United States Patent 10,233,495 (METHODS AND COMPOSITIONS FOR SCREENING AND TREATING DEVELOPMENTAL DISORDERS) - sequence listing, part 164

SEQ ID NO: 967 - DNA, 2304636 bp, Homo sapiens
acaagctctccatgtgagctgacaggcgagtggaaacccctcgagtcacgctgcccggcggcggagggagcgctcgcccgcagtggcaacagctgcaccaccgtccccgtcgctctgccttcctcttctgcagcctctgctcttctgattacctccctcccccgtcctttggtgatttttttttttcaagaaggagagggcggggtaggtgtccgttccctcccctcttccccctcctttgccttcttggtttgaatttcctcccccggcgttgcactggcacacagtgcaagaggcaatacccgcacggagggagaacgaaggctgagactcccctgccgctccaagcccggaagaactggagcctggaggggggtgaggggagaagaggaagcgggaggggcttggcttcctcgcgtatttgaggacagcccatctcccttcaagaaccctacggagagtcggactgcatctccgcagcgagctcttggagcgccgccggccgggaggcgaaggatgcaggcggctccgcgcgccggctgcggggcagcgctcctgctgtggattgtcagcagctgcctctgcagagcctggacggctccctccacgtcccgtaagtagccgtctcctcgctctgctctggagcagtttcagtgcggcattgatgtttggcaccagggtatcaactccgaagtgcatcgcagtgctggcaccctgatgtgtttgtgtctccgctgtcacacacttgcagccactgcagtagacaaactcgaaacccagcgtttctgttttggaagagacagggttgtgacgctggtgatgtttctggaaagttgttcctggtcttggtgatcggttggcaagagcttggctagagagactgatgtagatggcagcttcttaggagttgtttgtgcagggagagttaactgcatttggcttaggtaggtcagtgaatgaaaagtgaagaccatggcaaaaccaagtttcttatttttatttatggttataacttaatgagcacggggttgaggttaacaagaggagcatgttttaaacagtttgggcacctatagggtctctttaacctctcccgttcccttaaaaagttaatgcccatttagtacttgcttattaaaatggaaggcagcgaaattgtaactgaaattgctttaattctttgatactttgatatcatggatatgactgatgcagtacggtacttgggacactcagtgcaaagcgtcgttaatgtagtaataaacagattcttaatagggttttcaggaaaataattatattcaatatgtatatctctgcattttaatcaactgtgtgtgtgtgtttgtgtgtgtgtgtgtttaagactgcccctgttttcatgaggtttagaaagaaatggaagattctggcccattttctgcattcctttagaagtgcatactgtgcatgtagagaggaaatgcatgattgttcctttggttcagaaagagttaaacactagaaagactgcctataggaatcttaggataatattcataagcgcatactagtttctgagaatgagtaagttgataaagaattatcgtggagatttcagagtttaaaaggaagatttttttgtccatttaggaaaagaaaagtttaatattttccagaattcgtcatatgcgaagtagtctttgtttctaagattttgggatgtattaatgcatctttgttaataatgatcttattgtagtggtaaatatcaacaggaatagcattgaaaaaggacattataagttgtaataaggaatctactatataatatccggttatgagccagtattactgttttgacatatcttcctaagtacagtattagcttttcttttcccacaatgtgtaaagataaggagataaactaactggcaatctaagtttgtaatgaacttgaaaacattgtatagcattttttataacacaagttaaatcacaaagagttaaatattgttaatatttatgtcaattttataaatttaaacaaattttggggatataatgcttgctgttgatatttacacaaatatgtaactctatcactgggaaactagtttgatgaaatttctgtttccatttcaaggtctggttgtatagaatttcctgccacttttcctggaaaataaactcctcatatattaaatttattatattcactgattgaaggtcctcatatccagggtttttcctgggttctgtgttccatcattctgtatactttaattttgatgggtccatctgaaacatctgccatgagtagcaaatggaacactggcagcccttgggttaatgcattttaagataaaaaagttgttatttcataaatattttctgagttttcaactttatagttagaatttgaagacagagaacatagaaacaattacttttaagatggttaatagttatggccattaagattttttattaacttggctttcattctctattgtttaaaaatgtgtaatggcttaattaaggtggctttttatttcgtttgaatttaaactgtgtgaccaaaatgcaaagttgccctatatcctggaaatgaattaaataataaggatgctacagaactttattgattagaatgagtttcatggattcagtactttaaatatcaactgtactttacattaatgaacatttttatttacattatatatagctctgaagaaaagtatgatagttatattcttaatataaaacattcaaaggagaaaaagatggaaactacatgaatctaagataatgagcaactcaaccaggagaggtcatcacaagacaaaaagtagcatgaaaatctaaaactatcatttttctttggtacacatttttaaaatgtgatgagtatgctaaaactttctgttcctaaatacctttttaatatgagggacagaagatgtttatttcacaacaactgcatttcaaatatgtatttgcttatgacttatttctttttctctgtcgacagacatataaaaactgttaatactatgtgttgtacaagcagactagaataaacttgaaaacaaagctcatcactatggttatgtaaaaatataatctaatttctttgcagatagcgaaaatgaactgctgctgagctgatgtaacaaatcgtgtatcttcccttcctgtaaatgtagatacacgggacacacgtgggaagtttaaagaaaatatttcactcttagggagttgcatttatttgaacatattataaagaccttgatggtgcagttctaaatgatgaggagattaagctagcgcttaataaattcactttttagagttaactgaattttcacttaaataaatgatctctcataaaggccaatttacatcatttagtagaactattaacctataatttcattgaccaacacatttgggaaatgtgttttgaattaattcacatattctctaacaaatacgattttatacgtgtatatatacacacacatgaatatatatgtgtataaatatatatgtatttgttcatatgttttataaaaacatttgaatacatgttataaagtacatagatacatatttaatatagcacatatattaagtattatatgtaaaaatgtgtatatttatatattttctaaaacaccattcaaggaatttaagttgtttacaagtttatagaaaggtctttttccagtgcaattattttaagtaactaacgcaacaatattaagcaatagtatattagtctattttctcttcctcaattcatatacttctcccaaaatggtgtattttaaatgtaaaatatgtaaatgcatataaaagcaaatactgctggtttatagagaccttgaacataataatgaacttgtcttaatgaaaacaatttaaacttaaaaggagctttaggcaagcaaaattcattggttgataaagcatagcacattatttgcttaatgcaactaataattattaactaattggagagaaatgtataatctcgattttattataggcacggatattcaggaagtaagaatcattgttcaaattttactctttaccatcaatatatggcaaaattgggcaaaaaaattaatccacaaatttaatttaggtcttattaacctttatgcagttataaacctacaacgtatcattttagatgatatcaaagttgtttggtgcatatcatattttaaatcttacagttatgtgccccataatgacatttcagttcaatgatggaccacgtgtatgttggtggttccataaaattataatggagctgtcatatataggtgtgccatttttcatcttgtatattatatttttactgtatcttttccatgtttaagtatgatgagatacacaaagaggcattgtgttataattgcctatagtattcagtgtaataacatgcagtacaggtttgtagcccagaagcaacaacccataccaaatagtctatgctatgtgtgtagtaggctacactgtctaggtttgtgagtgtgtactctatgatgttggcacaaagacaaaattgcctaaggatacatttctcaaaatatatccttattgttaggaaatgcatgatgatatatgttttttgtctattttaagtgggaaaacctttcaagttctataatttctttgagatttaattcactgttccttattagtaaattcttctagacaaaaacttactcaaatgtcttaaagtttacataaagcttcctttttttttttttttttttttttttttgagacggagtcttgctctgtcgcccaggctggagtgcagtggcccgatctcagttcactgcaagctccgcctcctgggttcacgccattctcctgcctcagcctcccgagtagctgggactacaggcgcccaccaccatgcccggctaatttttagtcttgtgaatcttttttatgattgaaagagaagaaatgtgacatgtctacacatgtcatctgtttttaaaaagtagatttttgtatttgttgtaaatggtatacagaatcaggagagaatctaggctcagaaattcttaattcaaatgtgcttttctttaaaatattaaacatatggagatccaacttgtgcaagttgtctgtttagtgattgatgtcagtgggatgaagaaataaaacatgtactttaaagattttcccatctctagtcctgatttgtgaagtgctttactttatcattttttactacttgcaaagttataaaacagcgtatatagtaattttaagcctcaaaaccagtgttgtgtgaaataaaataaatttttatatttatatctgtaccagtatctgaaactggctgttacctgtttctagagagacacatattttaagataagtagttatcagaaacataaggtatatttctacaaccagtattgggctgctgaaataaattatatgcttatttttgccattttaataagtaagaataatgatgcaatcatttatatacagctgttaattttcaaatgaaagccttgaaaataatacttgtaacagagtgattcactaaaacactggattttcccatctcctgggctctgtagaagctatatgttttagttctgagcagataaggatgttggaatgtggaggtgcttcctctttctccatcctaacagttcattttatgggaagaaatgtccgtctatcacactcttagagtctatgtctacagttcattcgttccttcctatgttaggtagagttacttatctgtttggtgactatgggaaaaggacctagatgtgcttagctcagcccctcctttctccttccaggctgcctgcagaaagaatagattctgctgaacgatagataaaagtaggctttgcctctgcactaatagtgatagcgcgaagagccttatggtgttcggttcttcctatggcttgagactctgtttaattttagaaataaggttaatgaatcccactgtatcacacatttaagccttattcttttgtatcagcaatacttatataaagaatgttatttcctctctgtgagttattttctaatctagaactcagagaagggactgagattgactgtactcagtaaaaccacaaatatattgaaattgccaaaaataagattgatattaaactaaatgaacatgaaataatttctgcatagtttagaaactagtaaagaataagacttggtttttccattgatattgagttgaagatttggtgttactctggttaggacttccaaactctcccattcattcattcattcattcatattcctacccagtgctatccgtggtattattttacagagatgcttagaataccgtttctttatctgtggtaaataacattgccatttaaaatacagcctatttacaaactttagccagtacacatccaatttcatcctgtccatgtaactatttagtaaattatatatgcctttagttggctgttacatcatgatccttctgtaaaatcctgaaggttaaatgttttaagccaattattctttccaacaaagcatttgcacttagaaaacaaaattgattctttcttcaattgtaagttttgaaaaatatcttcttaaactcttctttagttcactttggaggtagctattcataataacagcttgaagtaactgattttttatgacactgcagattttaaagcctcccctgatagtaggaaatctagatataaagatgtggttgttggctctgaatttgcttgctgaagatcacatattttgggtatactgtaaaaatgttgaaaaaatacagaggagctcctgggggccgtattctgtatttaccttgtgatttaggtttgcttgaaataccctcataaacataaatagtgatatatgctttaatgtttttatgtttaggaaagaggtgaaattagattctgagaatacttttaccaggaaaaattccccaaacatatataagtttttccttaccttttctagtacattcacaaccttcttcatctgcactgggatggtgatctggaaatgtgaatcatagaaaatggcaggcaatagaggtgtgactggcatacgcactgtcaaaattactaaacctgtgttgtctggaacatctaagatggaatcaagttacataaagtttagttaaattcaggaaggatttgttcacctctatgcattagatgtcatattgaaatagtatgtgaaaaggaaaatcttgcctggactcacaatttttatttactgttataatgtcatctatgctgttcaattatagtattatttgaaaggaatacatgaaaaaaataataggcacagtttgtattgttaaaaaaacagtctgttaagtggtgaaataccatgatatgccaaataaaataataactctaagaaaattgtcttaaaattaaaggtgcttctatttttaatagaaaaggcttgaaaccaacccaaatgcccatcagtaatagactggacaaagaaaatgtgacaagtacacaccatggaatactatgcagccataaaaaaggacgagttcatttctttgcatggacacggatgaagctggaaaccatcgttgtcagcaaactaacacaggaacacaaaaccaaacgttgcatgttctcactcataagtgggagttgaataatgagaacacctcagcacagggaggggaacatcacacacccgggcctgttgaggggtggagggctaggggagggatagcattaggagaaatacctaatgtagataacgggttgatgggtgcagcaaaccaccatggcacatgtatacctgtgtaacaaaccttcacgttctgcacatgtatcccagaacttaaagtaaaatttaaaaaaaaaagtgcttattgtcacttctatatcatagactgaagtagttattttgaactaacagaaaacacatgtggattaaattttatcactgttaactgattttttctaagcagtcacctcttaatgggaaccaaattattaagtaacataagtacagactgtctatatatatatgtctttttcagacattggtcaaaaatttataaacagaactacatgaaaaaatttcagcctaattatgtcacatagtgaaattatagcatattttatgggtcttatttttaaaaatttattaagtacgtgttaaataatggcctatgatgcattaaattacttaattgctaataaattctaacttaaaatgtaaattgttacgtagcatatttgaaacattttttggttcaaataaaaatatgtctggactataaaatatgactatcaggttttcagattatgaaactattatactagcttagtgtttttaatgccaaccaactgaagaaaacatgattcgggtgtttttttctatgtattcatagcaacaataacacaatgagttcgatgctgccatcaatactaatgttactaattctcatggtattttactcagtggatttgaatgtggccatagaatctttctccacacaatatgccagacagccacgtataatcccatgagatttggtattcaatataaaactttacttttttactcaagttatatatattgccaccaccagcagtttttcagctaataaagtatacttatgatttaagtcacttggttaatgtcctcatccctaaagaatatgttaaaacgaatgcttaacttatagtagaagagattttcaatggcagtaatgaaatttccaaaaatgaaatttaatcatgcctcatgcacttctgtagtatatgtaagttttatttatatatcttaacgtaagcatttaagttattaagttatgactagttaaaaggaaatagtagcatagttaattgtgtttttgtatgtccacagtacagaattaagaataactattttggccaggtgcggtggctcacgcctgtaatcccagcactttgggaggctgagacaggcggatcacgaggtcaggagatcgagaacatcctggctaacacggtgaaaccccatctctactaaaaatacaaaaaattagccgggcgttgtggcgggcgcctgtagtcccagctacttggaaggctaaggcaggagaatggcgtgaacccaggaggcggagcttgcagtgagccgagatcgcgccactgcactccagcctgggtgacagagcagagcgagactccgtctccaaaaaaaaaaaaaaaaaaaaaaaaagaataactattttattgtgtcagttgacaaaaatagtaccgtgtcagagataaaaatgtgccgtggtggggtattaacattgcttctaccattaagaacataaacaaaaacaaccttattccaatattctagatactgagggggttatttttgtggaattgattccaaagacagggatgcttgatcaaagaagatgtttagtttttggctaataaatgttgcctgattgagttccacaaattctgtaacaatttacattttcagcatcaatcaatgagtgtccttttctagaactccaggcagcagtacatattatacttataaaacgttctgcttgtattacgtaaatagctaatatttgttgtgttgacttcttattaaatgtttcttcccagcctttcaaatcaggcactactctttatgtgtactaggtcatttatttcttataacaatgcttcagtttgcaaatgaaaaaatcagagacacatggagaagtaacttccctgggccaccagcttggcctatttccaggtccagtgctcttcactgtggcatagctggctgagagtgaagtgctgtctctgtgttcaagttctctaactaagaagtttcagcttacatctaggcaacattttaaggcttgattgcttgtatataaaggaaaaagcctattggcataatgtttctatctttttgtttacttattccttgatgacactgtcatatgttctggagacttaaaaattacattggtaaaaaataaagaaatatatttgaaataaagagaggaatgcagctctttcaatggtagcacattaaatcataatatatatgtcatttttgttcttcttcacaataaggtacttttgcagtgtagttctatcatttgagtactattgaaatacatgtaatagtcatgtagtgaaaacatttatttaaagctatgtaaaatatttcttaaaatgctttgtcaggtatacataaaagctgtctttaaatcagttctcaggaaatgttgaagtctgtatcgaaaactgtaaatatgattgctattactaaagttaaaagatggtaattgtttaatctataagcacagttttgagtattcatttcatacaatagctaatccatgaagcttttcttgagagtgctgttgagaaaataactttttcctttgctttcatggcagtgggaaaatatttgtctttaaaatatttgccagtcctaatgcttaaatatttcttgtatccatccgctgctctccattcctatcacagcttctatagttaagattttcagcatttccctccaggcattaatttagtagcctcctggtatgtctcccggattctaatcttccccctctagcttatcatctatatctatgccagaaatactttcccaaaacacaaatcttgttatagtactgcatttctctagttcttccctgtctcttaaatttagtctcctcctaacccaacatttgcaccctataatctaaccgaccatactgagatctttgcagtttctctaacacaacatgctgtttcgaatcatatttctcttataccttgttacattttgtcccctcctttcatttttcctgttttatctatgctgttttagaggaaactcatttacggtccaagcctcagaatcttggagcagactgatgtatcaacacctccctgtggcaatttgctctaatcacaggtgaaatactaagacgcagcaggcaaattctttggtttctgaacttataaggaacacagtgatcacaaataatgaaaaccacctccaattatctgatattaaagtgagaaattaccccatagtatcgacaacagaaggaaggcgagaaatatattttcaaagaataaaccacaaatattttcctcattttataagtaaatgtgtatctatcataagggaaatttgaaaccatgctgtgaaagcttacaacttctgcaaccctttttctaccggattttattttaaaagattttctctgcttttcttaagccacatgggtgatcacgtgcctttaaacccaagcctgactgtcctttccacaagctattatctgaagaattatttgttatctgcatgcaaattaaagacgtgtcaacaaaataattattgcatctaacaagtactttaaatagagtacttaagatgtcaccaaatcttctaaatgatagctgtagcttctgaaaaacttgataactatatatatttagtgtgtaataatccagcagatgcgttgatattgttgaagttgttatgaaatgtcaatgaatttcatttccacttttaatatgacaaaaatataattttataagtataaaaatagttacttctattctatttgtttatattttaaactccgtcttcatccttacctttgcaacttagtacacacttctgaaccatttcaaagttggccagtctagcgaagcctgtttcaaattttatattcttcacaatgatccctgcagtgatgcctactaaaaacacattactctcttttctattagtccacaatctgcatgagcagagcctgtattttttcccttaggctgataggtattagggaatggttgtattaaaggaactagactttagtaaacatgtttcatcatattaggtactgtactggttgcattataccattacatgaaattagcccaaatacctctgtgctgtaatattcaaagtataaggatgctcaagcattttaaagctcactggttccatctttatacagttcttacttttgtcaagtccttccttgcattgatacagatttacactcccataaattccagccagtagttctagttgggcttctcaaataaaagcttaatatttacccaatattctactgccgtaaaatacttgaagacaaatatagaatctaattaaatataatttaagacttagtcgctactacttttatagatagccaactaataccttgaagacaaacacattccttaaaacactgtgatttatatttacttatgtcctccaaattacccaaatatttctaggtacacaaccagtgttaaataaatacaattgaaaatggaattgaaatgggttagctctgtatacaaattgtttcttaaagtgcttatagctaggttatagcaacaaatatacattgttgtgttttgatagctaaaagcatcatactaagaagtattataattgtaatataatgttagttgcaaacaagtgtgtctgtaagtaatcttggtattacagaaaaaaaaactgccttaaaacttacatatctgtatgagtcaaaaccaaaaatgaaacagaaatatttaaagggactgttgtttaaaagtaataggacaactacagttattttaaaagatagtttatacttatttgctcagtgtgaaataaaacatttttaaattttaatttattatctactctttgcccaaagtatattagaaaaatgttactgcaatttgagtagtcttcatattgtgataaaataggtaattattatatgcaataatctgaggcattttcgttttacagagcatataatcacccacgtatcaatttttggaatttaaaatgtgttgttggcacaattagaatcatgtatctactttcaaagagagatttcagaatattgcaaataaaaatgacattgtttcttttatcaaattggcatcaatagggcctttttttcaaaaaaagcttttagatctgctatttgttcatttatatgtgtataattacagtattcagaggatctctcatgctgtgtttgtttccacatatggattttcaaatgacaaagtctcaagtggtggcgctaaagacaaaccatgctagctactcaagcatttccttcctggagttgtactgtgtcaactgctccctaagaaatgggtaaagagggactactcagaaacatgcattgagcatcagcatgtttttgaaagattaatcttctagacctggaactaaaagtatcttccagttattttctttattatccactttatcagcttccacataacacattcagttttctacattttagtttaaaaattgccatttaattctatgcttctatgaagtcacatatcctacttatgctttcttaatttcaaaattatttgcactgtccattttataatattttatctatcttaataatttaccttaaagttctcttttattgaataggtatgacaacatagaaattaaaattattgaatcattccaattagtccacaggtaaggtcatcagtgagtgattaaggaaactctttctgttataacattttagctaaaacctaaagaaaaagccaagcaaacagcaggaaaagactgttccaagaaaaagaggacaacctcacaattccaacattggccaagtttggaagtcactttgatgaggagatatttagtggttttggaattagtcttctgttaaacgtgtaatgaaaagaaaattttgaaagagtaaattatcccgcttaattgtctatcagcaaatagaaaagaaattttcactggttagaaatataggcagtcgggccgggcgtggtggctcatgcgtattatcccagcactttgggaggccgaggcaagaggattgcttgaggccagaagtttgagaccagcctgaacaacatagcaagactttctctctacaaagaaatatttaaaaactagccaagtgtggtggtgtgtgtctgtactgtagtcctagctactggagaggctgaggtggaaggattgcgtgagccccggagttcaaagctacagtgaataatgattgcaccactgcatttcagccagctgagacaagagtgagactctgcctcttaataatttttttaaaaagaatttaggtcagtattaaagtttgtgataattcaattatatttagcttagagaattttgctaataaaaataactttgataatttaacacatatgtatgttattgaaacagcaagcattttgaagaggcaattttctaaataacctttatttcaaagtgtattgtttattgctgtgttagtttgttttcacactgctataaaggaataccagagactgggtaattgataaagggaagaggtgtaattgactcacagttctgcatggctggggaggcctcagacaacttacaatcatggcagaaggcaaaggggaagcaaaggcacgtcttacatggtggcagatgagagagaagagcatgaagcgggaggatccccacacttaggaaacaaccagatcttgtgagaattcactcactatcatttgaacagcataggggaaccatccctatgatccagtcacccccaaccaggtttcacccttggcacttggggattaagagggttacaattcaagatgagatttgggtgggttcacagagccaaaccatatcaatcgctgactttaaagaaaacgaataatattgtttccaatctttacatagtttcacataacatttttgagagtataactgtaacccaacatttacaatatatttgtagttattttttaatgtgaataaaggtaatatgactcatattcttaagaatttccccttggcattactatgttctactgtttcaaaagtttgcttactttaataagatttcaattatttggattgttaatacattgagatagcgactgaggtttattctctcatttaacttatttttcatcctataaatgtaaggtgtacaatataatattttgatatacagagtaaactgattactaaaatcagaacactaatatattcattatctcacatagtttttattagagaggtatgcatttataagctgccaacaagtccaaggattgttttaaaatgtatctttcattcttattacatttgtgacttcctgggttccatgccaattgtttgtttttaagaaatgtagtgttataacaagattgtttcagaacttcaataatatgcaccttcaaatagaatattataggtcttgctttataatttgtaaactttcagcatctttgcggcttaactttgcaacatacttcaaagacttaggcttcatctaatttgacataaaataaacaataaccagcaagtactagatgattatgcatctgatatggtttggctctgtgtccccaaacaaatcttatcttgaattgtaatttccacgtgtcgagggagggaggtaattggattatgagcgcggtttcccccatgctgttctcgtgatagtgagtgagtctcaatctgatggtgttaaaagtggcagttgtttcctgtgctcgaatttactctctcctgccaccttgtgaagaaggtgtctgctttcctttctgccgtgattgtaagtttccttaggactccccagttatgtggaacagtgagtcaattaaactttctttgtttataaattacccaatctcaggtagattctttatagcattgcgagaatggactaatacagaatctgtaataaactcatgcagtatctgtatctcagattgtatctgagattacagtctctgctaaaatacgttctttacagatgatcaatttacttagaacataggccaataagtggttatacacagatgtctgttggccttgaataatagcactggccattgtcagagttggtattggggaggttggtgtataaagagtacgaacttcatagagcagcaattctcatatgctaatatgcatataaactacctggcagattctgattcagtaaatctggagtggaacctataatgtaacatttatttatttatttgtttatttatttttttattatactttaagttttagggtacatgtgcacattgtgcaggttagttacatatgtatacatgtgccatgctggtgcactgcaccaactaactcgtcatctagcattaggtatatctcccaatgctatccctcccccctccccccaccccacaacagtccccagagtgtgatattccccttcctgtgtccatgtgatctcattgttcaattcccacctatgagtgagaatatgcggtgtttggttttttgttcttgcgatagtttactgagaatgttttccaatttcatccatgtccctacaaaggacatgaactcatcattttttatggctgcatagtattccatggtgtatatgtgccacattttcttaatccagtctatcgttgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttccagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgatgagcattttttcatgtgttttttgtttgcataaatgtcttcttttgagaagtgtctgttcatgtcctttgcccactttttgatggagttgtttgtttttttcttgtaaatttgtttgagttcattgtagattctcgatattagccctttgtcagatgagtaggttgtgaaaattttctcccattttgtaggttgcctgttcactctgatggttgtttcttttgctgtgcagaagctctttagtttaattagatcccatttgtcaattttggcttttgttgcccttgcttttggtgttttagacatgaagtccttgcccatgcctatgtcctgaatggtaatgcctaggttttcttctagggtttttatggttttaggtctaatgtttaagtcttgaatccatcttgaattgatttttgtataaggtgtaaggaagggatccagtttcagctttctacatatggctagccagttttcccagcaccatttattaaatagggaatcctttccccattgcttgtttttctcaggtttgtcaaaggtcagatagttgtaaatatgtggcgttatttctgcaggctctgttctgttccattgatctatatctctgttttggtaccagtaccatgctgttttggttactgtagccttgtagtatagcttgaagtcaggtagtgtgatgcctccagctttgttctgttggcttaggattgacttggcgatgcgggctcttttttggttccatatgaactttaaagtagttttttccaattctgtgaagaaaggcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttgtaagttggattcctaggtattttattctttttgaagcaattgtaaatgggagttcactcatgatttggctgtttgtctgttgttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctgtcttatgccagttttcaaagggaatgcttccagtttttacccattcagtatgatattggctgtgggtttgtcatagatagctcttattattttgaaatatgtcccatcaatacctaatttattgagagtttttagcatgaagtgttgttgaattttgtcaaaggccttttctgcatctattgagataatcatgtggtttttgtctttggctctgtttatatgctggattacatttattgatttgcgtatattgaaccagccttgcatcccagggatgaagcccacttaatcatggtggataagctttttgatgtgctgctggattcggtttgccagtattttattgaggatttttgcatcaatgttcatcaaggatattggtctaaaattctctttttttgttgtgtctctgcctggctttggtatcagaatgatgctggcctcataaaatgagttagggaggattccctctttttctattgattggaatagtttcagaaggaatggtaccagttcctccttgtacctctggtagaattcagctgtgaatccatctggtcctggactcttttttataatgtaacatttctaacatgctcccagatgatgctaatgctgagactgatctatggaccacacattgagtagcaatattttaaactttgaatctataatgaaagatgtcatagaaaatttcctacttattttaaaattaagaagcacactttagaggaagaaaattttaaaaatatataattatgatatctcatttttattttgggtataaatagaaggtataatagtgtagttctatgatatgattagacgaaaaaaattcagaaagatgtagatactccactaactagttggatagccttagacaatttatataatctctcagagtttaagtttttgtagttatgagagaataaaactagattatctctaaaatccattccagtttttaaatctatgattctagtctcctaggcttctgagtctgagaatggagaagcacctcttataaacctcagtcttgcttttatatctaactggagatttggaatagagtttccaggttatttatgaagtttaaataatattatacatatgagtgtggtgcttaacaaattgccttaccaataacaagtgcctaactaatgttattaatgtttcctattgacaatatttttacctaccttagtaaaactgaatcttagaaagtgagttaacttcttccaggacatacaggtttctagacatatgctgaatcactgtataataacaaaatacctatgtaattgataatatattagaaatatacctttaaataaagccagtaattataatgaaataagaaaaataccaaggaagaaaaaaatgcttgtctctctatgttcaagctggtaaaattccatcaaaatcaagctaatctcaattacccaaatactctgtcctcttgtttgatagtctgtgtgtgcatactcctttttattctaatataatagtgaaaatattaagcttaccgatatgtaaatagcccccaattatattgtgtgatgtcatgtttgtaaagcacacattcatttactaaaattattcattgtttattatttatagctattatttctactaataaaaagcatttccacacatgagcaaatgtatcaaaaaaagtctaagaagatgatcagattgatcagtgtactctatgcccttcttaatagtaactgagtgtgattttttacattgcatactgccagaaatcaccacatgtagcatggcagatggctgccaatagtcttgttatcctttcataaattatgtggcatttatgccattagggtgatttttcagtttagaaaagacaactaagggtcagtcttttctatgataatggactcacaagggacctcaaaactttaccatgaacatattttatatcttaagttatcttccagagactttgaatgtttgaagctggttgaggtcgggaagtcaggacagaagagggagtagagcacacctgctctaagtataggcatttcaacgttcagaggaaattagtgtggcgtggaggggcaccaggggtggtagagagttcatgctgtgctctctcgaggttggattctacagaagctcagcgttggtgtgattgttggttagtctggtgtggtttggtttggttctttagtaggtggggcccctaagaacctgagtaatgtccccatgcactagttctgtaaacgcggaagcaggtggtggcagttaagtgactcacactcatttaggctctaagccggccctctcattcaatatccagcaattcgatttctactgttgggtttacgttgctttgctagtctggggcctgcttcgaagtgtcaaaatagcagtgccattgttcgtggtgaatttccagcaaaagaaacagacagaatgttttagcaccaagttgtgtgatttgagattaaaatgctctgcatggctattcctcatgatggcacttttgagtgattactacaagaaaaacgaactgttaaaatttgaaaaggggaaaatgttggatacagctcaaatgatccatatcaactactcagttattcacctgtgttaggtatttcccaacttttcttggggtatcctttatagagtagcctttgtcaagtctcataaaaacagaactaatatacttccacagtatgcagtattaattttatatttcgatttgctctgaaactttgttctctcttgagactaacaagtaaatcataaagtgaatatttttcaatgtcgaagttgttctgaaagtataattttaaaagttctttcgggccataatatatgcctttggagaagttaatatattattgaaatatctacttatttcatctgccacatgaaaataggactgtttcatctgtccttaaaagcaaggtggaatatttgcttcttttgaaatgtctgtggcattttttttcttttgcatattctgcaacacaaagaaatatttaggacttgaaagaagaaggtgagctgcttgattacgctgtactagcaaactgtgaatttatgttatttacaaattataattaaaagcctaagaagaaaatgcatgcattattttatttaaagaaaagcctctgcataaaaacactcatggaagagttattttcaatttaaaaaatagatgattatgtgtaccataaaatagatgatttcatgtaccataaactactatagtaatttgccaagagataagaccaaggttaattttttttcaaaattaacttttaattacaatttaaattaaatcactttaagtaaaatcataatttaaaattattcttttaatcaaaaggtttttattttaaaaataaacatgtagaaaagaattatatatacttaatatttaattctttaaaagtttactgaaaggtcatctagttacttcttaatgagcaccatatttaaatatatttataatgaggtttgggtttttttattcttttcaaattaggtttaaatatttttcagttaaatttggtttttgcaaactacattccttgcacatcatgaggctaaagccagatatgtgacataatataagaaaagcatcctaagagagaaaacattctcaagctctaaaactataaaactttaagtataaattgatgataaatgtcacattgttattttaacattttttgtctgggaattctatgaagaagtaggtgcaaaatgttactatgtggaaaatgtaatgtactttgtgcattgaattttaaaatgacatggaaggtctgaagaacacagaaaggttgacagctcaccacagatttattaagtatattcaggtttttatctcaagatttttttaattacttgagtgttggtattgataaatttgttgttgttattactgagaacttaatatgttactatgtagatttcctaagttctctttcaatattactactgaatttgtaaatgataagtgatcatgaaataaacttatatgttgaacaatatagaccatatcattcacaagtattagggacatttcattatgggtaagaaatataacctttggacgtgtagaccttgtagtccatttcagtttgactaatcaacatgttcagtttataacatgtttgatcctctatatctctaagaatatatgtgtttttgtgtgtgtacatatgtgtgtgtgtaggcagattttatttagttgatatcatggggaaatctgttgctcacatagttgacatttctttataaatgcaactcacctcatcaaaatgacataccaaaagaactttaagaaacacatttgtaaatggcttacatattctatgctttcttaacccaaccacagtgtaaaaataattctgagtactttggaacataaccacaaacacttatcaaatatatgctccccagtttgcaattgggtccctataaatccactgtaagttgaaaatatagttaagtcgaaaatgcattgaatacagctagcctacagaacagcatagctaagcctcacctaccttaaacatgctcagaacactgacattagcttaaaacaaggcaaaatcatctggcagcatgatccactatagtgtattggttgttaaccctcgtgattgcgtgggtgactgggagctttgacccacttcttcctcccagcatgtgagaaattatgataacacagactgcaagcacagaaagagatcaaaattcaaaatttggagtacagtttctaccgaatgagtattgctttcacaccattgtaaagtcaaaatatcataagttgaacccttgtaagttaggggtcatttttatgctattttaattatgattgcaatgaccaatcaggtctgtggagctgttttttcccaccacaaaatggcttaagagtgctgtattttgctatcttttcttattgatattagaataactttttgactgttgacacttaaatttaaaagggtttctaaaaatcaatgagaaagattatggaagatgtgtttgtattagaagatgtagcaaacttccatttgaacaaaactctgcccaccttaagagtttcttctgtgtttatgattaatttgcttcaagatttctgtttgtggctgttgagttatcattctttttttttctcagtgtgctcattccttcattcagtcagttattttaaaaaatattaatttgttgcacaaatgtaatatgtctttgtataagacagacctaaattcaactaagggaccctatttaagaagtttgtggaaatagaagtgtttttaaggtccataaacatcagttttctcatttgtaaaataattggggcaataatacatgcttgagttcatagaaagtacatagcacagtgaatagcacaatttggggggtatttaacaaatgtcagtcatctttgcattatctttgtatgaaattaacatgtaattcataagcagttttaggtatctagcatttccattagctccagcgtccagtcaaagccctctgttggaatatctttgcagctacaggagtctgacttgatcaaatgtaacactttcatacctgtgtccctcccaccctttcatttgcttgactggcttctttgtatcagactatgactcaatggatttttccttttctattgctgaagaaagctccatttccaaaaattccattcaacaattcactacagcagacgacttataaaagagaaaatgagatatcatcctgtgttttcaagagtagataaagaagtagtagggttcttgcacagtcccagggttgatggcagagtcttcttcctgttcaatgtctcaagtttcatctgtccatctcctattcatgcacactgatgccatcctctgccatgctccctcatcacacttttgccacacgtgtctgtcctgaggcatctaatgtctgtggcaagtaaagtctcagaaccataccatgaagatctatggtgaatgaaataattaggtagatactaagacagagcatttaaaatatattctcatatattaattctcattcttagccattaaaatatttgtacttcaagtgttcggcttgaggttgaaaaatctgaaggactgacagcatctctcattatttcttttgggtagttaataaatgcttggatttcagttcttgatagggacaaacgatattttgttgataatggatcttcacttaaatcccatcatgcaatttactctctacatcacaaacaaccatgcgaagaaagaaaaagaatcagtgatttttctcttccctctaaggaagagattttcatagcggaaacaaagggaatattttggaaatttactgtggtgattttctggattattatgaagggggtggtggctgttgacatttagagggcgaaaatcggaaccactagaacatcttgcaatctgcacgtctggcctaccctacaaagaatttcccaccacccagtgactgtaggtttgtgcaattgcaaaatctctttacaaatttctgaatctggaaacaaactcaaatttgtatgtagatacaaagtatattgcatagttttaatgtgcactaattttctaaatataactacagtgtcagtggaggaaacgtactttgctcaggtcacaactgttttcaccatttcagaaagtcacagataccaatgctgctcatggtgtctaagtggcacaaagggcacctgtgtgtcagcctacatttgtcgttgttatattgaaggtgattctaggtgtgagtaaaacatctgactacttgattatgtcttctaatgtggtggtgcttgaatgtttacatatcaatatattattcgtgtagatcactatccttttattgcattgaaacaatgtttaaattttgtgtgtagatagactgtattttttatggatttacttcaggctgagggacagattgttctggtagccatttgttacttggttgtcaagaagcaagctaggttgatggtgaaacactataagaaatatagttttcattttctttaacatttgtatataagtgttctatatttaaataacaattacataattaaaagttttagattcacttgtgaattatttattaattgtaagattgtacctttcaagaaaactcaaccttattttttcctactttaggtggttttcttttcaagcattaaaaataatgttattgagttctattgatgaagttaaaaatctgatttccttttattttataattcattaggcattattacattttcactaaagttgcaacttgaaaattcctgtaagacacgcatcattccatataagaaaaatgtaaaattcaaatattgtgcaactcaaggtaaatttacaaaataaatttagtaagcattattaaagactcatagcctttaggttactaatatttaatattatagtccaccaggaaagatgatctcaaagagggctcagtattgatttgcttgttggtatttcagagatactgacagctgctatgacttctgctgttttttcttaactttgcccatactgagtttgctttgtatttccttgttattaacccacatctcaccatattgcaattaactttcacaataagcactccattgaatatattagaaatatttgcaatgtgaatagaaactcttaataagagcaggcctgctgctagatgataagaggtctgcatgaattagaaaaagttgcccttccatatcctgaacagatgtagccccaaagttcaggggttagtgaagagagggcttctttcttcactcccctcattcttttcctctggggagacactgtctttcacaacttcgtggacagcatgtggactaaatttcagacagacacttgccccttcagtgaggcatctttgtgcaaggtacaaactttatacacaggcatgatgatccctaacacaaatgtgtctatgaaagaaaagagaaaaataaagaacacccaagttttcatgaaagagcagttatacaggaatgaaagaagctttctaacaagaaggaaacagttgagagggaggaattaaagatagaaaaatctattgatagccaatctaatttccctgtttttaaaattcaagggtgattcactctaccacttatgagcagaaaacaaaccttagaaatagattacatgattacgatctatgtaaactttcacttcgtattaccctaattgggttctcttctaattctgtgtaaaataatacatcttttggtttatggtaagagagagccatcctactatgactgccaaattttgattattcccaaattgagagacaggaaggaaagtgtttacatttatcatattgtaaaatttgaaatatgtatttatagcccattttagaaatgtttcaatgtaagaaaatgacttttaaaaagaagtccaatgtctagaaaggcatccagtagttagtatgactgaagtacatagttagtttcttaagaactctgcctttttggtatttttccttttagggaataaataaaatcaagcctctcaaatgattttccaaatccagagccatgaagttacaggatgatggattgctaggctgccattgttatctgtgtcaatggtggtcttggaatcactctgtgtggctctatgttgtggccctctctgcacctcctaaagaatgacttcattgctgtttgacttttcaaatttccttccaaattgaaaactcaagacatttttcttcacattttattttctttttattatgccagtttaaaagtctttgaaaataaagaactgaaactcaccttcttctgaagtcgcaagtgagcaaacagaaataatggattggactttgttaatgatatgcctaaaattagatgttaagttattaaaattttagttttccatgaataaggacaaaaacctcatttctaaaaccttgtcacatttaaattacgctgtctcatttgagtctccagaaaattatgtccagtcttctgattgtcactcctataaacttatttttatttaaatgacataacctccagaagtataaaatgttgaaattcttttcagaatgacttgcattatagcttttccctcctgtggtattgaaatactatgtttcatattagaatgttttcaaatatctactctcctaaatagattagttaatggtattgtgtttcctgaaataatctgtgtaatgaatacgaacatttctacaataagtttacagtcttcttactttagagtatcatagatctaaattctaatttatttttttttttgaaatggagtctccttctgtcacccaggctggagtacagtggcacagtcttggctcactgcaacctctgcctcctgggttcaagcgattttcctgcttcagtctcccatgtagctgggactacaggcatgtgccaccatcccaggctaatttttgtatttttagtagatatgggtttcaccatgttggccaggctggtcttgaactcctgacttcaggtgatcctcccacctcggcctcccgatatgctaggattacaggtgtgagccaccatgcccagccctaatttactttcaataagcaaaattacactttgtgtcacactttccccacacacaagctttttgtgacttcctaaaatatttatttatttatttatttatttattttgagatggggcctggctttgttgccccagctggagtgcagtagtgtgatctcagctcactgcaagctctgcctgccaggcttaagtgatcctctcgcctcagcccctcaagtagctggaaccacaggtgcgcaccagcgtgcctggctaattttcatattttggttagagaggggctttcaccacattgcccaggctgctcttgaactcctgagctcaagccttctgcctgcttcagcctccaaaagtgctaggattatagatgtgagctactgcaccctgagacttttaataaatttaaaaaacaaaaaatagaaaacaaacaacaacaacaaaaaatttcattccttcctgttcccaggctaaaattactcttttgagttagtggatgagtgtatgtgtaaaactctagcttactttgctattgctgaatgggctgttgttatagccattgttattcattgacatttcagggctgagactatgtcattctagaacttcgactcatactctcatgttaatttggtataaaagaaacataatgaagaaagtgtatttatctcattattatttgttgtgttgtttcttcctgcctctctaaatcccacttttttgtacaactaattttttctttcatcaacttttctattaacagcttttgactttataactgcagctaaatggatgataaaacaaaataaggtgtgacacaaagaatgaaacagtgaatggaagggcttaggtataatggaaggaaatgtcaggaagaaagtcccagatgacttttcaaaacttcagggttggcagtagctcatggtgggagagatgtaactcagttgatggatttgatgaattttgtccaaacgttggaatttggactggtcagatacaacagaaagcccccagacagtgactctgcaaaataaatatacaaaatgtgatcctgacattcagaaactcatctttttctgagatgctttaggccatttttcgtgattgaaagaaagcgacaacagctctatcccccgtgtccatgatcagagaaagagaaagaatgaagattcaagggccgaaagcgtgaccagctgagtcacatttgaagccttcctgaaagcctcactcagtgacttctctttaaacagctttagctagaatgatggcacctggcctctcttacttccaaattagacgagaacatactacattttagctgggcacattactatcccaaaccaaactggggtgctattagtaaggaaggaaaagagtagatactgggcaggcaattagaaatctttgcagcaagacattcgggaaaggtattatttagaaaagtaccaaagtctttttgtgtccttgatgtggattgaatagagtgagaaaaattgcctgtgtgccggtttcccagtggaggtacatggagaaataagaattgtttccttctgcatggtaagcagctctccttgtccaattgtcccctattactgaccatggtcccacagcaatatagttctatttctaggaatggactaggaaaaaaatcccagaggagaaactcccacactgatttctacttctaaaattcaatgtatttgtacctcgcgtctctagaaaaattgtgttttagtatatcagcttttgaagacagctgtacctaaatccagccatccaaatgggacaaaggaagcagactttcaccttcagaagcagccatgagtttgtgtctgctgcattgcactttcaatatctaggacagaatttcatacttattatataattacagtaatacaatttgttattaaatagttgccaaacaaaatagaaatacaataaaaatttaaaccactaacctttaaatgatatattttgttttaagaatattgttcagctcagatatcagcagattaatgatgagtacaactaaaccccaatcagttgaaagaaatgtataacatatcattttaagatctctgtagtaatttattttttaaaaggaacttaatatcgtggattttaaataattgaaaatattttttacacttggactaaatgttcagatgatttttattatgcaaacatcacatctaattaaagatatttcaatattatatttcaagacattcagtaaccattcattaagggctgaatattatatagtgggataaactaaggccatagaatatttatgtccccagccataggaagttcgccatttattggaggagataaacacacacataactgaatttggttttgatcttcctctgacctattctattaattcaataatgtaggcctaatcattattgatatactttattcttgtcaagatttgccacattatttgccttgaagttatttattgcaaagggatttgttctctttaatggatggctctgcattttagcatatgcgtttgtctttgagaaaccaccaagaccaccaggctaagacattgaataattaacttgacataatatttataaagtagtgagctagaaagttttgaaagattctattaataaaaatggttcatcaaatttcgggggcaaatgccttaaacatttattaatagctaaacaatatatgaacttttcctgaggaagaaaacatttcttcctaagtagtttctaagtagtaaagtctaatccagatcttgttatatgcactgtagagttcttttttcagaaaacaacattgcatagtctatatttctttttataggacaggcagctgcgttagtgaatgattcactaatggtgcgaagtctttctgtcaaacaaacacacagttcacttagttgggcttcaagtactttagtttttttcctaaacaataactgtctttaaaagaaagaagctgtgtaaacattgaatacagactttaatttaagacagatgataacccggaagtgaccacttctctttatcatcaaaataccgctgaagccccagtgattcaattgccaggaattcttctttgcttgaatttgatcattcttctttctctttaaaatactgttgttaagcactggatcggcaatgtggcattgtctctagggattgaattatgtttaattgggaaggaagcacactctctcttgtttttagttcataaagtaagaagactatcaattagtaggcagtgcagcccaattggagccacgctgcactacagacagtttggaggagattcatagtaacaaacaagatttaaaatacatgtcttgtgaaaggccattataggtggatggctgggtttttcctgtcttttcatgctgtagcagcattatattagaatgtgaaggacactcatatccataaaataatggctttcgtaatgcagatgattaaagtaggaagcctacccacttctatttttccctaggcatataccaggatcaaatttcaattagtgacctaggaactgcaggctctgtattctgttatcaatccctttagccagctagaatcaaagattcacctgtcactctagactctcagtgactctaaggaggatttagaatagacatctgctctatcctgttacgttgacttctttatactgtctgtctacaaaatgcattatgaatatacagtgaacattacaaatattctaaggtccattaggaaatttcattttctgtggacaaggattttaatgttaaatattgatagtgatttctgctaatttattgttgatttgctaaaccaggccattttacggaaaaattttaaatatgccctgttgatcaggaaccaatatatatatttttcaaagtgtcagaatggttaccttgaaatcatttttagatatgaattgcagaattcctagaaagaaaatatgctctcttataggactgtgctttatcaggaaatggcaggttatctagttatattttaaagataccaaatttgtttagtgcagattttacttctatagtgctcaccttgatgagcatcacaatgatgttcttttatttttaaaatgatgcattataatcccattagagcctttgccaaccagtaaattattaataagacgatgatcatgctaattaagctactttattagattttgatggattttgtgccagaaattatggtggggtctttgaaatatatagagtattttctcttagagcaagtcgtctagcatcattgaaaactttactgaaaactcttcattactcataacattgctcgtctgtttcaaaatgacacgatagtcactttcacagaaacataatagtatgcaattcaaatgtttaatttgctgctgcaaaagaattcacaatagaattctcaatgtggggttaattacatagtaatgaaagagtaaacctattgggaaaatgctctaagtaacattgctctgtttcctactgataaagacgtgcacgcctgatttattttttatgctgggaaattcagaagtaagagaaaaccttgaaaaggtatgcacatgaataataaagttttttatcatttgtcaacatgatgagaaaatgatgaacgtggataattattatattacaaaggctataatcacaaaatagtaatgtataagaatatagcattctattatacacaggagaacatgatacattaaaatcattgataacataatctaaggaaagacatcgctaatcagaacaaaaaaaggaagaagtaatagagcaggcactcaaaattgtgtccatgttttctacaaataatcttcaccctctctgcctatgagtatagtgttatattgctaggtatgttatgtttactccatatatgtcaaagactccactgggggaattgaacaatgagaacacttggacacaggaaggggaacatcacacaccggggcctgttgtggggtggggggatgggggagggaaggcattaggagatacacctaatgtaaatgacgagttaatgggtgcagcacaccaacatggcacatgtatacatatgtaacaaacctgcatgttgtgcacatgtaccctagatcttaaagtataataataataaaaaatttggaccacaaaaaaaaatatggtatcttaataaatatctcaaaacagttataagattgacaatatgatccctactttgttaggtgaagaaaatgacacttttaaaaacataaaaagatttcctgtatgataggattcaaattcatatttgtttgtttccaagggctttttctcattcattatcctatgctgtcatgtaaattaatccatgaatattgcagcttgtatcagaagcttgaaagttcacagaaagaatcattttctacctaaatttgcccatcaaatttgggtggacagtgacagcagcacagtgttaggcttacttttaaatgacattatttaggatagtgagaggataaacaaatagactaaaagaacagaacggagtccagaactagatccacgcagatatggccaattgatcttccaaaaaggcaccaaagtgatgtaatggagaaaggaaaattgttttaaccaccagacctagaaaacttggtatccatataggaaaaaaataaatcttgatacttcataccatacacacaaaagtaattatagatggcacatagacctaaatataaaatcttaagctcaaaagtttctagaagaaaatatagaagaatatttcctggacctgagctaggcaaagatttcatagaaacacacaaacagcattagccacaaagaaaaaaaaaaaaaaaaaaagaccagtcaggcttcatgaaaaacaaaacaaggaaaacctgtgctcttcagaattaaacaaacaaacaaaaacactaagagaatgaaaaagctaagctatgggagaaaatattcacactatatatctttgacaaagcagttgtacccagcatatataaagatgtcatacgaatcaattgtaaacagacaacacagtaaaaatgggggaaagatttgcactgtttacaaagataaatgtctgataagcacaaaacatttaatgtaataagttattagctaaatgtaaattaaaagcaaaatcaaatactattgcacactcactagaattgctaaaattacaaaagattaacaataccaattgttggtgaagaggtgaagtaactaaactcacatactctgctggttggaatgaaaaatcatgtaactttgagaatctcttgggtaataactgacaaagttgagcatatagtcaccctatgacacatcagtttcacttctaagtatttactctgtagaaataaaaacatgtttacaacaggacttgtaaaaatatgtttttaataactgtttacagagagccagaatatattgcctaacattatttttatatataaaggttacagattttttatattaattttatatctttgtagattttttatttcttttattttaatctttagatctactactatatcacctacataggggcaatttaactcctctaattcttatatttctgattttgattctataattccttttattaatactctcaatagaacattaaatagtattgttgatagtggcccaactttaggtagaaatctactacattttttgaattgatgaatgaaaaattattttagacaatgtggaatgagtcaataatgcttattaccatatatatatcaccactaatctttattattttttgtaatgagaatatttaagatttactctcttattagtccgttttcacactgctataaagaaaaaactgcccaatacagggtaatttataaaggaaagaagtttaattgatactctattgagcatggctgaagaggcctcaggaaacttacagtcatggctgaaggcgaagaggaagcaaggcaccttcatcacaaggtggcaggaaggagaagtgtgtgagagtgcaggaaaaatctaccatttgtaaaaccatcacatttcatgagaattcatccactatcatgagaactgcatggaggaaaccacccccataatccagtcacttcccaccaggtttcttcctcaacatccggggattacaattcaagatgagatttgggtggggacactaagcctaaccatatcattctcttagcagttttcaactatgcaatacattattattaactctggtcatcatactgtacaatacattgtgagtatgtgaatatagtactcgtacttattcttcctgtactaactcaaaccttgtaccctttaatcaatattcctccatttggtgccacccacccaatacatagtaaccaccattctactctctgctttatgaattcaattttttttttacattttatatataaatgagatcatgtggtttttgtcttcctgtgcctggattatttcccttagcataatgttctctaggctaatctgtgtgttcattgaagcgttatttgcaatagccaaaatatcgaatgcaatgtaagtgtccatcactgatgaatggacaaagaaaacgtgatatatatatatatatatatatatatatatatatatatatatatatgtatatatatatatatgtatatatatatatatgtatatatatatatgcgcaatggaatactattcagccttttttaaaaatggaggaaatattttgagaacagtcatctacaaattttattttaccatcattgtttaatttacattattacttagaatagctatcatcagaaagacaaaagataataagtcttggcaaggatgtggcaaaaaggaaactctcaaacgctgttgggaatgtaaattagctcagccattgagggaaacagtatggaggttactcagaaaattaaaaaaagaactaccatatgattcagcaatgtcactactgagtatatagtcaaaggaaataaaatcagtatgttgaaaagatatttgtacttttatatttattgcagtattattcactatagccaagatatggaatcaatctatgtgtccatcaatagatgactggataaagaaaatgtgatgtatatacacaatggaatacaatttgaacattaaaaataatgaaatcctgtcattttcaataatatacctgaacctggaggaaattatgttaaatgaaataagccagacatagaaagacaatcactgcattatctcactcatatgtagaatgtaaagaagttgctgtcatagaagtaatgagcaaaagctgtgtttacaggcgagggatggttggggtactgtggagactggggagatactgatcaaaggatacaaaatttcagttagatgggatgaataagcccaaggggtctattgtacaacgtggtagctatagttaacaatatattgcattcttgaaaaatgttgaggatggatataaggtgttttcaccagaaaaagaataattatgtgaagttatccatatgttacccagctggatgtagtcattccaccatgtatatatatttagaacatcatcttgtactgtgcatggtaaatacatacaattatatctgtcagtttaaaataagataaaataaaataatataattactttaaagcttgtgaaggagtcaccacatggacaatataacagaaaatctctgctagattgaactttgtgatgaacacgaagtacttaataaacatatttctttgatctgtctatgcatggatcaatctgttcctgttgaggaccttataacttcctactgctcactcaacaggaaattgttctgaaagtgctctacccatcaaccttcaatataaaaatatacattttatgatttactcccagagttttgcagtggcacaactttacacaacaaatttgatcaaaatagaaatacttcaatcaattttctttggcgtaagtcaccttggtacttgtcctcatagggtttcgtgtatttcacattgagttgcatcatagtaaaatcaaggtgtatatcattcctatttccatttcacaaattatggaaatgtttcatgttactggttttgttttgctatttatttcagtgttgcttcatggaaaattgaacatagtaattaaaaatgacaaaattttaaaaatctatcatcttgaaatttgtacaatgttttcatgacattattaacaaaactaattatcgagtacagttacacgttccaaccagagctatgttgaactagagtacacaggagagctttttagtatgaactgatactcacacgtaagaattgcttatattttaggaagcgtggccaaatttctatatgaaacatccacttttacaaagtctgactgtattgttgtttatttggaaatagtagtcaaactgtaacaaaggtggaaaatcttttgcacggctgttgagaaatgggtggatcacgtagaataaggcttacaaaaccactagtgggttagcagccccaaacatctgagactatcagtacaaggaagaaatctctatttctgtagcctctgatttgctctatctcatatggagggcctaatgaaggaaagaaactgcattctaaatgatgcagagcaaataccctaaaagggaagtgcttggatctttattactttggagacctaaaagacaatgtactttgaagttagtttcttctggttaatctcttttacttgatgtagacacattacataaatccattgtcgtatgaataatacgtaacagcaataatctattatcataatgtttttaggtattcataaagtacattttctatgtctaaaggaaaagtagcagattattaaacttccagttttattttatgatctgctctgcctcttcaattcattccacctttttgttttgttttgttttttaaatacattcatatgaatgtatttttcaatttcttaccaaagaagcaatttggaaaacactgattgttcatttcccttttacctccttgtttcaatttatgttttgagtacagtacattagtttatagagactgtgattgaaaaaaaagagcttacaatcttcctcagatagctttgctctgagttttacaatggatggtttggaaaaatagtgtaataatgactgagcttctaaaatagtgaagtaacagttatttttgtgatgtaatatagtgatgtatatgtggctcaaaagggttgctatatattccccccaactccaattttatttttaatttttggttgtttttcagttttatgcaagacttgctatacctaattctacaagctatacagtgttttttaatattgattccagaatttgtttcatcatatgcaccagaacaaatacttcagtaaaacttcttctgcactttcttagacaaagacagcatgatacaggcacagctaagtctcttaagctcttaggtatccttaaaacattgacaaggaagtcaatattgaatttcagataacaactggaattttgacagtactcattagttagtttggtctgacccaggcttccatcagtgcaaactttatgccccaagagtctcacaaagcatttacagcatatgctacagaaacatagaaagggagcaggcaactggcagagtatgggcatgaggctgacagctcagagatgccactggacctgcctcatcagctctctgggcactactcactcttctgaaagtatttgaaaccttttgggctgttactttacacctggtaaaaagcatctatagaccagaagaacctgggaagagggtattccttcccttcagagccaaaacagagagttttatactcttcagggggtttccttcacaagacagttactcacaaatcaacgatattgaaattgtatatctgggatttgccctctactgtcactcatattgttcataagaacaggaacagataatatttattggtttgcaaccacacatagatataaactctaattgcttcaacagagttttatggtaagaattgtttagtactaccatttcacagatgagaaaattgaggctttgaaagcctgaataatttgtgaaaagatacaaagctcctatgtggtcagactggaattttaatctacttgtacctgacattggatcctagactcttcaataggttacacttccttcgaactgggaaaaggtagcacaaatcatttatttttaaatcaccgatactagttttgttgtttaaggcatttaatctaagttgacttccccaaaggactgtgcagatgttttctcaaattaaagtgatatttcagaacaacaagtactagaaaatttaattcaactaaacagtaaattctagaaactgggggatcttttggcctctcatacaattttattcgtataactatgtgtcccggccagtcatgataacatatacttgttcaattgataaaaactgaactgaattcaagtcatagacttactgtagaggcttgggcacatttgcagaatatacacttggaatatgcaatgaggaatagaggttaagaagaaaggaaataagtaattacataagtaataattatatagtaattacataagtaaatacaattataaataattgcataaaacaatatcattattattattattattattattattattcgaaatggagtctcgctcttgtcgcccaggctgaagtgcaatggcgggatcttggctcactacaacctcctcctcccaggttcaagtgattctcctgcctcaacctcccaagtagctgggattacaggtgcccaccaccatgcctgactaatttttttttgtatttttagttaagatggggtttcaccatgttggtcaggctggtctcaaactcctggcctcaggtgatcctcccacctcggcctcccaaagtgctgggattacaggcgtgagccactacacttgggcgacaatatcattattataaatacagaaaattcctgtttttttatatcagtcatcctagaacagagacgctatcagctcctggggataactcttcccacatcgtctggaacataattatatttaattaaaacctgaagtggtatctaaagataatgacaaagtattaaatgtgcagagggtttcagtctctcaaacaaatgtgagtttgttactatgttatgtaccatagtagtctaagggctattatgttgtttcttacattagtgtaaccatggtgaaaaccaaagagaaaataaagaatgattgttcatgttttaatgtataagagcacattgatacattgtaaaacacccagatcagttatttaatccatcttttgaaatcacagaagaaaactggtgatatacatgtgatgaggaatggcaactgtagtgatttatattcctctaattttttgcaaaaaaaagaaagttcactgaaaaaattacaactttcgcctatgctaaacttaatttatgtaaaatagtggtcacagctattaaattattgttatttattcacaaagttctcctctacatattgttttaaagtaataactgctttacagcatttttttttaaatggagtctcactctgtcaccaaggctggagtgcagtggcacaatttcggctcactataacctctgcctccagggttcaagtgactctcctgcctcagcctcctgagtagctgggattacaggcacctgccccacacctggctaatttttgtatttttagtaaaaacaggtttcaccatgttggccaggctggtctcaagctctggacctcagataatccacccgcctcgacctcccaaaagttctgggattacaggcatcagccactgcgcccagctgctttacagcatttttatagacgctcttctttgaacttactaagagttcattgaaatcagctgtgcagagtttaaatccagcaaggaaattcaggcacagacaggttggaggtaacaaaaagtaaaactggaaagtgaatcaaattttggctgaaaatttaatatatttaatagtatgtatgattcctcaatctaacttaggttaaaataatcaaaaataaaataaggtgaactactttttttttaatgggcaaggtggcagaaatggaatttccaaacatctagatcttaggtctttattattctaagcaatttttaatacaatttgagaatctttatttctgtactcttcttcaataataacattaaagcagaaggaggttccaagatggccgaataagaacagctccagtctgcagctcccagcgtgagcaacgcagaagatgggtgatttctgcatttccagctgaagtaccggcttcatctcactggggcttgtcagacggtaggtgcagcccacagagcagggtgggacattgcctcatttgggaagcacaaggggtcaaggaattccctttcctagcaaagggaagccatgacagatggtacctggaaaactgggacactcccactctaatacagcgcttttccaatggccttaggaaatggcacaccaggacattatatcccgtgcatggcttggagggtcccatgcccacagagcctcactcactgctagcacagcagtctgagatccaactgcaaggtggcagcgagactgggggaggggcgtctgccactgctgaggcttgagtaggtaaacaaagtggccaggaagcttgaactgggtggagcccactgcagatcaaggaggcctgcctgcctctgtagactccacttctgggggcagggcatagttgaacaaaaggcagcagaaacttctgcagacttaaacttccctgtctgacagctttgaagagagtagtggttctcccagcatggagtttgagatctgagaatggatagactgcctccttaagtgggtctctgacccccgagtagcctaactaggagacacctcccagtaggggccaactgacacctcatacagccgggtgcccctctgagtcgaaacttccagaggaaagatcaggcagcaacatctgctgttctgcaatatttgctgttcttcagcctctgctggtgatacccaggcaaacaggttgtggagtggacctccagcaaactccaacagaccagcacctgagggtcctgactgttagaaagaaaagtaacaaacagaaaggacacccacaccaaaaccctatctgtatgtcaccatcatcaaagaccaaaggtagataaaaccacaaagatgggaagaagccagagcaggaaagctgaaaattctaaaaatcagagcgcctcttctcctccaaaggaacgcagctccttgccagcaatgggacaaagctggatggagaatgactttgatgagtttagagaagaacgcttcagaggatcggtaataacaaacttctctgagctaaaggaggatgttagaactcatcgcaaagaagctaaaaaccttgaaaaaagattaaacgaatggctaactagaataaacagtgtagagaagtccttaaatgacctgatgaagctgaaaaccacggcatgagaactatgtgacgcatgtgcaagcttcagtagccaattcaatcaagtggaagaaagggtaccagtgattgaagatcaaatgaatgaaatgaagcaagaagagaagtttagggaaaaaagagtaaacagaaatgaacaaagcttccaagaaatatgggactatgtgaaaagaccaaatctacgtctgactggtgtacctgaaaatgacagggagaatggaaccaagttggaaaacacttctggatattatccaggagaacttccccaaactaatgaggcaggccaacattcaacttcaggaaatacagagaatgctacaaagatactcctcaagaagagcaactccaagatacataattgtcagattcaccaaagttgaaatgaaggaaaaaatgttaagggcagccagagagaaaggtcgggttacccacaaagggaagcccatgagactaacagcagatctctcgacagaaactctacaagccagaagggagtgggggccagtattcaacattctaaagaaaagaattttcaacccagaatttcatatccagccaaactaagcttcataagtgaaggagaaataaaatcctttacagacaaagaaatgctgagagactttgtcaccaccaggcctgccttacaagagctcctgaaggaagcgctaaacatggaaaggaacaaccagtaccagccactgcaaaaatatgccaaattgtaaagaccatcaatgctaggaagaaactgcatcaactaatgagcaaaataaccagctaacatcataatgacagaatcaaattcacacataacaatattaaccttaaatgtagatgggctaagtgctccaattaaaagacacagactggcaaattggataaagagtcaagacccatcagtgtgctgtattcaggagacccacctcacatgcagagacacacataggctcaaaataaagggatggaggaagatctaccaagcaaatggaaaacaaaaaaaagcaggggttgcaatcttagtctctgataaaactgactttaaaccaaaaaagattgaaagagacaaagaaggccattaataatggtaaagggatcaattcaacaagaagagctaactatcctaaatatatatgcacccaatacaggagcacacagattcataaaacaagtccttagatacatacaacgagacttagactcccacacaataattatgggagattttaacaccccactgtcaacattagacagatcaatgagacagaaagttaacaaggatatccaggaattgaactcagctctgcaccaagcagacctaatagacatctacagaactctccaccccagatcaaaagaatacacattcttctcagtgccacatcacacttattccaaaattgatcacacagtttgaagtaaagcactcctcattagaatcaaactagaactcaggattaagaaactcactccaaactaaacaactacgtggagactgaacaacctgctcctgaatgactactgagcacataacaaaatgaaggcagaaataaagatgttatttgaaaccaatgagaacaaagacacaacataccagaatctctgggacacatttaaagcagtgtgtgcagggaaatttatagtactaagtgcccacaagagaaagcaggaaaaatctaaaattgacaccctaacatcacaattaaaagaactagaaaagcacgagcaaacacattcaaaagctagcagaaggcaagaaataaccaagatcagagcagaaatgaaggtgatagagacacaaaaaacccttcaaaaaatcaatgaatccaggagctggctttttgaaaagatcaacaaaattgatagactgctagcaagactgctagcaaggctaataaagaagaaaagagagaagaatcaaatagatgcaataaaaaatgataatggggatatcattgatctcacagaaatgcaaactatgatcagagaatactacaaacatctccacgcaaataaactagaatatctagcagaaatggataaactcctggacacatataccctcccaagacttaaccaagaagaagttgaatccctgaatagaccaataacaggttctgaaattcaggcaataattaatagcctaccaaccaaaaaaagtccaggaccagatggattcacagccaaattctaccagaggtacaaagaggatctggtaccattccttctgaaactattccaatcaacagaaaaagagggaatcctccctaattcattttttgaggccaacatcatcctgataccaaagcctggcacagacacaacaaaaaaagagaattttagaccaatatctctgatgaatatcgatgcaaaaatcctcaataaaatactgggaacccgaatccagcagcacatcaaaaagcttatccaccaggatcaagttggcttcatccctgggatgcaaggctggttcaacatacacaaatcaataaacataatccatcgtataaacggaactaaagacaaaaaacacgtttatctcaatagatgcagaaaaggcctttgacaaaattcaacagcccttcatgctaaaaactctcaataaactaggtattgatgggacgtatctcaaaataataagagctatgtatgacaaagccacagccagtatcatactgaatgcgcaaaaacttgaagcattccctttgaaaactggcacaaggcagctatgccctctctcaccactcctattcaacatattgttggaagttctggccagggcaatcaggcaagagaaagaaataaagggtattcaattaggaaaagaggaagtcaaattgtccctgtttgcagatgtaaaatacctaggattccaacttgcaagagatgttaaggacctattcaaggagaactacaaaccactgctcaacgaaataaaagaggacacaaacaaattgaagaacatttcatgctcatggataggaagaatcaatattgtgaaaatggccatactacccaaggtaatttatagattcaatggcatcaccatcaagctaccaatgcctttcttcacagaattggaaaaaactactttaaagttcatatggaaccaaaaagagcccgcattgccaagacaatcctaagcctaaagaacaaagctggatgcatcacgctacctgacttcaaactatactgcaaggctacagtaaccaaaacagcatggtactggtaccaaaacagagatatagaccaatggaacacaatagagccctcagaaataataccacacatctacaaccatctgatctttgacaaacctgacaaaaacgagaaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaagcaataccattcaggacataggcatgggcaagggcttcatgactaaaacaccaaaagcaatggcaacaaaagacaaaattgacaaataggatctaattaaactaaagagcttctgcacagcaaaataaactaccatcagagtgaacaggcaagctacagaatgggagaaaatttatacaatctacccatctgacaaagggctaatatccagaatctacaaagaacaaatttacaagaaaaaatcaaacaaccccatcaaaaagtgggcaaaggatatgaacagacacttctcaaaagaagacgtttatgcagccaacagacacatgaaaaaatgctcatcatcactggccatgagagaaatgcaaatcaaaaccacaatgagataccatctcacaccagttagaatggtgatcattaaaaagtcaggaaacaacaggtgctgtagaggatgtggagaaataggaatgcttttacactattggtgggactgtaaactagttcaaccattgtggaagacagtgtggtgattcctcaaggatctagaactagaaataccatttgacccagcaatcccattactgggtatatacccaaagtattataaatcatgctgctataaagacacatgctcacacatgtttattgcaccactattcacaatagcaaagacttggaaccaatccaaatgtccatcagtgatagactgaattaagaaaatgtggcacatatacaccatggaatcctatgcagccataaaaaaggatgagttcatgtcctttgaagggacatggatgaagctggaaaccatcgttctcagcaaactatcacaaggacaaaaaaccaaacaccgcatgttctcactcataggtgggaattgaacaatgagaacacttggacacagggtggggaacatcacacactggggtctgttgggggtttgggggagagaggagggataacattgtgagatatacctgatgtaaatgaccagttaacgggtgcagcacaccaacatggcacatttacacatacgtaacaaacctgcacgttgtgcacatgtaccctagaacttaaagtataataataaaaaaattaaaaataaaaataacattaaagcaattgaatgtacataataatcagtgacaattttctagtataaaattttctttgttacattcttcatcagttctcaaaatatcatctaaaaggaaagggtgagccagacgaggtggctcacacctgtaatccgagcattttgggaggttgaggtgggaggatcacctgaggtcaggagttcaagaccagcctggccaacatggtgaaactccgtctctactaaaaatacaaaaataaaaatacaaaaccccatctctactagaaatatcacattatatatatctatatatatctatctatatctatatctatatatctatatatatctatatatatctatatatatctatatctatatatctatatctatatctatctatatctatctatctatctatatatatatatatatcagggcgtggtgacagacgcctgtaatcctggctactcgggaagctaaggtaggagaatctcttgaactggggacggggaggtagcagtgacctgaaatcttgccactgcactccatactgggtaaaaaaaaagaaaaaaaaagaaaaagaaaggttgttttaagtgtgtttgtaaggaagagggcagacaaaagaaagagatcattcaagatttacacaagattgtttttatttaggaatgcctttcttttgaaggtttataattggcgtttggttgagtttagtaagtgttccagacccagctctcttcagactgatggttcggaatccatctcagcctcatctccttttaccccagcctgtgacaagaagtgctttctctgaaaataaaaatcagtacacacagttctgttgatattatatttgcttctttgtcatatgtttaggtagaattagtggtaagttttctgagttttctcagtgtttaaaaaattcttccttaaaattggtgagtcaacatttatttccagttggactttgcagacatgttataggtgtataccttgaataactttctctttttaaggtttgctttctttcacgataaatgcagtaacatttgccctattaaatatgttctaagacttcattaaacacacactaaaaaacagaatcttaagtataggcattttctgctcatgtatcactcatctacttactccaagaaaagttgatcctgaagagatgaattactgttttttttgttttttctttttaaagttatttagggaaggcagtgtgtatttaggtaggtatgtacctatgtggttatttggttgttactatgttatggaccagccttctgtgataaattgtagagtttattttgttacgttgttgcagcaacttccttgacattattagaggggcagatttccatttcctgaacagcaacttaataacaactcttgatgaacttgaataccatcagtaggtctattctcagtttccttctcatttggctaaagaagtggtctcttccctgctttattgcataggcatgaacattgagttattttttcattgctttggacattgattctttctaatgacttccagtaggctacctttcagatcattcttctttatagttttacaaaatgcgtcatacattttaaacgcatcttccgtttctctatgtttcataaaaagacaatttgtgtttagatctcatctttctgggagttctttgaggcttatattcctaatctttcaggtgggaccagtcttcaggaagttattcggagtttgaaaagataagcagtttatgtgaagtgtgtgtgtgaaacaaccctaagttaaagcctaaagtaatctacaaaatagtatttttgtctctttgtatatatttctgtgaacattcacagtttggaattaaaatacggtgcccttacgaactataatctatgacaattatctttaaacgtccaagctgtgaagcagtagaaaaatctactgtgatttgggtaaacttttcttttcttaactttctttgttatcttggaaaaacataacatattactaatatatttttttaaaaatttgtcaatgttcagtaaagtacagaaggcacgcttttaaaataaaatgcttaatgtttaattcagcacaactaaaaaagaaaccaaagttttcttaattaaaattagttatgataattgtattatgaatcagcaatattcccaaaaggtggcatgcttgaaacgtggaatatgtttgctaccaaacagtcttaaaatctacaaagaaaagaggaatattattgaaagactcttatgacaattgtcttttttgaaacatttgtgcacattctaaaacaggttataaaagttatccaagtgtgatgctcttgattattaaaagctaaacatttcaagtcagtctgtcaattagtatttttgactgaataattgaaatctttttcagtaatgtttaaattgcactatggcttttccagattttatatgtatctaaatctgtatctatctgtatgtcttcaattaaaatccccactttattatgtcacaaaaatgaattaatgttggaaatatttgtgaatacataaaaactttatgtgagatagatacagcataaaacaaaagttagcaggttataatatacaaaaataaaatattttctttttggacctagcagcatcatttgtgtaatgcataatgataaaagatgcattaggtcatgatagttcccaacatgtattttaatggtatatcaacccttcttttccttgcagtatcatagtaatcacttgtgtgtatttgcatgttcaattttacaaaatcaaaacaatgtgtacctaatacctaatgtttaaaataattataaattataggtttattttgttactttgttgcagcaacttagcaacttccttggctcacattcccccacccctgtttttttggtggtggtgttcttgcttttgttttgagatggagtttcactcttgttgcccaggctggagtgcagtgggatggtcttggctcactgcaacctctgcctcttgtgttcaggcgattctcctgcctcagtctcccaagtagctgggattacaggcacccaccaccatgcctgggtacttttgtatttttagtagagatggggtttcaccattttggtcaggctggtctcaaattcctgacctcaggtgacctgcccatcttggcatcccaaagtgctgggattacaggcgtgagccaccacacctggccatatttcccccatttttaatcaatccattgctaagcatccaatggactgtactccaaaaagctaatttgttttgaaattggaatttgttttctatagactcagcagtaataacattgggtaaggtttcatactaacttcatgaacttacttaaatgataatgcaaatgaaatacacttaaaaattttctaatgtagcaatatacacggttgcatactagttattaatcactattcactagaaaataaacttggaaattaatgaacatttaagctatttttaaaaaacttactatgaatacttaaatccagccaaaaccccttggattgttaactctgtttaccttaaataagatcagaatcgagttagaagtggtcagacacagtggagcaaatctttctgtagaagaagaaacagaaggtttagaagatagcgggaaataatgcttgagcacccaagggctctgaaggcataagccaggtagtgaaagctcaaatctggtccaagagctgtgaaatggtaagaaattaaaaaagaagtccgaaaccacatgtgagtaacgtgaaagacatggaatgaagcaggcttcccacctgacatgtagggggaaggaatcaggcactttggagaatttcttcccagacatgaagctggggaattttaattgatagtgacaactgggcgcatagcagttgctctgtaaactcaaagagaaagaactttgtagaagtcttactaccaaccaacaagtacttttcctctttcttcaacagaccctgtaaccaaaccacaaatccataaatcatacaggtgaattcccatagctctagtatgaattacttatacattaaacattttacagataaatgacactcattgttggtcatataaatattacagtggacccatgttaagctattgtggaaacacagaagaagagactcaaatcaaattggagagaatatgaaagactttcagatggccacaatacttcagctgaaagttgaagagaataattttgttaatggcattgcagctgttgtgtgctgaggtattaatgagcccctacattggctcaggtgagaaatattataggattgatatgtagcagaaaggatgaagaggacataaactcaaaagttatttaagaatctaaaaatgtgtggttcagatgaaaaggagtttagaatgatgctttgatcttcttctagtacaactatatctttgttgttgcttttcaaagatacaaggaatacttgaggaggtgtatgtttgaggagaaagatactgaatttttgtttggacacagcaaatttgagttgatcattgcattagggttctccagaggaacagaactaatagtatagatgtatatatgaaggagagtctattgaatattgactcacacgatcacaaggtgaagtctcacaataggccatctgtaagctgagaggcaaggaagcaattacaagtcccaaagcctcaaaagtagggaagccgacagtgcagccttcagtctgtggctgaaggcccgagattcccctggcaaaccactggtgtttcagtccaagagttgaaaagctgaagaacttgacaggagactgatgtttgagggcaggaagaatgcagtatggggagaaaaatgaaggctggaagagtcagcaagtcagctccttccaccttcttctgtctgctttattttggctgtgctggcagctaattacatggtgcccacccagattgagggtgggtctgcctattccagtccactgacttaaatcttaatctcctttggcaacagacacacccaggaacaatactttgccttcttcaatccaatcatgttgacactcaatattaaccatcacagtcatgtattatacatgaaggaaaatttaatataatattggaaatgtatgctcatacattccctatcctatagataatgtaaggactcaatattaaccatcacagtcatgtattatatatgaaggaaaattttatatcatattggaagtgtatgctcatacattccctatcctacagataatgtaaggacagagactcccgttattttttctatatgttgaaagagatcttcccaaccctgcccctgtatgtaccatccttagatttctctaccacagattgtagccagtctgtttttctccagttgttcagtccaagaatatgaggtcttatttgactcttctctcctgctcacatttacttgaaagtcctgttaatgctacctaacattacatctggatttcaaacacttctctgtgcatccactttctcactcctttcaattcattatcatttcaaacctgaaatattgcaatgacctacccaatggtttaccagcttctagcttttacccaagaactattttcaatgtggcaaccagaatgaccccttaagtaaaagtcaaattatatcacttctctgctcaaaaccctgaaatggctgtccatttcactcaggatacaaaccaatgtctttaaagtgacttacacaaaatgcctacattacctcttccctcataacctactattctccctcctgctcactcagctccagccgcagtggcctttttccaggctttcgtacatactgtcatatttgaacctcaggacctttgcactggctgtttcatcttccaaatatcctcattagcagcacctttgccactttctgctatcagttcaattatcactttctacgctctgttcaactattctatttagaaatgcaatccaaccaagcacttttctcttctccacattttcttttccagatagaattctaacttacccaatttatttgtacatttttcctactgtctctgctattagaatgtaagccacatattagggatatttatctcttttttccacagaggtatgtcaagaatctaaagtagtacctgacatatagtaagtgcttgataaatatttttacagctttaggagataaaattgagaaatgaaaaatgtctatattgaaggcataatgtgatgatttgatgcaaatatacattgtgaaattattaccacaatcaagctaacacattggttatctcacgtagttaccttattttttgtgatgagaacacttaagatctattctcttagcaaatttcaagtatacagtatagtataattaactataggcaccatgttgtacatttgattctcagaacttattcatcttaaaacatttctccatttcccatacctctgatcccctgacaaccacccttcttctgttgctgtgatatgatttttttttttagatttcacgtatcagtgaaatcacatagtatttgtctttccatgtctggtttattttatttaacataatatattccaggttcatccatgttgttgcaaatggcaagatttccttatcttttaaggttgaataatattttattatatatatcattgtttctttattcatttattcgtggataggtacctagtttgttttccatatcttagctactgtgaataacgctgcaatgaatgtagcaatgcaggtatcacttcaagatattgatttcatttgccttggatatatacccaaaagtgggattgctggatctagacttcctttcttttctttttttttttttttttggagtggggtggtctcactctgttgcgcaggctgaggctggagtgcagtggtgccatctcggctcactgcaacctctgcctcctgggttcaagcaattctcatgccacagccttccaagtagctgggattacaggtgtgcaccaccacacccagctaatttttgtatttttagtagaatggggtttcaccgtgttggccaggctggtctcaaactcctgacctcaggtgatctgcttgccttagcctctcaaagtgctaggattacaggcattagtgaccgtgccaggcacaatagttctagatttctgatgaaactttgcagtgttttccataatggctgtaccaacttacattccaaccgaagggcacaagggttcccttttcttcacatgcttgccaacatttgttattactcatctttttgatagttgataaatacttgttgtattaaaaattagatgttgaatatcactagttttttttttacaggtgcaagccactgcacctcaccactaatatttttaaatatggtttttgtggtcatatgttaacatagaaaatatgaaaatattaagaaaactaatttttaaaaaattgaagaagaatatgattaggttgagttaaatatgaatggcttttagagctatgcaaacaattaaaactaactgacaagagagaatttgtaaagagattaagagtgattcataagtgctgggtatggtggctcacacctgtaatcctggcactttgggaggccgaggcaggcggatcacgaggtcaggagttctggaccagcctggccaacatagtgaaaccctgtttctactaaaactacaaaaaattagccagacatagtgttggctgcgtgtaatcccagctactcaggaggctcagggaggagaatcgcatgaacctggggggcggaggttacagtgagccgagattgcgccattgcacaccagcctaggcaacagagcgagactccgtctaaaaataaataaataaataaataaataagagttattcatatgtgtggatattcacctagcaagggaacagctttctggattttttgtgtgtttgttttttcattatattctgctatactgagtagagttttccattaaaatttttcctgattattatcaatggacaatcaccaatccttcttagctttaaataacctctctaggcaaacaagaactaagtagaaaaaaatatatttgagacaaaacaatattttatagtatagttaggtaattattgcgtttggtagtttttgcaaatttaattgtatttctttgagcctatttctttgatattcgttatttagaggtgctgaaagagggaagcaccaaaatgaatcacatatgacaagtatacatacaagcaggtttaaaaaaaaccagcaaaatattttaaatagctaaataattttctatttgtcatattttaaatctcacttaattataatcattataggttcaaggtttgttttaatcaactcaagtaatattttctggaaagctatgagcaagtgttttatgaattctaactctttggtatcaaaaacacaaattggcctgtttcgtttttcatcatgcatcaacaccagtttgggaattttctttggccaaaatttctattaatatgtaaaagaaaagatgtgttttcttaaatgctctggaaatagtatcataaaacatatataatgtgtaaatttaataaacttttaaaaatattgaaatgaacatcatatatttttgaatgatgtgttgatatcttaaatagtgctacagaggtaacaaagtttaaattaattaaaattatattcaccttgaatatggaatctatttcatgtcattaattcagctaaaaattagaaactaaataaattatattattgaaatttaaaacattgtagaaatttcaaaaaatgacaaatttgctttgtacctttatttcttctacaaattcttaaaaaatgctcttagtattttttttttttttttttttttttgcttatgatttaaaatatgatatttactttggaagtttcttcttttttttgttaccagttcgtgttatttcttgggttttctttttcacctaccatccttgtatttcttacaatttgcttctgaaaatacctatttcttctttttaaccaaatagctcaaggctgggataggatgcctcccaggaaacatctggcaatatttggagaaatgttttgttgtcacaattctggggagaggaatgctactgacatctagtgggtggaggccagggatactgctaaatatcctactgtgtacatgaccacccccaaagcacagaattttccagcccagcatatcaatagtaccaaggttgagaaattcttattgaaacatacactgcgcagccaccttagtggtccagatttctctacattccaaaaattttattgaatttattctcctttttgaccacaaaattcctgatttttctctcctctttcttgttttcatttctcagattaatgattctgactatgatgtgattgaggggcattgcctttggaaccattcagttaccaccacactagatcttcaataattaattaagttctgatcattacgtgttttcatttctgtgtggataactggaggaatcttgtaattaattagcaaccatgtgtagtacagtgttaacacttgctagaaatgagtgggctctttcagaattctcagtttaagaactcttccttagtgtttttcaacgcattttgtttggaatacagacatgcaagatattctgcaggggaagatcatggtctgatagatctggaaaatgctgactttttggtcccaagaagctctgtgatatttaccaatgaacctgagaggtcctgaagtactaaagcctgcttagtttggttttctgcagctgtgtgtgtgttttttttctaataaaattgttttgtttcgttttaatcccttaaaattcctattaacatcaggaaatattgatataatcctatctgctttcacaagattctaaatgttcaaatctcctcaccagaacaagtagaagtaaatctgctcaaaggatttttaaaaaaaactggcatttttagtgaattacgtgcagagaactttatatttagttttaattttgttcagttaccttaagccttttttatcttattatacattattagagtaaatttacatttttatctaatctcatattaaggattgaataatacactttttgaagtttacaatagtgtacatattatatgtatcttgttttaattttctccaggtgtttttaataattgaattttccagtttgtttgctgtaaacattgaccatttagaaaataaattgatgtaacactatctgcttcctcaaataatccccctcacctccccccacaacacacacacttatatcttgcttgtgtagtttatagcatagtaaatatacatgcgtattttagggtataaggctaaattcaaatctgtgatgctatatgccatatgtttcctgacctatttgacaaatttaattgccccttaaagtttctattgcttctgtaatgttataacttattttttgtaatagttggtatatttattttctttacagaacaataatttccatgagaactaggactctaaaaattgctcagtactgtatggtatgtcatatagagatcctgacagaatgccgtacatgcaaatatactcagcatgtgttagttgaaaacagatgatgagactcctaacttgtagtagcatgtaatctatatgtggataaaagtgtgctcaagcagtagctattaccaatgcacagctctgaatgactaaatatctcaatcaagaatatcgacaataaatccaggagctgtggctcaagcctgaaatctcaatgcctagggaagctgaggtgggaggatcatttgaagttaggagttcaagaccagcctggccaacagtgataccctatctctacaaaaaacaaaaataataaccagagatggttgtgcacatttgtagtcccagctattcaggaagctaaagcaggaggattgcgttgagcccaggggaggacgcagtgagctataatcctgccattgcactgtagcctgggtgacagactaagatgctgtctcaaaaaaaaaaaggaaagaaaaaaaagaaaaaaaacccaacataacaacagaataccgaatacccataataagaaatgtaagattctccatgaactccacatttttgggcttagtaacttgactcttaccacctaaattcaactcatttaaaactataggccaggagcagtggccacacctggctaatttttgtacttttagtagaaacagggttttgccatattggccagagtggtcttgaactcctgatctcaagtgatccgcccacctcggcctcccaaaatgttgggattgccagcatgagccaatgcacacagcctatagttttaaatgaattttgctgattctactataggctgggcgtggtggctcacacctgtaatcccagcactttgggaggctgaggctggcggatcacctgaggttggaagttcaagaccagcctggccaatatggcgaaaccccatccatctctactaagaacacagaaattagctgggtttggtggtgggcagctgaaatcccagctactcgggaggctgaggcaggaagaatcgccttaacctgggaggcggaggttgcagtgagccgagatcactccactgcactccagcccaggcggcagagcgagactcatctcaaacaaacaaacaaaaactataaagaaagcacccagaggaggaaataatcaataaattacatatttcctggacaaataatacttcatagatgcccccaactttcccattcattgctaaaatctcatcataaggttgtaaatccaggattacatggagcacaagtttcacagatgttgtttgactcattcattcattccttattcattcaatatgaatttattatattttaggtaccaagctatcggctgaaaccagctgttagaggatggagagtatccagattgttaaggaagaaatgggtagatcatctggtcagtagtaataatggtaatggatccccagaggcagagtcaccttggggaatataaaatgcattttaatttgaatcgataaggaggctgatattgtgaatcattaaaaaataaatttgaaaaatgtaaagtagtgacagaagcacatggtcaccaggcaagaaggctaagaggcagttttgaagccactgcaaggtattctttgaggaagtgaaggatgaaagctctgtgtttaggtttctggttctaatacatcctttaacaaggccatattgtaagagaatggttaaggtggggctgttcagttggagtgaaattgaccgttaatgatccatctcagtatgatgggcaaagatgtattacatgaacctggtatcagaagagtgtaatctttgtagctctcacctatgattacatgattgccattaattttagaatctacgtggaatcttaatgattgtgaatgactgaaaaccattaagaaaactttagagactttctggataaaatgcaatgactaagttattattcgatttatatgaataaatatattcttagtctttatgtgcttttcggtttccatatgcacaccctttagttctaagtttggattttcctctataatattacaattgctatttctttgtctgtctctctcttccctcctcactccattctttccagtatccttgtctatttttctttctttctctcttctttttctattgttgcatcactggccataaccctattgcagttgtgaaatatttagtggcctcagcttatgtccctagtgggagctatggaaagtacagaaaaatgaaaagtgactcacgttattctagtgtgtctctcactttccacagctacagttattgctacccttggggaaatttacatacactataaatagaaatatatactttagaaagacatttaaacttcttcttttacatgtcagaataaacaaaagtactagtaaagaaattatttctgcactaaataatgaattgatcctcataatgccctgtaggtatggcatattgagggacaaaaattataagtctgatttcaaacttctaagtgttgaagactcatgtttgataatttgataattgggggaaaaacagagcaaataattccctttttgtctatggatcatattgcctctcagttcctttagaaaaatacaagttaattaagcttagggactggaggcgtaaaggatagtaaaaggaagaaaaataatttagctttcagaagatcaagagtactaggggaagtgattttggctctcattttttattgaaataaaaattgacagagaatttggacatcctttggaaagccaggcaaaggaaattcagtttatcataaacaggataaaaatcagaatatccaattccctgggaatcagaaattctccatgaagctgaattctgcttcagttcatctctgactcattttgtcattcaaatatgtgggatacctactatgcaccaagcattgttttagctgccggagattcaatagaaatgatacggctaagttcctggcctccgtgaacccgacattctgatgtgactgctttattattagataatgtgtaagcaaatttgccattgtgtgttctaaattaagtaaattggatttaaaaaatttagaaagactatcttttggtattcttacaacttactatttaaaataatacaccatttgaaagaaggttttgtgcctctagctatagccacaagtggcttcatgccttcagaaggggtcagggaagacaagcagccaggaggcagtagggacagaatagttgctttgaatagagacaggtttagtccagttttgcctgagagggttagagatccattctgctctctgtccttgccatggattctgttgtctttcactccagccccttctgctcaacatgcatcattctttgtttccactctgcagtcctttcatgctgcttacttaggtgttgtaaattttgaatgactctaatgtctacagcatttcctgaattttacatctggacagtattgaagggcagcggggcctcccaaagagcctgttttgcttgactaagttcttttgctgtattgatttagtataagaaattctgggataatgttcaatttcttcatggttcttaaaaatttcaggcatcaacaaaggctgtgtattccaggcaagagatacaatatgaagaaaaaaaacaacaacagactattatcagcttgttcaaacacaaatctctacaggttgacattttcttaggattggttcccagaatgtgatgtattttcttctgtgggtgttcaactcatttgctcttacaactgaaaaaaacagcagtaaaagccaaattgaaccagtccagctgttatactattacttttaaagaatgcctcaaattcttagtgtttacttctagtttagttcgtaccggatttctcttcacatgtcaagctatgaaaaaacaagctgacaaatcaaaaggttgacttcccaatgtcttctgataaaaataatatttgaactattctatctgtaacacaagaatatgtatttatatgtaagaaatcctttggctcttccctcttttgttatttacaatattgggtgcattctcatgatctttctttgctattcattttatttatttttactttcctacatagagagttcttattgtttctgttgtttcataaattttagaagcctccaattttagaactaaaagaaccatattgtagagatttcatgatcgccaagtttaatccttcctcttacctatgagaatgcctgtaggttgcttgtattttattttatttcataaactactggaacatattctttatttttatttttatttttttattttttgagacggagtctcgttctgtcacccaggctagagtgtagtgacgtgatctcggctcactgcaagctccacctcctgggttctcgccattctcctgcctcagcctcctgagtagctgggactacaggcacctgccaccatgcccggctaattttttgtatttttagtagagacggagtttcaccgtgttagccaggatgctttcaatctaccgacctcgtgatccgcctgccttggcctcccaaagttctgggattacaggcgtgagctactgcacccggcctggaacatattctttatgtgcttgtatttcttttctgttaatatttagatctatagtttatttgcagctactgtaaattttgatacatcagatttatcgaacatgctacaaagagtaaattatgtcatagtttgctattttctcatttagatattactccatacaatacagaacataagctttgggcatgtttgattagtaatttaagaatcctttctatctatacaagtagtgacctacgcatcctccatttggcctccagtgtgcaattctgtgtgattaacattttaaaatttcctatttttttaatgctaacttttgtaatcttcaggtgtcagacgtttagatgaaaacagtacatctgctaaattattgctcaaaatattacatattttatgcaaaattgaatggttcacctacaggtagaatgaagagaaacaaacaggcaaaattattctttcagttctgttcttatcatcatacagttgggtctgcttattactaaggttagatcaaaggcctgagataatttagctagtttcctatctagataaacctagacttggtctaaagccacctagcagctctgtgacttgctatgatttagggctgctgttatctcccaaatactggttgtaaattaatgaatgaatccagaagttaaagataactgagacttttacaacatgaagattttcctgactgaaataaaccaggtcatgtgtcactcatttatattttaaattggtttaattagtctgctcctctgtgatcacctagtgaacataagctcttttggggaaacagaagttttgagagagaaggagatgaggggatagtaagaaagggatggttttggagtggataatgaaagctatgatcagatgaaagtgttgcagatgggaacatggccgttctggacagggtatcgccatggatgacttaataacttgggacatggggtaaataaaaatagaaccgtaaggaatacttggggagggggtgtaattgaccctaaaataattgtggaaagccaagactatctgatattttttgatatcaaagaaatataacctagaaagtcagaaaaaaactttagcatttagttcactaaaagaaataatgatccaaactaattgatatgcctgccttaaacacagttttctatgaattttaggctcatatacccttataggaaaaacatgatcacacacacacaaatagcatgtttttcgagaattattaaatattgggaacctgaaggtatcctagagatcctaagatccaaactcttcatttagtaagtgaagtaaacaagtcccagaagattaagtgaattggccaggtcatagagcccatcttcatgcaggattttatagtctgaagtgatatttcaaaattgggggataaatgcttcagacctttcaaaatttaattattgtagaatatagattagtgactaaaatgaaaagaaaaagtttcaggaagataatctctattattttggtataaatgttgacgaagaagagataaaaaatatttttatggcaacggcttgttggatacgttgccgaattttctttaaacaatatgaaatgatttttagtaggaaagtgtcagtgctgtatgtgtgtgtgtatatgttacactttctccgccacttccaagccattcacagttaaacaggatttcactcaaacattgtaacagcagttgccaaagcactaaactctgtatgtttttggatgtcttggtacaaagaataagtaacaggagaaacaccctcagggaaagtttagaaactctgtgtagcttttttcactttaataattacaacagtgttaattcacagcctctttgactagacacttaggatttaagtagcctagcaattctgccttcagctactagtgagttcttttgcatatttatcagatgtgcccgcctttctttttatttcatttttttctttttttctttccttttctcttcctttccttttctttcttcctttctttatccttcatttttctttcttttccttccttttaatttattttttaaagttgttaaactttaagataaaatcaatggggcatatatccattctctatcaaaatagatctgccttataaatatgtttcatttaaaagtcgataaatttttaaattcccagtattaatgtgtgattattttatttgcattatctctttttttaacctagtatattaaaatgtatgtattcaacacacagctgctgaggagctctctcccaccttcattcttcctcaatcaacagccctctctatactaggcactgttgtaggaagtaatgattgttgtagcctccatttattcttcataccaaatactaaattatttaggttcaatttgccgtaatgtaatcttcaccacagtctttgaagttgtatatcattgtcctcactttatgtattaaacaaaattttaaaaaatgttcaaagaagttaatatcaccaaggtcagtaaccagtaagtaagtttgtcgtggttcaaaaccagttcatctgaagttcagagtcgggtgtatgtgctgtgccttgtagactgtgtttgaacacaaaagcaggaggagggatatcatatgctactggttttcttccttctactctgcctactatcttctttcttggctccacttttcccagggcatagtctataaatttctgagaaacattttgcacttctgttatgagtaggaactctttcatgacttcaacgttgcatttgaatgcatatgcttctgcaaaatgtaccatcatcaagttactttaagcactttgggggaacaacatgatgactatacccaactttgccaacatacccatgatatgcatgattcactttcattattttagtataaatgatgccaaaataaatagaataaggaggttaggatttaggagagttgggtgtttcagctctgccactaaacatctctgatatttgggactaatatcttaatatttattggctttagctttcttatcagtaacagaaaaaaagttctagatgtgtttagggtaacatgccatgataaatttttattattatttctaataagagtagcacaaggcttagcatatagtaacatttgcaaatcttaagtgtctaaatcaatgcggttttacatatccttccataaccgtgccacttgataatacatttttttctcatgccatccaataactttttttctctaaaaataggactaggatagtaactgcagaataactaaagacttcacttttttactgctcagatgaacattcaaaataagtattatatggaattttgctgtagttttatgcttacttggcaacacaagcctggccttgtttctgtaactcaaggtttttgaccatgaatggaagttaaattttataatcagagcattttctaagtcttgtcccacaaaaaaataaaatataataaaatggaaactgttcaggccctagagagaatttgctggtcaagcacatatttacacaagtagagtgcatggcactcttgatattgtttctttttcaggagctgatttaatatcctgccttatgttgatgtgcaggctcattggtcatgtaggttagcttagagcttatattcccattcttattatttctggaatatattttaatgtccaggttatgttgaaacttattctaataataaaaatagctgcaatacagagtctccagtgctcacagaaataatgtagaaacaatactttatttaataaaaaagaaaaagaaaattttaaatctaaaatatttagtatcttcttccctgaaagcaaactggagaggaaatatgaatgagaataactgtgtacttgtgtgagaaaaagattctagagacaagagaatctttttgtttgtttgtttgattttgtctaggtaggatacttcactagtccaataatctttcctctaatgtttaacaacattcccacagtaacactcctgaaaatggctatgcaattgggaagctcaaaaatttgtaggagacatgtacatattatctgtacatattttcattcttaggaaaatagcaagtctacatataggcaagcagagaaccatttcctttctttctggttcatcacacttccccaagaatacatagaatgtgttcttccaaagcagcaaaagggatcctctcatgagttctttttttcacagcttgttacaactgcatgtttatgcatcttttcttatccatttccatcgcttcactttggatctctgcacaggattctgacaagctctttctccttctggcacagcagattaatccttttctaacacaacttttaccctttaaattattgatttgaaaatatccttcccaaatctaacttcattctgtttgacttcgtaggcactcacgtctgatccagcctcacacatcgaacttcctcactgttcccttgctaactcatgtctctctcactcttgtacctctcttgtaagatcacatttaaccacttcctaatatgctgtatctgtactccaattttctatctaggtcctgctcatctttctatgtcctattaaataccaccttttagtgagagcttctcttgtcattgttcgtatttcttgttcctttattttatacattaccatttaattctattaaaaattccttttagctaacaactacaatcacagttatcctataaatgttctcttcttggaatggtatttttggacattccatgttttgcaaaaggcttctgttttcaagatttaagcttgattctgctttactttataaatgtgtgccatgtccagtgcctctgttattacctcccaccagaggatgccaggccttgaagaaccctgcctgcatctcacaatataaggagaagaaaccagaacaattggtgtctgggattctagcaggacagatctcccacttggtcccatcagccatgggattcattagctgcagttaacccttcattggtcccaaactcttctctctgaatattgatgagaagatacctggaactttcatggccttccagcattttccccctggttttaatcaagcctttggtaatgagtttgtggcttgctctcttaatgaaccctatggtatgatgaaaactggtaccctcagtaaaaggccatccaactgtgactaaagggctcagaaacaagaggctgagtcagccagtgctgccgcagatctgctgtcagcaccatcaggagaatttatcaccacacaaataataataataataataataataataataataaatgtgtcactgcaattcctactagaaactcaactgccatcagagtgcacaaagtcccaaatttatataaggaacagctgggtcacttccatgacattcaagcttgggctggagtagcgacgttttgtctaagccaactcagaaccctttataatactcctcccacctataattttctgttttaggctctctgaaatatcctccctttctgttacctttacctgaccattacctcgaggaatctctcaaggctcacactcggaatcttttttactgcagcttgtagtccacagtagctggctctttactttgggcacagctattgatctctgcccggaagtatggacttgatcttgggacttccccctaggtctcaaggtctcccttgtgaaggctacctattttgttttccctttcttccatatgcccatgctcaactcccaagatcccagatgcagaaaagctccagctttgccccgaaccaactactcagtatgctcaaaagcaaaaatcacggactataagtatgaggaacttaggtgctgtactgaactttgcaactctcatagtatctaacagaatgaggttacatgttaagtattatttgattaatcaattgataaaatgtcttgtagataaacaaacaagaatccaaataggaccacaaaaatgaaacctgagacttccaaaataaccgaaatggcaggcagtccatgagatagtgtggaacataattgacactaaatagactccaaacaacaaaagattgtgtaatcctaaacactgaagcctactgtaagaaattataatactgtatgatgctaatatggagaattacagtagggattaattaaatgataagagctaagagaagaaacattagttaatagaatatattttaatttttatttttgtgttctgctctattctcttggtctcaggctcagctaaataccatacgtagaaggattaccaacctcttcctgaaagcttgaattacagttccccaggtggatattggtacttcatgaaggatggttggagttgctgaatattttacaaaggaaatgcgtgtggctcaaaggataatctagttatcttgatgaatttatcctttgtagttgaaagaagttttgaaacattagacttcaaagaaaagcaggaaagtgattgagcatttatgtaaatactccctaattgcaaaaaagtggttcttagacatttctaaattgagtgagataaacatcaaaagtgctacattattttctattttacaagtgtcactatctctctttccctccatattcagagatggtttttctgtatcatttctgctaaaagttaaagaaataaaaacgaacatcccatattccaaaaatcacgctcaaacatgggagatattttgaattcagaacacaggttgtccaaaaattaatattacgtccagtggtcagtttcccaggccaatccataaacattctataaaccctagactatagcttaaatctagtctaaacataacacatttgtattaaaatatgtagagtaagctatcctgtaaagattgtaagaaagaagattaaaaaacacaattgaaaaaaaaatactactttttagtgcgatggctgggaggaaagtatgtttaattagagcaaggaacagcaaaccaaactgcagactaaatcaggccacccacctattggtttatattttttccatggctctttcatcctaccatggcaaagttgagtaacttcgatagagaccatgtaactctcaaagccaagagtatttacgggttggaactttccaggaaaaaaaagaaacacacaaatgctggctctgaattgaaagaggaacaggagctagatggaactctctgtaaattttaatgttaacttctgtactgtgagctcctccaagggagcagtgctgtggctcgggcatcctctctccagagatgaggctcgtgcctggcacgtagtaagtgctttgatacagttctagtaaattccaagggcttgataaagcaattcctctagttctttctcatttcatttcagttcaaaaattacacatataattaaatattattttcagggagtgaactttttattattctttttttttttttttttgtagaacacaccgagcttctttctgtgggctaaagtaggcttcagttttctaaaccatgcatgggtatttggtgtaggtacttggaattaaaataaatattctgtctggagtatgtcctcagatataaatttttaagataaaagtcagtaattatcttattcagtaatctttccatcaggcatttttatttatgtaatgtatcataccgagagaggtgttaaaattgtttctctcaacttgtttggcaattgctgacaattattgcgtaatagatgtgtcagtgcatacagccagatttttgttaaggattgtaatcactgtcagtaaaacaaaccctctcaatcccatatcataaaatgtgtgctaaattctactctgcatattactgatattgcattcatgtttgcctatttccattttcttaattttattcagtggtgtttactgaatgcccccaataaagaatagggaattgtggctcatttttatcttacctttaccttcattcccccaaacagcagcaacaaaagcaacagaaggaaaaatgattttgtttttctgtcttctttcatgctgtacatatctttcttactgtacactttccctcaagaattatacgctttaaatttgatttgatatatgcttattcaattatacatgttacttgataactaacttttatcatagttattgaagtctacattcaataggtatgaatcataaactattcaattgaatctgtactttcttccagtttcatatcataattaaaaataacttaatcacttttatagtgtcttgcatttccttggtgtattatgtatttcaaatagactttctgttgcctttatatatgaatgacaatttggatatgaaatccttggtcacattcttttttctgcccaaatgctgtaatcttctggtatctaatattatggaagacaaatctgaaataacttgatttatttttgtattgtggatggcatgtcccttctacctggaagtttatggcatcctttatttttggaaccaataatcctttcacagaatgttttcatgtggttcattttcattaattttatgctatttacattttaagaatgcataatgcattcaaacaacttacctctattcaagaacctagtaaatattaaagctagggccagaaatcagtctcttatatcccgtttctatcctctttcttcctagttactccactagccctgcatcttaaaacactcattgcagtgtaattgtatttattcttgcagaaaaagtcttagtttagtctcaaacttagaaataattttttaaagtctagtcaggtcactagtattgttgagggaagcccacgaatggctttttcctaagggaagagtgattctgagagcaggtaattgtcactcagaatatcatcccacccaactctggtaaatgtgagtagaacatgaaagaaccctcaagcgttagcacccttgcttcagacatcttctgctctaacagaagatgggtcacagcagaggtgttacatgtgggaggtagaccacactgttggcaggcctgatggctgcttttggcaatggtagaagcaaaggaagttcacccactgagagccgaagaagagaaaatggcatgggccacaaagtagccaaggatattctactccatagcacatactatgtggaaaaattctgcagaatccacaaaactatacattatcacagaatcaaatcccataaatattgtcttgtgattctttgtgaccctgtgactttcctctttccaaatttgatatgacctggcttaagtaagatatattgttttctttttaccctctccctttttcttaccttctcccattcatatactctctctcctccccctccttccctctctttctccctctcctattcttttctctgaaaacttactaagggccatctttgtgataagaaattcaaccaacaacacggaactctctcttattcagattcaggtttattatggccacattttctgccttcctttgacaaatcatggattattatgaagcatgaaacccttcagtctgaaaactataataacaaatgtgaggtagtttttccacaacccattaatacgtttctattgctaacctgcctgttcccatgctcttgtgcatttattattaatactgtgagcagaacagttcctctgagatttggatagttttaaaactcacaattctatgcctttctctataatcgtaatattttagagtatgtattaggctatggataaattaaaacatatcacaatagaatatgtaatgaagaccttaggtgagtttatcacaaatgacaaaggaaaactatccctgaagaaaaaacaatccatattgaaacaggataagaacaaccacaaaaaattccataaggaatctgatgaacatttgagtgactgatactgaattcagcccattcttcttgatgtgagtgagatttgaaacagtacagtgagcttttccagtatagcatttttggaacgtgaattaccgtacataccactaacatagaactcaaagtatattaaggctgcaagagagcttggcagtcatttaatatcttacttttcagatggagaaactgatgcagataaaaggcagttgcacgccctaagcatttagctagttcgaggcagaacctgaactaaagccaaatgtaaagtctcttaatgccaagttttcttcactttatcgagtttccttctgtgtcctgcaacacatggcttagacaggttaatttgttctagaaaatgttagatataccttggactcatctgattctaggctattatgtcaaagtaatatgtcatttcaggtgattctcttaatatgagacataaaattattctcagcatgaaatttgaaatggtttaaaaattttgcaatcagcatacccaccaccaaccaaataataaagttcatttattttgcatcttatatcatgaatagactagagcacaccaaaccactgagttattgaacttgcatctggcagaaatcaatttgacatcccaatttggctatttctaggccatatgagtaatgtcataactgtgttacatcagtggtttttcaaatgtggctgtacattataaccacccaggtaaaattaaatcagaatctctggagggagggcctgagcttctgtttgtgataaactaattagagagttttactagtaatgatgtgttatagtaattatgaattttattacacaaaagctacttttaatcacaatactcagaaacacagattgataataaatctatttgtaatcataaagtaaaaatcaaagaatgagaaatgcttcaattttagacattttctaattctctcaggtaatgaaattcggactttgttctttgatccatactctctcaatctgtaaaatagaataacatttcttgtctcacaaaacaattacgaaaattatgttggccacatgataatatgccttacattgtgtacatagttaatgctcaattaatattatccttgatgacaatggtgatgatgatgttgattaataatacttaataatacttcagcttcaataaattaaataggtttccggtcctatgcccattcaaggcttgcatgaggattccagcttgcaatatagacatcttagtttaaattcttactaccacttatagattatttagtggaaagctaaaagtattagtagtttaagactaatggggcatcttagagaaacacagaaggtggaacaaagtctatacatatgcacaaagcagtttaaaattaaacagatttaagaatttagacattgtcaaagagaaagttaaagagtagattttctggtttgaccttttagcaagaaagtaaatgagaagagaagagataggaccatggaggtgacattttgcaggtgcgactgagtgagggcccttgaaattcaacataaatcatttgaatttcaacattcagatgtgattcttgaacacttttgctcatttaatgtaatcatttgaagccttatcacacttcaattgaaagtaacttacagctgtttatattgagagtttatcatgtagaacactcttttaacaatatgaaatactgtccaatcactctggttgccatatctaatgtttcttttgcacatgatcccataaattactttaatggaggagtaattttctcacataagtttgtgattttgtggctaatcttctgagaacatacgttcacagacactaaagacagcactctgacttataatatgtcaggtaataacggagatatacttcaaagaagcgatttccttactgacccttggtaagaacccaggaaaatgatgcaaacctcatgcgttcgtttgttaattaggagactgaacattcatttctactgccttttatatgtgcaggaaggcttctggctctggccattctgcaaaccaaggagataagcagtgacctgcagtggtgctctttccctgttctgggctttattcttctatgcaggaaccaatatcagcactgtcgttgagttgtacttcatcaacttagaaagactgttgaagtacgataaaggatgcacaaagctgttttatttcagtagaccctttttatcagtgtctgtgataattgtagcaatagcatggctctaccacatcaacaaaccatctgtgggccctttttcaccattgctctggccctttccagaaaaatgtgccacatccctgtggtaccaaaaccctttggcaggagatatcatggcttcaaaataagagtgtccaccttcgccttacaatcaggattgatgcattcagatttggtaaagaaacacataagaagcattctcaaaacttttataagtgataatggaaagtaaagcagaattgttacattcctcatgaagttcaagaggtatacatgaataccaaagtgacaaaatcctcttgctcacagcaccaatagtgacagtgaccatttaatacatgctttttttaatgaaaagaagaagacagatcccttctctctctttctaaacagacatctagtcattaagaacatgaaaaatgtcattcatgttttccctaaaaagcattttctaaaatttagtggtccaagaagtaaatgtccagtgtagcaacaaattacaacacagcaaaatttgactttaatcatatgaatctatcactcacagttgcagaggtttggctaagttcataatgtaggtattatgtgtatgtagtattctttctggtcaccaattattgggggaaccacccccaataattcaatgtaggttcttttcagatatcgggggaaccacccctgataattcaacgtaggttcttttctattttccctgagtgttggctggtctgagtaataaagggaaagagtacaaaacagacaaattttaaagctgggtgtccaggggggacatcatatgtcggcaggttctgtgatgccccctgagccgcaaaaccagcaagtttgtattagtgatttttaaaggggagggagtgtacgaatagggtgtgggtcacagagatcacatgcttcacaaggcaataaaatatcacaaggcaaatggggacagagcgagatcagaggaccgtggtgaaattaaaattgctaatgaagttttgggcacatattgtcattgataacatcttatcaggagacagggtttgagagcagacagccggtctgagtaaaatttgctaggcaggaatttcctcgtcctaataggcctgggagtgctacgggagaccagggcttatttcatcccttatcttcaaccgtatcaaccgtataagacagacactcccagagcggccattttagagacctacccctgggaatgcgttctctttctcagggctgttccttgctgagaaaaagaattcagcgatatttctcctattcacttttgtaagaagagaagtatggctctgttctgcccggctctcaggcagtcagacctaatggttatctcccttgttccctgaacattgctgttaccctgttcttttttcaaggtgcccagatttcatattgtttaaacacacatgctttacgaacaatttgtgcagttaacgcaatcatcacagggtcttgaggcaacatacatcctcagcttacgaagatgacaggattaagagattaaagtaaagacaggcataggaaatcacaagagtattgactggggaagtgataaatgtccatgaaatcttcataatttatgttcagagattgcagaaagacaggtgtaagaaattataaaagtattaatttggggaactaataaatgtccatgaaatcttcacaatttatgttcttctgccatcgcttcagccggtccctccgttcggggtccctgacttcccacaacaaccaataactttatttagtacgtttaaaatatagatttttctcttgactttagtgttcaaagcagcctgtaaatacttgtaacatggaatttttagcctgccccccaaaaaagcattctagtttcttttcacaacatactgctaaatcagaaaccctaagatattagcctgttctcatgctgctaataaagatgtacccaagattgggtaatttataaagtaaagaagtttaatgaactcacagttcagcatggacggggaggcctcataatcctggtggaaggcaaaggagaagcaaagtcacatcttacatggtggcaggcaagagagcatgtgcagaggaatcctctaacaccatcgtatctcatgcgacatattcactatcatgagaacatcatgggaaagacccacccccatgattcagttacctcacactggatccctcccatgacgtgggaattatgggagctacaattcaaggtgggtggggacacagcaaaaccatatcattctgccctctgaaatctcatgtccccacatttcaaaaccaatcatgccttcccaacagtcttgcaaagccttaacatatttcagcattaactcagaaatccatagtccaaagtctcaactgagaaagggcaagtcccttctgcctatgaatctgtaaaagtgaaaacaagttggttgcttcctagatacaatggaggcacaggcatagggtaaatacacctgttccaaatgggagaaattggccaaaaggaaggggctacatgccgcatgtgaagcaaatccaaaatccagagaggcagtcaaatcttaaagctccaaaatgatctcctttgactccatgtctcacatccaggacatgctgatgcaagagatggattcccatggtcttggacagctccacccctatggctttgcagggtacagcctctctcccagctgctttcatgggctggcattgagtgtctgcagcttttccaggcacatgctgtaagctgtcagtggttctaacattctggggtctggaggatggtggccctcttctcacagttccactaggcagtgcccctggggactctgtgtgggggctccaaccccacatttctcttctgcactgccctagcagaggttttccatgagggcccctcccctgcagcaaacttccacctggacatgcaagggtttccataaggcctctgaaatccaggtggaggtccccaaacctcagttcttgacttccgtgcattcacaggttcagtgccacatggaggctgccaagacttggggcttgcaccctctgaagccacagccgaagttgtaccttagccttttttagccatggctggagcagctggggcagagggcaccaagtccctaggctgcagagcagaagggccatgggccctgtccacaaaaccatttttacttcctaggccactgtgcctgtgatgggaggggctgccatgaaggtctccgagattccctaaagacattttccttattgtcttgctgattaacttttggctccttgttacttatgcaaatttggcaggcaacttgtatttctcctcagaaaatgggttttccttttctattgccgtgtcaggctgcaaattttccaaacttttatgctctgcttcctcttaatcactttgccaccttagaaatttcttccaatggataccctaaatcatctctctcaagttcaaagtttcacaaatctctagggcaggggcaaaatgccaccaatctatttgctaaaacataacaagagtcacctttatgccagttcccaagaagttcctcatctccatctgagaccacctcaacctggacttcattgtccatatcactatccgcattttggtcacagccattcaacgagtctctaggaagttccaaactttctcacattttcctgtcttcttctgagctctccaaactgttccaagctctgcctgttactgaattccaaagtcacttccacattttcaggtatcattacagcagcactcctctctactggtaccaatttactgtattagtctgttctcacattgctaaaaaagacatacctgagactaggtaatttataaaggaaagatgtttaatggactcacagttcagcatggctggggaagtctcacaatcatggtggaaggcaaaggagaagcaaagtcatgtcttacatggttgcaggcaagagaacgtttgcagggaaatttccctttataaaaccatcatatcttgtgagacctagtcactatcatgaaaatagcatgggaaagacctatccccgtgagtcaattacctcccaccaggtccctgtcaggacacttgggaattatgggagctacaattcaagatgatatttgggtgggaacacagccaaaccatatcaccaactgtatctaaattctaatgttaaacaagaaaattgtaaaatataggctaatctttgctttttatccatacactaatgagctttatttatgtggaaataataacaaagttattttatgctgctaaaactaacttatttgaagttcatgatattttatcctttaatgattctaaaatatgcttgcaaccacaatctgctgtcttttctgagacaatgttttctatatataagaagtagcaaaatgtagtaagaaaatgacagaactgggtctggagacctgaattctagtcctaaatacactgctggtcacttctccaatctggggtttccatttgtaaaattatattccacagatattgaaatatttaaatactaatctgtgaatgtttgtttctgaacctcactttgtcactttaaaacaaaattatgtaattattttacaataaagaatatgggagaattaattctccagctttgtcattttattctttcttctctaaaacagatgctgcaagtattaccaagtgtcttcagccttggaaagataaaacttcctttgcttgctgcagtatttatgtatacaattgattcattaaacaagggatgcatttttaagaatggcttgattttctttggaaaaaacggtttgcactaaaaacattaaatcaggtgcagtttatgtgccaatgaaccaaggaacagcagacagtaaataaagttgagaatactgcacattcaaacagaaagaaaatgagaagaggaaactgcaccagtattgaactaacatggagggcataaactaaacagtgactgacacagtttaaaattgctttcattctttctcaacacttttcactcagtggcttctttacagctttcaattaacctgctccctctgcttccaattgctctttcttactgccaatgatatttaaaagatacactaaattatagattcagaaatgtttggaaaagactctgttaatagttttgctatcctcagatggctttaaaattttgaagggtgcaaactgctaaactaagaacaatattggtgtcaggattcttggagaccagaacagtcaatcccagggtgaccagccagcccagcagatactgagatactgactgcactcctgccaatggaagaccatccaggcacaacctcctgaagccttggccctttgcctacaacgcacgcctcagaatgatgtcagcatttgaaaaggatttgtatttaccacatcatttatcattatatttgaactttttaacatgtactctggaaacatgtaagtcaaactcccttcatgaccacttccatcatgatggtgtgaatctcatgcctattataaagagatccatcatccatggcagtctactgctcctgcacctctagactggaattgacttgccatgtgagttgtcttggtctctttgtttttacaaagtttgacttctgcttccccaacctttagaatgctgtaataacaagaagtttgcatatgcatatggaatgctcatgcacaattacatttgagtgcacagtgagtaatgtggtatattaaccaacagtgcttaaccttaaaagacatttgacagagaatcacccacacttttcaatgaaattaaaatgaacagttagaaataacacttccatggaattaccttatttattttaggagcaaaatggaatgaaatgaattagagactcttacacaggcgttagttcatgtttgtcataacagcaaacagagccattggcatatgtataccaataactacaatgagaggtagaaagaaatgagcaccagccaagcacatgggagttttgagtggaggattagttacagttcagaagatcccaaaatgttttgttgattgtcatcatttaaggtaagcccaagactatagggaaaaattatatacagagagtcagagggaaaggagggagggagggagagagagagagagagaaagagagagagagaaagagaaagagagagaattgtgggacctagagataattacaggatagctgcttctagagaaaccagaagagaagacatggcatgtatagaaaactataaatagttcagcagtctagataatactaatatatttttatgtactgtcaaatataagtatatattcacatagaaagaaacatatgcataaagagacatacaccaagagttaacaggaggcttttgtattgtcgcactactattggaaatttcccagtttctttactttgtgcactcctagtactctaggaggcttcattttatttccactaatgacagtttatcttcaagttagtgtgaaagctgcaggctattatcattgaaacactgggtaatatttttgtacaaatttttttccccagtgaatttcatttatttcctcataacctctctgttttgaagatggtctctattcagtgtaggaaaatttctctactggaaaaaaaatggaaagatctgcaatattatacaggttgaaaagtttttccactttcatttttcctagtgtatgatagcataaactagcatttttttacgttgtaaaggcaagaatgatgtaaaaaccagaaaagaattaatgtacgtaagctcattgttattattcctcatagcaaataatatcacaaaagacaaaacaaaggaattatttgtaggaacttactaaagaatgtctgtttgcacaagtttaaaatttgctaagtcttctcatcaaataaatttaaacagcttactatgaagattgataggtatttaaactgaccttagaaatcaggtatataatttctgactttttggttttgtaattaagacgtgacagtgtgactgaaatttaaattcaagaaattagaccagcagctatacctttaaaagtacctgtagatttttgttccatgatactattttaaaatgtactcaaagcttgcaggtttaattacaggatcactaatttgtttccagatacaagagacttaaaatttaagtataactttaagccaatatttaatcattcaattgttcttcaaaatattaatcttctctgtatttttaaggaaaaatgacttatctagtctaacagtatgctgacttcatttcttttttccagcattaaattacatataaaccagtttttcaagctttaaaaatatggctcaaattaaaagccggtttcttgaggttttcaggtatattagcccattttcacactgctataaaaatactacctgagactggataatttataaatgaagaggtttaattgactcacagttctgcatggctgggtaggtcgcaggaaacttagaatcatggtggaaggggagggggagcaaggcatgtcttacatggcagcaggagggagagaagaggcggagctccaggcacttatcaaacaaccagatctcatgagaactcactcactatcatgagaaccgcatgggggaaatcacccccatgatccaatcacctcccaccaagtccctccctacacatgtggggatgacaattcggattataacttgagatgagatttgggtgggcacacaggcaaatcatatcatcaactatcactaatattcctgcttacaattcagaaatataccccattttggtacaatttggaaatatagggaaagtgatatattctctgagcacttttccctaaaatgtcaattataaattgaagattcagaaaatgtgttgatttttccaaagttgtgtcaaataggtagatatatgactggaacgattaactcaaaagtgaatgacttattcgttatattgaaaatagaaagcccaagtcccaaaataagagatatattctaatttctatgtatcccccaggatttgtgcctcccatttgtttaattgggtgttgctagtgaaatggcagtcttattagctttaacgtatttaaatttatgttcctgactcatgtgccttgttttcaaaccagttcaaccatctacgttatggtatcatcttacatcttctatcttaaatgttatacaaagtgtgtaagatctcaacttgtcttcatcctaagaaaaattcctgcaatgttgtcaaatttgaaatcctttttcttatattctaggtttcagtttttacagtgccaataagaagaaaaatgaccctggcatagaactttttttttttgttttatcattggtgctatatgtgaattccaaggtagtgttttgatgaggaacatgtttagtgagaataatttcattgatttcttggcatttttattagtatatattgaagatccagaaccatctattctttcaagaattatcttaatatatcaacatatactacatttccctaatctctactctgtattcatttagtcaacacaaccaaattcataatcttctttgtatctacatttgtcgattttttccaagacccctttattttccactatctccttctccaaataatgatggttgtaactgtaagttcttattcatatccacctaatcatcaagtatttctgttaattctccctttaaaacatgcctaaaaattattccatctctgttacttgttggggacacaataacctcttagagatagaatccagcaaatggagtggatgtcatttttttcttgaaatatcaatctaaattttagtagagaaatagcagatataattgtttacttgaaatcaatataatgcactaatccaagatgccagggactaagaacttgagacagttcaacaggctgagtcataggaatgggcctgtagggatgggtagaacagaagattgcacagggcaggacagaggaacaaatgagataggaaggaataagaaggaaagatagagatcaaggtgggagtacctactataacatacagagaatgaaaaataagatcagttaccacaggagttaaataattaaggttgtaattttatcactgcacatgactggaaggaaaatatcctgttttgtccctttttacttgtatacaaatgtttcagctgtaataatttactgtggccataaaaataaatgttccatttgaaaacactttacccccaccttttaaagggtgtcgacttcattcaggtcaatagagaaattagagagggtagaaggaaaaaattgaagatgtgaaaggtgatgtagaatcaatgtgacaatgtaattcatttaccttttaataaaaattacacacaacttctcattgcttttcttttcttaaagatcatgagctgaaattttaatatttctgtttctatgcttgaaaaacagtctttctcccttgcccctaccataagcagtggctagctaaaataaactaatccaaaaagtttcagttctttcctcaaaaaatcccattcaatgaagtccgaaaattagttctaaggatatctcaatttatgagtgacagcttctggtagtgtgaagaagtagaatctgtctaaaatattcacatgataactgttttctttttccaagactagagccattataagctgaaatataggtagagccaggtgcttcacaacaatgtttcagtgatggaccacttccacatacacaaggatggtctcataaaattataatactggccgggcgtggggctcacgcctgtaattccagcactttgggaggctgaggcgggcggatcacgatgtcaagagatcgaaaccatcctggcccacatggtgaaaccccatctctactaaaaatacaaaaattagctgggcatggtggtacgtgcctgtagtctcagctgctcgggaggctgaggcaggagaatcacttgaacccggaaggcggaggttgcagtgagctgagattgcaccactgcactccagcctggtgacagagcaatactccgtctaaacatatatatatatatacacacacacagacacacacacacacacacacatatatatactgtgtttttactatgctttcctttgtttctatgtttttagatacactaatgcttaccattgtgttacaattctctacagtatccaggagagtaacatgtaccaatgtatagcctaggagaaataggacatgccatatagcctaggtgtctagtagattatgccatctaggattgcgcaaatgcactctgcgatgtttatatcatggaatcccctggaggacacatttcttaaaatgcagcccatttttaagtaacacatgactctgtattccatcttctaacccttctgcttctggaaaagcacagacttcaggccaatactgagtatggcctctgaacagaaccaaaagagacgttgcagggtaaaaaggagttaatgaaaagttttttgtttgtttgtttgtagcctggataatttgggttaagataatgtttcaacaggaacagaccctgaattactgaatccaaaagggatgtcttgggttgtttctcacgagtggtcatcagatttgtatttctgcaaaatgagattttccatatttttgttagacttcagccaaaacttttgctgtgtagaaaggggaatgcaatttttcttatggtatcaatgagtgagaacatacaaatatataaaacattagtgttaatgaaaagaaaaaaaagctaaaaagtgtaaaagtgaatcaccctgttaacatttatctgaactttctgggggagaaacctgatgtcatagaccacaattagaaaggactgcacttaataggaactttgagtaattatatgaaacaggacaaaatatttaaaatacttttaagtatcctaaaaaagaagaaatatcacattaaaataacattcagagatgattattggcagctcctaattgccaatccctctgctggatgttcaagatacattaatgcaatatagacaatagcctgagccttaccttccacaagtttactgtttgttggattttccagcatatttaaaagtggaaaatgataatgcaaaagaagaggatcaatatatcctgaaagaagaaaaaattccaaatgaaacagaacttttttttaaatgtcccacgagtgtgtgtgtgtgtgtgtgtgtgtgtgtgtgtgtgtgaatcagaaaaaaatatttattaaggaagaactgaaaattgacatattgcttcaattacattgtgtttggaatcatacataatttttctttagttaatactttgtgaaatatatttaaatatactcctgaatttaactggtcacaaatcactttgtcaacttcataatatgccaagttagagaaacacacaataaaataacatctttggacagtcggtcttctttagagcaattgtagtaaggttagtgatacagcaacaacacaaaacaacaaaaaaccaaatcaaatcgacaaaaaagtcacttttgctttcacattttccacatagtagggccttagggatgacaatcctgatggtggtgagtgagattctcatttgtatataaaacatattgtcttcatttatactgcatccttatctgtgcttgtctggagaagctgctaatggagattatcaggggctcacatcacatcatgccacctttttgagttgccacagttgagttgccataggcaaattggtatattttcatgccacatagctacatgaaaatacaccagtaacagtgtagaagagttttttactggtctctattcataacctacattatctgatttcagccaagatatttttttaactgatggctaaatgttattgaaaattaaatctcctcttaaggataaaactagatcagtcgtctcttgagtgaatttctcagatttagttgtagaaaatatcatatgtatctaattctaatttgaatgttaaaaatgttaaaaaacttaatgcctgtgtataaagagccattaaaaagaaaatctcgccttgactcagccattacacttccggcaatccaaactatatagaaacctatgcccccagaatttattgttgtatgtttaagacaattaatttaaatagccaaaatatttaaaaatggtgaacaactgcacagaatataaaatgtctactagatgaaatgctactagatacactgttatgtagctattaaaattgcattcataaaatatttataataatatacaaattaaatctgtcatggttaattctattatcatataaaactgcataaaaataatgagttcaactatgattacagaaaatgtacattatagaggcagaaataattacatcaaaatattgacaacagttgtctttggtagtgggaatttgaatccattatcttttcctatttttttgtacttcatacaataagcatattttgatgtgtaaatacataaacatcttaactattttgtaaatcctgttctctgatacactttagagctacaagcctttggttagtttctgcaaaagttttttgttctgtgttgctttgttttcgtctctataaaagaacaaacttttctctatgctcttacatcacaacaatcaacacagaaggtttttgtgaccaagtgagcttgggttttcccacacacatcaagcaagcaatcaattctgcagcagacacaggttgagtgtcctctaattcagttcaattctaacactatccatctggagttagcatcagatcccagggtgaggactcagttttcaagaatgccccctcccaccacttcagaagtcaacagaaaggtctgcctctttctgatggacaagctacaaatcattcctacaaacccttcctttgggttcagttaatttattagagctgcttacagaactcagggaaacatgcttacttgtttatcacaaaggaagttacaatggatattggtgaacaccagatgaagagatgggcagggaaggggatgagtgtggcagtgtacagcttccatgacctctccaggaccctccagaagcccccaagtgttcgaatatccggaagctctttgaacacttctttttgggttcttacagagttttcattacaaaggcatgattgactaaatcactggccattgctgatcaccttaaccttcatcctctttctcctctcctgggggtgggttggggcagaaagtcccaaccctctaatcctgccttggtttttctggttaatagccccatcctgaagctacctagggactgccagccctcagtctactagtcaactcagtagcatacagaatttattactttgaagattccaaggattttaggaatcatatgccaaaaactggggatgaagaacaaatatatatataatatcacacaccaaattctgaaattgaaaataaccaaccctgcttatgaaagcatagttgtgattttttggggggaatcctttaattcgtaaattatatactgtacctttactacatatatgacttttcaattatttaataaattattgatggcatcatagcattagttttaatatattcatgttgacttgctatcaactcaaggacttcctttcagctaaataaaatatatccatggggaaaattcttgtaaaactttgttttatgcactattttatttacatctcagagatctaaattatctattctaagattaattgggccaacaatatcttaagaaaagaaatgacagactctaaattggaaattaaatatcagtccactaattagttaatagatcttttaatactgtctctaagtgatcaaaatgttctgtgcttctgctgacttctagcactgaaacttgttcttaaaacctgtaatcagaggaaagagtataatgggaattgtaataggtatacctttttttattagctattctctgatatgcactgatatggatgctttgcatatgtcacaattatgagtaaatatacattatatctcttctgaagtagatatttacatgcctagtttacaaacagaaacaacagtagaaaggttatgaaaattgcccaaattccaaaacccagaaaactgacagattatctttgtatggagtctctctcatgccagtcgtttgttggtggtggtttaatgtggtcgtggatcatatagtaaatacttttcaaatgtttcaaccatagagttaaaacatcttagatatttaaactacatttataattcatattaaaaatatcagctcataattttgtcatcccccagtgtttttacaactgattattgtatataactaatggccccacccttcagcaaaatgtctttaatattttaatattcctatttttaccatgcaatgggacaggcaatgtaaggagtgccatattttcaaattgaagccagacatgggaacattacataaaatgtataaaatatacttccctaaaagaaaacgaactctccaagagataaaataaggaaatatactgaggcattgacagtaatttgccttcacagtgtcctccataactggagacttaagaaatatgagtgaagatatatgtcagtaaattgtaggcaagtaagcaagtgttttaattatcttcctgtgattttctgtctaaatatgaagatatctagaatccctttctctattccaagaacacatttattattgttcactgacagcataagtttctccctaccatcacatttattattgtttaattaaacagagacaagtcaagtggttcagaaagaaaccaagtaaatgaatccccatcagtctttacataattaatgatattctctgtagactgcacaatttattaaattgctgagcagaaccacttcagatacacatatttatgtattctgagtcaaagactattctagaaactgtagaacattggaaactaaaataagtcagtggattttttttaaaaatgtgtaagtatgacaaaatttaggagagtaagaactattaatagtgccccattacttcttttttcattttcagaacctttaatgtagtgctatagcaattttgaaagtaaaatcacttaagaaaaataatatgaaaaattaagatattggaaataaagtatataataaaaaagtactgatttctagggaaaaataaataattccccacactcagaccagatacttttctccctatggagtaaattacaagtgaaattttacatttgaatgaatccggccataggatatatattgtaattattaaaagtctaacatagcaacttgaatgtttcaagagacttgctattttatatttaatatgagtgaaaatatgttttaggaatatgttttttgttccttaagattaagttttgtatacagagtcatagacagaagttttattctttctgtctctgggagagcacagcagtaatgattctctatgaggctaccaacatagcaaaattaaccaggaaaaagcaggctcctatgcagagcctattaataaagaaggtaatgacctctaagcattttatttgtgtttcgtttaggcagaattctgttttgtcgtattttacacattattcacaatactgtttttcaaggacatatcacagactaaaatcactgacccagatgacaaaaattataacataagtttgtattgtgaatgtcaatcatagctgttaaaactaatgtatgctgttaaagaaagagtgtgttgaaccattccagcaaaatttttagtgggaaaatccattaaataattcaggagaaattgtaataattaatcattggccttgaataaattgctagaagaaaacaacatactatgttgtgcttaatgaaacatatacgtgaaattattttcaatttctgaaacgtatcatttcaaatataatgagaattctttcattcatgagtcatagataatatcaaagctgtcttggatgctgttaggacacagtatttctgggatactattaatcaaactgaagaaagtaaaaataggtttataaagtagtctagacccaaaagggaggatagacattaatttcttgtgtgatatattggatacattaatatacaatgcatctttagtacttgaccttaagtgtcaagaatataatgcaccatttctcttttataagcagtactttaaagaggtgtttctggtcaacattattttgtactgcaaggttaaaatgatgaaatgcataaaaacatgaaatacacaacttattaaaatgcaattcaccagtccatgttcaggtgtttctttaatgtcagacctcaacaacaacactttcagataaaaattaatcatcaacatgatgctgtatggtaatggcatgaattttatttccatttaaatgtttacatttctctcaaatcaccaaattaatagtacctttaagtctacaatcaaaatacatatttagatttgtttcttttatgctatttttgcagcaatttttattgatagagtatgtgggtccttagctaacaccaagtattcattggtaatgatatcaaggtaagagctctcaaaaaacaacattggcctcaaatattcacccaaaacctagctgtatgattactgcttgaccaagtgcctttgacaaaatctatctaaaaaaaatcagaccttacctcccttttccagtggagccttttaaggtattcacagctttcattctaatttattgtgaccccatatatctacaagtgtaattggactcttaaagtttttagaccaatccaccactagtagcatagtagaatgtatcatgcggtaccgtgaaaaataatgggaactgaaataagaaagacattcatttatatcctgtctaaatcaattactctcttggagacttggttttctttaatggggattaaaatgctttccattcaagatgtactgagtttaaaataagcatcatacaaataatatcttggtgtatggtaggtttccataaattttatctagcttccttcaaataacattatacaaataacatactacattcctactagatttccatcagttttagttgaatcctttcaatctccttcttttcatttatcaatcataacaatgtgttagacaacagaaattttttttagttacaaaatactttcttcaaacagaacaggactgtgttttttttttttttttttttttaactcattcatgaaacaaacattttttgaggcatggttattagcaaaaacattccaaataacgaaagagtggaggatggataaatgaacctgctgttggtttctccctttgttctaaataatagatgtagacatattttaataatagcgattagatgaaagtctgcattatatagtttaaattactttaaaatctctgatggaacttaaaacaagagaacaagtaacaggaacttgagagttagaaaaatattttttaaactttaggcagaaataaagcccaaaattttagtatatttcctgccagattattttatatcctagagataccattaagaaatgaaatagaaacaaaaagctgttgtaatgtagaaacagttaccacaattcagtaaatacataagtaggacttaatttttttagttcctaaagtatgttcttattcatactatatatgactttagcagacttatttacttatttatttactttgaaggagggagtggtggtgtttgggtatataaataaatgttagctgatgacaaagcaactcttttaatttatgaataaaaactgctaggcattaaaagttatttcctgaattatctatttcccaaggtttaaatctttaacttaatactcaatatgtaagttttcatcctgtgaaaaaaaaaattactaagtgtaacagaatttctatatttcactctcttctgtcaagaaaaatttcttttaaaagactaattatttatagttgaaataagactgattagtgttgcttgttccaatgactaattaatgaggaaatggcatgtccttaccctttgatttcttgctgattaataaatcaataaagtattactggaaggaaaaaaaaagcacagaaccacactcatataatgagataatggttgccctttttcactttctgaaaactcatagtctgaaaaaaaaaaaagtccacatcataaatgaaattagctgggcccattgccagacttttgaaggaggactagaattgatggctcatgaagattaaattatttattcactcctggaacatgaaacaccaggacagagttgggacacagccattatggtcgcagcttgtcattgcccttgctgctgtgggtttcatttcttaatatacaggaatttcaaacttcaggtttgttattataggtcagttcttgagatgggcctcaatctagtccacatcttcatgacacatccaagataaaaataactgctaagatttttggtgtttcccagtctgagtttctaaagacatcacagagtaataaaaaaaaaagtaacctatataatgtaggcaggcattagccacctttgagccttttatgctgtgtggatataacagctccaaagtgaggaattaggggcttcattgtaaacccctaaaacttgagctcctttgatgcctctttctgtaggtgatgctgtcgccatttaaatacctggaaatgagccatatgaggtgcagagctaatcttaaaatccaagtagaaaagacttcagccttccattggccctcaagaagtcacagtcagaaccggtttgagagacaggtaggctacctcacttacaaccctacgagtaggctgtctccctagccacaggattctctgggtctcttatgggcactgcatgcaaaacttccttcaccttggatctcttaactttagcctcctgaatcatcctgttcttatgcaacatcagctatcattttgaactcaactagtccattgcctgaagcataagagtcctaaagtgtcaaggccagttgaggcctcacccagctttgtgattttaaggctgcacttttatagatgccactgaaatattctttagatttcatgaaattttgagttcacaagactaatatttataccttaaagaagaatgcttatagatgatctggctttattgctgcagacagaataaattagacattttttacaaaagtcaaatgtaaaagtatagtatctaggatttttgtgctagtacttaaaataaaggaaatgtttgaaataaagggaaatttatccaaaatataattatgtaatcaatcaattaattcaaactgattttagtaaaacttccatctatagaacagctttcttttaatgaataaaatcattaatgaaggcatattgtaaacataaatatatggacagaatagtccagaaaatacagaatttggatgcgttgcgtgagttgtcgaggtgaagaataaagcatcttggacaacaggttgagcatttcaacaagaagaaaacttactgtacagggcctggctgctgtgtgctcccctagatgcctgaaggttctgtctcaaatataccattcccacctcctcccttctcccccagattaaatctgttagtgttttgaaatacccaaacttttcatgtttttaatagacattttgagtaactctggacaaaaaggcattgctagattatgatgaatatatgcactctggagttactatatctgaattcaaaaggtgccctgaaatttgctcattctgcagcctttgtttggttacctaaactctttaaacctcagtgctaccatatgtgaagtgaagatgattgtcttcctattaagactgtgtgggacttgagtgatgtagtacacaaaagcacttaatacataagatgacttggaagagaagagatactaaaatggtgtattttaatttttctccgcctcccgggttcaagtgattctcctgcctcagcttcctgagcagctgggactacaggcatgcaccaccatgcccaactaatttttgtatttttagtagatacggggtttcacaatatggaccaggctggtttcaaacccctggcctcaagggatctgcctgccttagcctcccgaagtgctggaattacaggtgtgagccgttgtgcctggcctgagtatactgttaatatagttttccaccaccggttaccaggctatacctatatcataaatcaagtaatcctataaatctcttatcagaaaaatatagctattatccccactaaccattgcaagactgacggaattctaatatttaccagagtactttggtctaatggcaagggggccaagttctctgttgcactgtgaatgggttgtcgggtaagacagacaagactacttcatttttttttttttcgtggtcacatgtgtctaaccctggacggtcatctcatttccacacacttttgttttaaggtaagaggcctaaataattaagaaccaatcaactaccctgagataagattttgcctcaatagtggaacataacacctgaaaggaaagtgaaattgaatgttgattttggagaaaagaaagaagaatgaaagcaaatttttatgtgttgacttagatagaggccttgcaaacataaacacatttaaccagcaaacaactctagggccctttgcaccaaacgatgcaaaataaaaatgcattaatttcattccaaaagctgcatccgtgcactttatgtaagttgcttaaagattaggaaatcagttactgtgcataaagttgaccttcatttcagacatctgaaaaaaatatagttttaagttaggatgatgataattttcctccggcaatttcgaaagaggtgtaattttgtagctaaagtcgaaatcttgaaagaaaagtctacctttcaaatatgaattcttaatcattaccttgatgtaaaatcaattaccattaccaagcaaaaataagtaagtgctcacttttttgtgaaggtgacattattcttttaatgctgtatttttaatattttcctttttgctttataatgggcccacttagatgtatttttgttttccttagtccaaattttagtaacagttttgtgctttggatcctgtcctgatgggtttgtaataatttttacagaatttttaaagagatattaccctaaaatattagagttccatataggttcttgaccacaaactagcagaaatgtgaataggtatattggaatagcttggccacttcagaattagtgagtcaaacatgaggaaatactataaactagagacagcagacctagaatttatatattatttattcaacattaacagtattatcagtaaatattctaaaattacagtaatgctattaaggaaagaattttctgtagagtatataaagacaaattctatattttttaagtttattaattaagtatattaaaatttcttatcacagaatgactatgaataataataattcatccatagatagatacagcttttctggtctgtagaaactgctaaaatcttatcggattcatatactgaaattttatattttgtcatgctgtaatgctcattcaaagatattaagattctgataagaagtgttttctaaaagcaaaataatatttttgaaaatccaggatatatagtttaatatacagagcttcttaaaaatacatccagatcgcagagtgtattcaactaatagtgtgtgaaacaattaatcactgggggtcagttttctaatttaaagtgaggtggtttggcctgaagtacattattttgaagcccctactatgattctgtgaactatttgacttactaaataaatgtggatggaagacgtagcattcaccaatggtccaggggatgctaaaaacaacagaacccttgctagattgacctaattgggagtctggtgtgtccctgttttaagatggtgagttatctaacaggcacagaacattcagcccaggtatgtaccctacctttaatcatctggacgtataatgattttgagcattagattcccaaagtcatgaatcctgttgaaagagcaccaatgaaattccaaattgaccagagtattttgccataatattatcaggttattttatgagtaattacattttattatagcaattaagacatctaattttgccagtatggaacaactaaatatgagtttaagtttgaatgatgagaagatttcaacttcatcagggtgatgaaaaggtacatagaatggtcatgaagtagaatgaaatacagttagaaaatactgatcactccagcatgtctagggcatggggcccttatagacacaaacaaaatgctcttcataggtgatgcttggtttctgttcagtacattgtgttcttccaggtgactaaaattgattatttgatgatgcctgctaatatctcccccttactggagttaacctgaacatgagatgctgtgattgccagggctgtcttgtgcttaacagtgttcctcattgattcagtctgaaagtctaaagtgctctcaacagtgtagccccttatgccattggacggctactgtagaagtgtccttggaaaacactgaattttatcaacgactggggagtagttgattaatttttaacgtacttgcttctataaatctaagttgccatttccagattaatttcatttcagcagagttgtttatgtgcatataaaggtataatttttaaaaagtgaaatttcaatacatgtccaattctgttggcaaacctcaaaatttaaaagaagctttctttatatttttaaattatgcttctatggtagccataaatctcagtgcacttttctgagtggaagccttggctattgatcaacctttggtcttctgcagctgagttaaatatcatggaaacattagtgttgaaaactaaatagatgaaattgtaaaacctactttacttaactcagtgacagtagtatttgtcatttatttacatgacgacactgaaaatcaatcaaatgtcagattccttttaactactttaacagaatatgtgagattgttgtatgttgggcaactcaagaagtaatttattcaaaccctaatgctggaaattaaataatatgactagaatgactactctggttagtagaacacttttcatcagaaagttgtgagttaaaagattttaagtaacccaatgggaactagattcaaatatcccagttcccaagccatgttctctaattcagatataaatattagcaataaggatgagtacctcataatctttgtgtttccgtctgtagaaatagcttaatgccacctgtcaaccaatgtctgaataaactaaatttggtaaataagatgccatcattgtttttccatggaattcagaggattcggttactgaaatccatggcattaatttttctgcctaacagcctacactctatattgatttttcatatagattaaatttcctttttaaatttgcattgactctttaggcttcggtttcctcatctgaaaagctggtaaaacaatagtgctaggaagaggcttcattgtgaagtcaacaaagattacacctcaaggctacatttgcaagtgcctacacaatatatgtgcattgctatatgttgttgtaaaatttttgaataagacattaatgcattcattttcttaaagaaggactctcatattctttaaaactcagaccccacaatacccagatctacttttatacaaaatccctaaggatgtgataaggactaaataagatcatgtaaatgctctttttttgcaaagtatgtgcttaaatataaactgttgtcattatgaaagtcattcagtgtagggttctatacagttcaggagtcaaaatactcacttgatacagtgactgtcattgtatttaccattcaacattgtttacatttacatacctggctttgttatttccagaagggaaaatccacgttcaccttgtttgcctttcaaccccagacactaggatggtgcatggcacactgaagacactcaataaatatttattttattaatgaatatgaaatatgacttagcagtacagaataatattcaaattgtgaaataaaatacactgaggatcaacactgttatttaaaagattctgttgatcctaaattttacaatgagtcattaaatgtattgctcagctttcataatcttcaatctataatggtttatttttcaaaaaggctttaatttccttggattgttgtaaagttcagagttattcctttaagaaacaggctatattgcattgcaacaataaccccagaaaaataacattagtagaaataatataattaaatattcatataagataattgacttatctgctttactcaaatggattttaatgataatattggactaaccctatgtgacagcatctgctgcttttatgcactgtccccttacctccctcggccccctgctttgccaatccttccgaacataccctggaacatttggcttaaagtttcagaaaatctgctccgtttgataatgtcaactcatcacatttcagttaagcagacatcaaatcaaatgactcatgtcacagatacataaatattacgtacatggaaaggaaatttttagctataaatgcataaaatcttctggtttgtaaacctgaactacattttaaaattttgacagtaagaggaaactgatgtgaaactaatacataactctcaaataatccaatggccaactgatttggaagctactcatacaaaataatacttgcgttaaaaaatgtcctttccttaaagttactatcttaacaaatgtacaatcataaatctactaaaggtaaacatcatttcttataagaaggatatattgaactgcatacacatcttactgtcttcaaattccttcaaaaatataattaacccatccaccttatcagggttagctcaaggaaattcgaaaccatcataagctaaaaatcgttatgtgattgaacctcatcactagataagtgattctgacaaaattgccattttatggaattgatcagaaatgccattccaagaaagagggttcgccttatgaaaaaccatatatatttttatatctatattatcttatatgaataatatatatatatttttttacttgcctttggaaagaactttgtaaaatttgttaaacttcctgtatggaatgaagtaccttattacacatttctactcttgttaaataactgggggaaatgtgttatatctaggcctcactttataaatatttgttgaacttattgaattcagacaaggaaggccagaggggtttgtgtgagctgttctctgccgtcggctgatatcgcatttgctttgataaataatattttaccttcccatttgggtaatgcctgccttaggttgagttcttcttaaagcagattcttagatgaagattcatacaagtggtttatttgtgaattgaaagaaatacatggggttatggggaaatgagacagggaagggaggccagttgctaaagtcaaaacaggtgcctctaagctagctgccacgggaagggaatgtagatgagtgtccatatgtcaatgccattggtcattagatgtttttgatgaggactgctccatgatggttcatttcctggctcttgcaggctgtcatgaaggtggcaaatgagtcttcagggacaggagagcaccctcaggaaaagaagccaagaagccaggggttggctttctcttggaagttaggcagtggttgatgaggtgatcaaggtgggagatatgagtggagaacaatcagcgtctgccagaatgacaaccatttttcacatcttccttaatattttaaaaaacagatatattctaagacttttcttataatgactagagagggttttaaaaagtggttttatatttgatggaacccttgttggtgctgcagttaaagagttacttcaaaatcctgcctcagcacaccctgttcctttttctttgcactccccgaagccaatgtttcagaagcaactgccgatcagcagaattcatctgtttctcccacagggctaatccctgaccgacctggaagccaagccaggctctaacctggcagactcactcttctcctgctcctcttttacgtaatcccatgcttattgattctctagaaaatctgttttccttttgctcaaagcagagtacaaagcaagaaactgcctcgcactctggagaaaacacatgaaatcacaagctaaccagtgactgtcattccataaaatagcagttctattaaagtgcattatgtaaaaatgggatttgtactagagttgttttataggaggttggtttatatcatcacctgtttcattgaaaatttggtcggtgatgagtcatccataaaactggcagaataaaacttcaggagtggctgttgtaaagttcttctaaggctcataaaaccgggttatgcgcttccacagttttgatattgctcaaacatttcatcaaaagaacgtgaatatcatcagtgctacattttaatttgatttttaggaactttcatttttaactttccttccatgacccctgatcttttatttgaaagtatgggaacacttgacccattgttcctcttcacattggatcagagaatacaaaagttaaactcttacacactgctatagataagagagagtttaaatgttagttatagaataagaaccttaacgcttttgtgattatataaaaataaaagctagcatttgctgaacatatgtactgtttcaaacattacattgacttatgactcactgtttacgttcattgcatcacatactctttatgacaatcctgtgaaatagttgctcttttcttaacttttatttcaggatcggggtacacatgcaggtttgttatacaggtaagttgcatgtcacaggggtttggtatacagatcatttcatcacctaggtaataaacatagtacccaatgggtcacttattattatccacacgtattaatacttagaagaaacctgaggcgcagggaaattaaataaccatttaaggtaagagtcaggaatcaaaccctagtttctctacacgaaagtatgctttaaaaaactctactgtgttatgaaataatatgtgcccatgtgaaagaaatatatagacaaaattaatctaggatggaaaatatcacagtggtggttgcctctgggtggggggattgagactgacctggagggagcatgagagaactttccagggtaattgaagcctcctatcttaaccagcacatagttatatatagattgtaagagtatatgcatttgtcaaaacatattcggtggtaacacttaagatcaatgtaatgttgttcccctcttaacttatggatactaggcttaatatatgggtgatgacataatctgtaaataaacctctataatacaggtttacctatgtaacacacctgcacgtatatccctgaacttaaaatacatgttttttaaaaagatcaatgtatggaccaaaggcaaattatacaggcacaccttcccaggtgtgctatcctcccacctctgtttttagtcatagaatctgaatggaagcagccactgccctcatcctgatccccaaaccacgtgagagttcaaacgttgtgcacaagacccagtccagccagtaagaatccttaccaagaacttttattaaaacattgccatcggccgggcgcggtggctcacgcctgtaatcccagcactttgggaggccgaggcgggcagatcacgaggtcaggagatggagaccatcctggctaacacggtgaaaccccgtctctactaaaaatacaaaaaattagccgggcgtggtggcgggcgcccgtagtcccagctactcgggaggctgaggcaggagaatggcgtgaacctgagaggcggagcttgcagtgagctgagatcgcgccactgcactccagcctgggtgacagagtgagactctgtctcaaaaacaaaaacaaaaacaaaaacaaacaaacaaaaaaaattgccatcaaggttaaaataaataaacgaaaaaataaaaatatatatatttcttttttttcccctgtggtgagaaatctgtaaggacatgagtactacttgctgacaaccaagtcctccacttttggagaaggtagtctaacacttcaaatgtggctaattcaactaatgaacttttatttaattttaattaatttaaatttaaatagccacacatggctagtagctaacacacggaatggcaaagctttgggagaatgagtcagatatccacagggtgtaagacataagtaataagaagaaagagccctgatggaactggatctctctggaagggcagctccacccctgcccttcttgtaatctggagatgtaagtgtattagtccattttcacgcattataaagacactatctgagactatataatttatagaggaaagagatttaatggactcacaggtccacatggttggggaggcctcaggaaacttaacaatcatggcagaaggcaaaagagacgccaggaccttcttcgcagggtgacaggaaagacagaaaagttcaggggaaattgccatttataagaccatcagatctcacgagaagtcactcactatcatgagaacagcatgatcataaatcacctcccaccaggtccctccctccacacgtggagattatggggattacaatttgagatgagatttgagtggagacatagccaaaccatatcagtaagctaatgaatacacatgccttcatctctgcaaatgattcccctccagaatattaccctttaaagttacgattaataacataaaaatctttataatgctgtttgtaaaaagcataaaatgcaaatgtgtgggctgaggtaacacttcactataactaagtttccatttatctaacaaataattagtagataaacccaaatggctaattattgtaaacttttccatcttcataaaaatggaagataatataaatagacgaacagcactagcaccttcagggcaccaagaagacaggaggctgaggcttggaaagaacaatcttcacaactttttctaggattggttgtgttaattttcaaaagtctcaggtaaatgagatgggtctggagcaatacctttgcatgatttatgtgattttttttacacttgaattacttcaaggagctttccaaagaatgttttaacatactgtgaccaataatgtcagagctgatggcagcatctgtgattatacttttgaattctggctggtagtgtcagatttgtagactgacattattatttttataatagaagttataagaacacaactctaaagattatggctcatagaattttagaggtggaagaggcccttagagaacatctagtacagccccttaattttacagatgaagaaacaaaagcccaggagaggcaaactgagttgccacaggtgatgacacctaattactgatcgagctgacactaaatccagttctcctaatccccaaagcttgctgtcagtgagccaatcccaatacatcataccattctgacttttgccttttcaaatgatgtcttaattaccgttgatatattttataattttgtaggagctgacaaatttgtcaggacaaaatttcatataatgtgatatattttgtgactttggcgtcaaggaatgcttgtataagatgtttgcccttcatgaaaatcttgaagtattggggaatgcatgctaaaaaaaaaaatcactagttttcaatgaaattttccagctaggtctaatatcaatgtatgcaaaattatcttaaaattgtctgtatttgccacctatatcatcatttacagtatgatagttgcaggaaggacacaagctcagatttgggtagaccaggttcaagtcagccacagcaacttcttaactgttcaggctttgtttgttcttgtgaaaaagagattaaaattgtactagtatagaaagcacctggtattatagtttgtcctatagagataataaatatatagtaaaacttaatgaattggattatacactagaacattttcacatttgaactaatagtgtgattgttatgtaataaatgtggttaataaaatattgatacagtataaaatatataatatctgattaatactaatataattctgttacacaaaaacttttaaaacgttatgaatgaaaaaaattagttataagcatttgagaagattttgcctgggatttggaattattggaaacctagtagatccatcttcttgcagacctagaatagaaacactttggaactgaaaagagaacaagagataaaattttgttgcactgctttctgttcaccttcctcctgacccttcaaatatttcatcccacccagtctgaggcctatgcccaaagtttgattatacattgttattagataatgtttgtgcctatcatcactgagaagtacttccagagtccagagtcgtcttcacttgcattataccacaggttggtccttaatccgtgtgagaatgaatctgcatgagttgaatcactccatttctgaatggaccctgcaggtcctcttcccacaaccatgaacaactttaggatattgtcacttttgtaacttttttctttcccacatcctcacaatatcctccctttgtgtccttcccaataatgctcacacatgattcaataactgcaacaatttatactgaaggctatatatgcaacaatatatactgcaacaatatatactgaaggatatactgaatttatacagaaggatatacgtataaatatacgtttaaatatacttttaaatatacttatatttaaacaatatatattgcaacaatagatactgaaggatatactgaatttatacagaaggatatacatatccactgcttcagatccttgtcttaaaccaatctggagatattcaaattattgataaccctccagacctggaatctgaagctgtagacctgaagattagcctgatatatttattttcccaatatttataatcaatcagataaagagtccgatattttctgggtaaaatcctaggtaaaatatcaaataaaattcactggaagtactcattatatagcagattactgaatgactaaaaaacctaatagagaattctgttgtgagagcacttctaacataaatttattttataatggcaaatttcattagaattcagaaaatgtaatgtctattcaggactgtttacttcttaacatattaaagacaaactatattttgctaggtgaacaagtatttttcttaagtcaatacaaaggattggaaaattaaattttcattgcattcaaggaaaagacaatgaggttcctatcatttatgtatcctcagtgcctagcatggtagcagcacatcactaattcacaagtgtttgtgaaaggaaggagggaggacaaaagagaaaaggaaggaagaaggtttgttacagcatgtcaagaaggtggaaatagaacttagattcaagactctggtttttgatttccctttgaaatacccattttttaaaaatgcttatgttacctagaagtggtaattactaagtcattcattctagcaagaaacatctgagctgctactatgtgcagacacctctggggatacaatacaggtgaaacacaagccactgccctccagatatccacaggctgacaagagaaaggatactttgtacatttctgtaaactgctatcaagaacatagtaatgtcctgtagcccaatgatggaaggaggctggaaaatggcaagagagcaaataaatttggagaataattgcttgagcaaaatttgaacacttaagagaaaatcaatggtcagatatgttaaaaagatggaattcctggtagagaggatggcaaatgaaaggattggggcatgaaactgtggtgaaatttccctaaacattcagttagtttggtatgactaaagcatagtgtgtgtgtgtgtgtgtgtgtgtgtgtgtgtgtgcgtgcacatgtatgtaggtatatgtgcatgtgtatgcatacatggatgtatagaacatagggtaggggtgggaaaaggtaaattttttttttttttttgagacggagtctcgcttgtcgcccaggctggagtgcagtggtgtgatctcagctcaatgcaagctctgcctcccaggttcatgccattcttctgcctcagcctcccaagtagctgggactacaggcgcccgccaccacgcccagctaatttttttatattttttttagtagagacggggttttaccatgttagccaggatggtctcgatctcctgacctcatgatccgcccgcctcggcctcccaaagtgctgggattacaggcatgagccaccgcacctggccaggaaaaggtaaattttttaagatgacagtgaggacacttggtcaagatgaaacaatagtaagatcagggactatgtatgatgcctatatgtgccaggcactgttgtaatcattttatacacactaacttattcaatgaacacatagacacaaacccacacacctttgagctatatcccattgtgatcatcctgaggtacacagaaagtgctttgttcttgtcacagagctaggaagcagcagaggcaagagttgaaactagccagtctgtagagactcgcatatttcatgccaagatgtttggacaagagaggaactgaagcatgctaataacgtgattaatatccctagattctgactaagtttgtggaagttatttataaggaggaaagctggagaaccaaggcaacaggtcttcttggggtcagatgcagtagctcaagatagcagaaagaggtcagtgaagagactttgatctagaacactgagacctggtcactagcttcagtaagagtggacatggggaggactcactgtcacccttctgtctagtttaggtgaatgagtgagaatgaggagtttgatttccttagtgaacctccataggaagtgtctggcacacagctggaatgcataagatacagctctggcaatcttgactctagacaaacatggagttactatcttcttaactggaataggtagaaatataggacaaataccactgtcaagcttcccgcttttcacttttatttgttattataatgtagctatggaagatatgcaaagaaggaaaataaagtaacctccacaccaaagtattattattaataaaaaataaacacctagctcttatcctaaagaggttattaccaagtggtgagaaatagttataaagtataataagtacatataagccttaaatttccaaacagatttgcataatttagcatagcttgtgggtaatgatgatgataaaatcactaaacatctgctaagcatttaaacaacattttccttccgttagcatcagttgctggaaaataacatactttggctcaaattgtcctgttaaaaatatagtttggggccagcagaattttattcatgcttttatatggagtctccacttttttctgtaaatgtatttatagccaaaagctttcaccagttaggaaatgcagcagatgccaataagtacattcattattttgattatggcaatgtcagactttcagaaaacttcctccatctctatctgtagcacaacctcacatagggagggaccatgtgctggtcaggaaataaacagctttctggcaggagttaaatgaaaatactgtttattactcttataagatgttataattgacggttttattgtaatacaatagcgattatgacatgttgtcccaaaccctaattttgttgttttgtagcaagttacgtttttatcaaggaacacagtggtttaaaaaaaaaaaaaacccaaaaaactaagatttggggccgggcgcgatggcttacacctgtaatcccagcactttgggaggccgaggcgggcggatcatgaggtcaggagattgagactatcctggctaacacggggaaaccccgtctctacaaaaaatacaaaaaaaaaaaaagtagtaataataaaagtagccgggcttggtggtgggcgcctgtagtcccagctactcaggaggctgaggcaggagaatggcgtgaacccgggaggcggagcttgcagtgagctgagatcgcgccactgcactccagcctgggtgacagagcgaaactccgtctcaaaaacaaacaaacaaacaacagcaacaaaaacgaagatttggataattcatgtgtcttttgttttgatctcagaatttcctcattaacagatgtgaaataatttaccaagtttttcttcaaattgactaggcctgtataaaataacagaaatgccctttgcagtgaaagcactttgtattagggattgatcactcaattacattctggatgagaagaaaaaaaaaatcctattggtgtttttatgtgattacatttagggagaaaaagtttggaaagctaagaatcttttgtgggaagacaaaaagaaagagcttttaaggggcactttgaatacagagagtgactttagatagctagcaatgctgtttaaaagttacatcatggctttaagcaaaatcaacagcagtgaaacaaactgaacaagcagaaaaaaatataactcgaaacactgatgagtagtagtttttgaaagtgaattcatccaataaactacatcaaataaaggcaaataaagacaatctaagcttcattcacaaagtacatagagaaaaatgcttgaaaatatatcacatccaggaagaattttttaaactgacaggtgaagttattttactatatataaattctttaaggtggcagatatcttgtcaaatgaccacccttacaggaggacagtcaacttgattctaattaataaacaaagttttagtggaaatcctagaacacgtagattcatgagactcagcattcaacttggaaacccgcagaaactgtgtatctaagccactctaaccaaatagaagaaaaccttctacatattatgtgccagggagacgttaggcattagcagtgcacagacagtcatggttcaggctttgacgctgatgacaactggtggaatgtgtgttatctaccctgttattgtactaacctatcctctatcctcatcacacagtatgagaactacagtagcttgtcttctgcctaaaatctcctaccacttccacagtcatttaatctgccagctcactgttatgctggtatttttaagaaataatttcatataattagtctctttctggatgaaacactgctaaggtgtttattactaacctaaattcagtccttttcagctctttcactctttgtaatccaattccattctttgcagccagtattcatttctgcttgttctgaaatctatcccatcacttaggatttggaaactagcagacatgaagattggctacaaagaatgtaactagatttttaaacagatttagctctaatcccatttcttagaacaattcccaacttgaaacaggaaatatctagatggtttcactgtccgattctgtggtgacccaacctcttagcactcagattctgcctcggccctactgagattactagtcttacccaacatacaacttccttccacatctaccaggttgaggaatgaagcaaattatgtgaaataggagaaatacttttagaggaagcttgagtattggtgtattgggataatttatatgggatggtaaagttagagggtagatgatggcacttcattacatctgcaaaattttaaaaaaaattatcctagggctaggcatggtggcttacacctctaatcctagcactttgggaggctgaggtgggaggatccgttgagcccaggagttcaagaccagcctgggctatatagtgagaccccaagtctacaaaaaatacaaaaattgaccaggcatggtggtgcacacttgtagacccaggtactctggaggctgaggtggaaaggattgcttgagcacaggaggttgagactgcagtgagtcaagatcatgtcactgcactccagcctgggagacagagtgagaccttgagactttgcatcagaaacaaaacaaaacaaaacaaataaacaaacaaacacgttctggaagtagtatgaatggtaggttgagagatgagggtaaattcaattgagaaagggatgcaaatgagaacataattattagtaatctaaaagagaaatggtgaggggaaatttttaattaagataaagtaaaataatggtgaaatcatgaatttttttattttgtatttcatttttaaaaatcataaccacatgtacacttcattactttaagaaatgttacttttgaaagaaaaaatagtcatatccattgactctcaaatattcttatgagttatttatactaaatgaatgaaaaaggcagagaatacaactatgtataaaatatgagcccaattttttaagacacacttatgtatagataggcatagagagacagatgggttaagagatattaagagaggaatgatgagagaatagaaaaaaactttaggggctgggtgtggtggctcacgcctgtattcccagctctttgggaggccaaggagggtggatcacttgaggtcaggacttcgagaccagcctgaacgatatagtaaaaccctgtctctactaaaaatacaaaattatctgggtgtggtggcatgcatctgtagtcccagctgctggggaggctgagacagcagaattgcttgaacccaggacgtggaggctgcagtgagctgagattgtgccactgcactccagcctgggcaacagagtgagactctgtctcaaacaaaaaaaaaaaaaaaaaaaaagaaaaagaaaaaaatctttaaggagatatgcataaatatttcattggttgactctagttattgacactataactgatttgcatcttctttcttgcactttcctaatttagaaaattcaattaatatttctttaataaagagaacattgagtgtatctaaaagtatgtcaattggtgagtaatgaaagaaagtgtcaataaaaataaccggaagagtgcagagaacaggtgtagaaatatcaaaaaggacaagctgacaaaagttttgattggtggttcagggataatagagagagggagaaggcaggcatccatgataatttacattttcagctgcatgttatgcatggctgttgatggaatcagcagtgcagaaggctcagcataaataaataggaggtgagaattgttccaagtgaaggagaggttggctgtgggaacattcggtctcaaagcagaggaatattttaacactgacatactttcaaattgctacccatggtaacagttaaaagcaacttcactgtatttggttttgttattattattataaacttccacttcctacaaagcatgcactccatctttgcacctgaaaggagttgttttcactgctgccctctaccttggttcatgactgggagaaaagagctgaaattctacaggattcattttgagagagagaattcaaagcactatagcgttatagctgcaaatatccaagcgatatttggggataagtgtgtgacactgaggagaaatagagtttgaagataatagtttaaatctttgtttagtagtaaacactttcattagtggcctaaacaccttgtttagtagtaaacactttcactagttgcctaaatgaaactctcaacagcataactttctagctgcataatttcggcaagtcccttaatctcactggacctcagtcttctcatatgttacataaagacgataacagtataaattctgtagagttgtataaaagttaaatgaatgaatagatgacaacagcttagaacatggctttagcagattgtaaatactatgtaaatattggatattttattttcagtatatgtatatattctttctacagagcaagctctttatgcattaatagtaatcttgctaaaaatccaaatctattcagaatgagtactacagaatttttcttatagaaatattaccaacattaactcctctcttagataaatgtgattcacatttcatctctttatgcaatttccttattgttttatcattttcctattgctctattctataaataatgaatacagcattttaatgattcttgtaaatagagaccacattttttaaccattgagcatacggacaaattttattcataatattttatttctttcattgtacttgagattaatagcacaatttctcatccacaaagtttattataggttgtaaaaatgaacatgatctctcttctgattggctcagaaaagaagtttaatcttatgtaattatctttcgaatcacacatgcatcagtacaatcaagctctctatctattagatcactgaaccgtttcacatgagtttacagattaatattcatataaaactatatatctttcagcatatctcctcttggtaggttttcttaaagaaaaacaaaaaagagtagcaaattggaaccttggatatggaagaactgcttaaaaaatattcaatgaattgccatcgggtcactttttccccttataaataaaaagttggggtataaaagcagaaatatcattataaaagaactggaatgtcagaaaacactaagaacattctgtttcagtggtatacaaacttgtttgtccttttaagccatgaaactttttctttaaacaaaatttcttcaaaggtctaattcttaaaatagataaactactgtgaagggcagatgctacgaggacaccccatgacccaactcccaaagcctttctttgtaatctctctgctccaggtagtggtttgaataaggacggcctaatccaaacattgccttttagagagaccttgagaagcagtgatgtagcctaggttacaaggtaatccagtaaaatgtatccatgagttccatgcgctgacagagaatgcattgttacattaattttttttttatatcatcccaactatggaaacttcagttgccaaatgctactgctacataatgtattcatcttttggtagtaaacttctctgctccagtttatttttcagcctatgaagttttttgttttttttttcttattaaaaaaatctcaatttagaaataaaaatgagacaagcacagtcaaaatttaaattagcttggtttcagttcctattattaaagagatttttaaaatatcctacttttgaacatctttgctgccatccttcatttctctcacaagggaaatataattcagcagagtcaatcgtgactgttttgaatatggtttactaaattcacaaacaaaaagtgtctctgatagtcaacacaaatatataaacaagcattgagtaaacggcaagaaggataaaaggcatttttccaaatgaagacttccattgaaaagaagaaattcaatgaaccttccttaaaacatatgaaacattctattgaattttgatctaataaaaaattgtattaaatttgctgtattagaactgttacacacttgagatcaaaaaagaaaacaaaaaatgccctaactataggtagggacattgtaggactaatggaagtgagtatataagtccacttggcaccagagatttttttctaatgtggaagtgtcaaaagaattctgctccacttcaaagcagtgcctggcaggaacaggaaagcataaatgtcactgaacaaacttagagacaagcacttccttcactgaagagaaacctgatatctttctagaaattctagtatgctgatacaaaatgctagacactatctaatttcattcctccatattaatcagcaccttaatgtatgttgcagtttatagacagtaaatatactttaatattttctttctttgcatgggtaaagaataaagaatgcaagtcaatagaaaagaaaaattttaaaataattgtagtaattggctataactggtgagtatagcttggctttggagtgatgtagccctatctttgaatgctggctccactatttgttatctatagaaatagacaggtcatagaaagcatttcccatctggcaatgtacttgtgaagattaattaaaagttaatctattggccgggcacggtggctcatgcctgtaatcccaacactttgggaggccgaggcaggtggaccgcttgagtcaggagtttgagaccagcctggccagcatggtgaaaccctgtctctactaacaatacaaaaaatagccaaccatggtggcaggtgcctgtaatcccagctatttgggaggctgaggcatgagaattgcttgaactcaggaggcagaggttgcagtgagctgagatcgtgccactgcactccaacctgggcaacagagcgagactttgtctcaaaataaataaataaataaataaataaaaagttaatatatttaatatagcttgaagaacctagaataatacctggaaccttataagcattcattaattggcagctagtgagtcctttaagctctatgattgcaggaaatatacattcactaggattacctcaagtaatggggaaatgtttttggaaaatagatatggatcaagtaagttaggagttctgaccctgcaacatggaaatagggcacacccaggtcccagttcagaaacaaggtaaagctatagtggtactcttggccacatctccttagtaagacgcaggagtgaacctgttttccttcagtattgtgactagctctactctacttctgcatcaatcagtcctgttcgcagcaactagtcacctcctcctttgtttaatgttcatcatctttaaacatcgacctgcttatagtatccacttactcccatgtctgctgacttatagaaaagcaaggtacaggtatgtgaatgtagaatgagcataaaatataattaaattaaagcgtaatcagcagaaactctgtgcttttgcatagtaatcctaccagtgaatgattctttctttgtatcctattttgacccatcaagacaaattttattggtctaattaataactaagatcccttctgagcaaagctcttctgtgagactacatacagaccagtctataattgctctgatgaagtgcatccgggaatagggtgaggattggtttctcgtggcacctatcgcagccatttatcctggaagaattccctggaaaggaactgcacatgtggcacacacttttagacttagcatttctatacttctcttgtccatttgtgcagaaaggtggagagataattcagaaagagagctagtttaaagctagaataaaccatgcaaacacattttttttctaatttttgcaaattttctccaatatcctgaaggttaaacagaggttattctgttctgttttctatacccatgctaaggttcaagaaactataaaagaggctggctgactatctctcaaaaggcttcctaggagaggttttccatggccctgggtctggacttcacctagaaggatttaaatctgagttgattaacaagatgatatccttcatggaaaaactcacaggggcaaagctcaaaataagcttgttatgtatataaaaaagacaatttatcaatttagaaaagatgccctgaatgcctgtatgtgtatgtgtgtttgtgtaattttatatattaaataatatataattttaattgacagataaattgcatgtatttatcagcctatatttttcatgacatagtttttcctctggaaaaggtaagtagaaatctaaattaaaagctgtatattgctcaatgaatttgaaattgagaaatgtgtgtagttcaaatattttgtctagctacctatagggatatgcttggcctaaaaaaatctttgagccagagattctcctcatttggagtgagactaggtatcctccatattagcctataagaatctattgtttttttggtttctgctgtggaacacttctcctgttgggacattctgcattatttatattagtacatcaaatcaaggtatagacttgtttgaaaactattctatctctctaataaccctatacacttattcattcattcattcaaaaacttacttactctgcacttattatgtgcctgacaccttaggcacataataagtgacaaaaacaatgtcaaagacattgacatttgacgttgacaaaaacaatgtcaaagacattgacatttgacgttgacaaaaacaatgtcaaagacattgggggatacaagagtgaatatggaaagcaatgtctttttcttacttggcccttaggctccagttaaggtagagagacaaaaacccatttaattattccatctctcactctattgcataatctcaatctattggaatgtaatccgtttagggattatatgttatagaacataatctacatgttagagtatacaatcccaattgatcctgcaaacatttctagaaaaaatcctatcaaatgagtaataaagtgttctaagcactaactagaaatgtattcaggtgaaaaagaaaaatccaaaaaaaagtgtttttttttattatggtttacttgagaatagaacttaagataggaacatttatcacagatttgactcttccataaaggattgatcaaagagcttaattctcagaaggtaacttaattcaccttgcgatgaggtcaacatgactatttacctcataagcaacttgaattttcatagtataattagccagtggtttttcaagtctaaagaacagcctttgccatgctaaaacatgatgaagcagtgactcactacagaagacaagccttttcagaatatactctgtgactcttttttttttattattatactttaagttttagggtacatgtgcacaatgtgcacgttagttacatatgtatacatgtgccatgctagtgtgctgcacccattaactcgtcatttagcattaggtatatctcctaaagctatccctcccccttccccccacaccacaacagtccccagagtgtgatgttccccttcctgtgtccatgtgttctcattgttcaattcccacctatgagtgagaatatgcggtgtttggttttttgttcttgcgatagtttactgagaatgatgatttccaatttcatccatgtccctacaaagcacaggaactcatcattttttatggctgcatagtattccatggtgtatatgtgccacattttcttcatccagtctatcattgttggacatttgggttggttccaagtctttgctattgtgaatagtgctgcaataaacatacgtgtgcatgtgtctttatagcagcatgatttatagtcctttgggaatatacccagtaatgggatggctgggtcaaatggtatttctagttctagatccctgaggaatcgccacactgacttccacaagggttgaactagtttacagtcccaccaacagtgtaaaagtgttcctatttctccacatcttctccagcacctgttgtttcctgactttttaatgattgccattctaactggtgtgagatggtatctcattgtggttttgatttgcatttctctgatggccagtgatggtgagcattttctcatgtgttttttggctgcataaatatcttcttttgagaagtatctgttcatgtccttcgcccactttttgatggggttgtttttttcttgtaaatttgtttgagttcattgtatattctggatattagccctttgtcagatgagtaggttgcaaaaattttctcccattgtgtaggttgcctgttcactctgatggtagtttgttttgctgtgcagaagctttttagtttaattagatcccatttgtcaattttggcttttgttgccattgcttttggtgttttagacatgaagtccttgcccatgcctgtgtcctgaatggtaatgcctaggttttcttctagggtttttatggttttaggtctaacgtttaagtctttaatccatcttgaattaatttttgtataaggtgtaaggaagggatccagtttcagctttctacatatggctagccagttttcccagcaccatttattaaatagggaatcctttccccattatctttgaactgaaaattcacatcttaatttgcacagagtattctgaaatatcaaatgtatacctatattggaaactttaccaggtagcactgccacattcagtttttacataagaaactgagcattttagcatatgagttgggaagtcaattgtcctgcttgatttcctatttggcatgtctgtgataatattgaaattgcttaatgattttatttattccttggagaggtggatccgtacacaataagcatttgcaaacacctgggacaaagtatggacctctgtcagcatagtctgtttataggcctaggaaagtatgaacagagagttgagaaggaagaggcaaaggcatgttattttactgagacacaatgaaatggctgtacatagaaaatacatcttaagatatcagagataaaagctataaaaggggcaggaagaacaaaatgtaaaaattagatagtttcacttatttttcctttctacatccttttttttttttaattgggaatcttagattggtgggttttgggggagggtggagttccttttctgaggtcctttattttctgcttgagtgcctgaaaatagatgcaagacagagaatgtctccactgactctcacggtggctgtttattcagagtgcagccttcatttggctctcctggaagctggctgtgagacaaggaatccaggccaagttctttatttggcagggaagtggagatgtagatagaaaagaaaaggcaactaataacacattatcaagtcagttaccagtacaggtagctgtagcttaatcccactgggaaactgagaacccttagaaaagtttgccatcagcatcatcttctctggggcataagggatctggggttcttataccccttttccccaagtggtcatgatctctcttgtacttccagcctgtggtgttttcaggtgcacaggccgtggctgcgtgagaaaactctcagcccgttggaagtcaggagtgcaccacagtgaaaagggctatgggggcagagatggatagagcatgacagttctgctgtaagtggcccaagttgaagggagctgttctcccgtctgcctttttgccttcttataaaaaccaaattagcaaagacattgatacatagacttgtcttataaccaattatggacttatattaattacccatcaatattctctgatccatagtacatatggaaatgtgtgtgtgtgtgtgtgtgtgtgtgtgcgcgcgtatttgtaaaatgccattatccctggtattctatattagcctaagcttaaaattcagtccttgtactgttactttttactgtacatctgtgacaaaattaatactgccatatgatgggtgcctaacaccacccactgcttttaaattatattctcattttttgttattcaatgatggttcaactatttcaccaagaattaaatagaagtaagagtcaaaatgaccaggatattttctctaataccgctgtgtactattaaaaaaataattaagatttctttattcatatcaattatgagttgatgcactgaatgatgtaatatttattcatgttaacagtggaaaatgtgagtgggaacagctttcatatggaatgcttttcttgtactttagaagtaaataaataattaaataaataagagttctaatttatgggaaaattgtcttatatgagttgattttctaagcctttgttttaccagcctgaaagaggaatgctacacagtcatattttaatggctttgtttattcttttagaaaaagtatcaacatgacatcatctgaggctaggttgtgctgcatactaataaaaacctgagaaatgtatgtttgacttctgatgtaaaggttttctttttaatatagacttaataacaatttcatacttaaccgatgagagcagcaaattaatcaaacaaatcgaacattttcttctccagggaactggggaagcttctgatcccttgatatgattatatctatatatcaaattccatactaatgacccccaagagagatggctttatcaataagattgtaagttattaattaattaattagtctcctggaaattctactgtgtgattttctgtttttacctcacaggagggagttctgagttaccttgcttcttcagagggttagatttttcatgtttcagggttgaacaatgaggtgtaggcaagagctcaagatagcatttgaggggcttcgtttctgtattttagactattaagctaacttctataaagggaaagtactaacgttgatatttagagaaaaacacggggggagctaaaacaagacagagaaagacaatttgatgcccttaggatggggtgatgacaacaggtttgttccaacatagcagccatccacatagctgtaccagaagcaggaccttggcagggaagttctgtggccttgtgtgactttaaccctgggaacccggcaaagatttctgtaggcagagttgatacaaaagggaatgttctcaaagtagccaccactttaaatgaataaatagcacctcagtagaagaccactggccagtgttctgtccaaattcacacatggaggcaaaggtagccatacaaagtgatgaatactgagtttcttgctaatttcattgaatgggtagcttgaaacaattactttgatttagaaaaaataatgagatctgacatactttgcattgcgtcttcagtttttctgatcaatccgtaagttacatgatcttcacatacaaactaagaccattcacataaaagagagaaaaggagtaattatttttgctttcttagcaagtgcctagaatagcattttccggtgcatgcactggggacaatcagggccataaatttctgatatgaaatacatttaagaaataccaatatgagggcaatggaaatttccggtgcaagcactggggacaatcagggccataaatttctgatatgaaatacatttaagaaataccaatatgagggcaatggaaatttctttggtaatttgcaaaacatattaacatattaaaggttctgaagtaacccttgttactagtttaactttctttaacccagaattgcccaaacttacttgagcataaaagtgttttaacacttctgagaaatatcctttcagataccagatggctagataaaaataaatagttgttctacattgtaatagcatctattacagtttcaaatctaaatatctgtctttgttccaaaagcaagcttatgtatatgattgtttttattttctatgtagactcacaaaaggagagacatagaaaatttaactctacactatcattcccccagattcaactctggcatgataaagatcctagagtgtattacaaagaggtcacccttataatatggtaaatgcatatcttctgctataaatattttcataaagctcttctcttagtcaaggattgagagtacaactggccgtctttaggaaataggaatcaggaacgaatggttgttgctcaaaagcataacatttaagtgggttaacagagcacttatatgaatgagcaagaagataattgtgctattacacacagttttacgaccattaaaatacctgttctaatttggcatcagatacgtgagcacaatgtgaagagcctgaggttggaatgagagcaggaaaaatgtccgaagtttggacagggagcaaagaaattgagaaaattatagaattgaagagaaaaccatggtgaggcacaaaaaagctgtataattatatgaatgatattaggtggttggcaataagcaattattaatattttcttttatgagtgaggaaaaaaaaagtatggtcataacagagggaatgcaattcgagcataagaagaaacacgagagtattatgctgtagtagtccagtctcactctgctatgaagaaatacctatgactgggtaattcatacaggaaagaggcaaaactgactcacagttgagcatggctggggaggcctcaggaaacttgcaatcatggcggaaggcaaaggggaggcaaggcaccttcttcacaaggcggcaggaagaagtgaatgcaggaggaactaccaaacacaaaaccatcagatcttgtgagaactcactcactatcacaagaacagcatgggggaaaccacgcccatgattcaattacctccacctggtctctcccttgacaggtgaggattgtggggattacaattcaagatgagattttgggtggggacacagccaaactatatcacatgctaaagcagccaataatatctctaggaaaatgttgtagtttagggtagatatgtgtttggaacaatttagattcaaaactcacagaattgtgagtagcaacaatgattactcttaaattagtaatgctggaatataggtaattttaattgtgtgttctattctgtggtgccagtggcattttcccccctgatgttatttttctgcagctccggctttgtacataaatggataatagtgctccttggtgatctattttcaagtcaaaattctttcttattttctgctgaggtttagcattccgtggataaaaagcaaagtttttcattccacagcaaaatataatggttaaaataccaacagctttacaggaaagaggaccagcctaataaccctgaaatagtcgcagttagtgaacccttaggcacagttttctcagtaaaaaaataatgtgatagttgataggataacctggagaatcccactaagtgctgatgtatagacactgtttcaatcttctcacattcatctgacttccctccagcctacctcagtgctgtgttatcctgtgtatggacagattgcatgtcagattcctaattttcaaatcaattttcaaattaataatttaataataatgtcttatacttatgtatatttcaaatcaaccctggtaaatctgatacttgtgttttatagtcaaagttgagcattttatgaatgcaccttgtaaatatcacatatcaggcaagcactagaaaaccaaatcacaaactgaaccaggttatcttccaacatttgccaaaatgagatgcaacacatctgagggaaatatgtattaatctttcttgtaagttatctgaattggtttaatggaaataaaattttaaaaactaaaatatattataaattctcatggatctgtctacattggtttataatttattttttcattagatttataaaggggcaatgtaaaaattaacatcagaatatcttatataacccattttatccattgtaataaagtttattgaacacctgctatgtataacttttgttttatttccttttaaataatagaaactgtattaactattgggtttcacattttcctttggcttccatgaagctcctgcctaaattttttgctcaggcacagaaatgaatttatctaggttaactggataacagtgcatcgacctctattttacttatagtagaattttatctacatattatttcctgttctgttttatatacctttagcagtgtaagctaccttaagcctttgcagaaatcaaatgaactataagtcatatatgaataaataaatgctaggtctaatatagaaaaattaataccttgaaataaaggtttattgagtcttttttcagagaagaagcattcctctaatgaaaaatattaatcagaaccatatttgctaattaataatttaatgataatgtcttatgcttatgtacattaaatatatttatatataaatgataataataatgcctcacacttatgtacattaaatgcatataatatataattatatatctatattatcacttctcacagtgaccttaggaggtagacattttttctcaaattaagtgtgaaaaattagaattcacaaattccaggatttgaactaaagacaactaattctacataaagtggttcatctgtaaaatttagtgtttagaactaatgtttgctatttgcatagggctgcagtatgaaagagtgttgggaaatgtcattagcccgttcttgctttgctataaatatctgagactgtgtaatttataaagaaaataggtttaattggctcatggctctgcacgctgtacaagtacggtgctggcatctgctcagcttctggggaggcctcagggagcttttactcatggcagaaggcaaagcaggagcttgaacatcacatggaaagagtaagagtaagggagaatgtggtgggggagtgccacacttttaaacaaccagatctcatgagagttcactcagtattgccaagatagcaccaagcgggtaatgctaaacattcatgagaaaactacccacatgatccactcagctcccatcaggccccacctccaatactggggatgacaattcaacatgagatttaggcagtgacacatatccaaactacatcaggaggtaaggcatttagatatatgtgtagacttcaaacctccttgctgtctcttcagtcctctaaaatgaggtgtgtctaaagaaacaaaagctttcatacagacctgtaccctagtggagatactgagtcatgttgacaaggattaaactagtctatataggccatcacataaaaataagctttatttagccagacaacagtaaccattgtgttcacaagaacacatacatacaagcatggctgtttgctcatagtaaaattttctttcctctagccatcaaattatcttgaaaatttgctgaactcttcactgtactaacttaaaaagaccatgcaagacttataataactcattgcatgaagatgcctaagtcattaatgtgacattttttttagaaagacagccttccacaaatctatttctaaatattagaggaaattgtgaaatatggttcagatatgatagagaatcatagcccatagttttttcctggtgtaataagacttgtaacattttcaagaaatcaagtttaaagtcaatccataactctaagaagaatcctacagcctccctaaaatttgaaattatatatatacctatacacacacacacacaaacacacacgcacacacacaaacatatatatatgaaaagactctattaagataaaaatactacctagaagcctaatggggaaaatatggttaagtttgctcacactgaattggaacaaaataggattgaaattttattccaccatttaaaaagcatatgacttgggaaaattacataacttcttcacatgtcaatttcttgagctataaaaagagttcaataatataatttatctcatgaggttgttgtgaggattaattgtgataaggcatgtgaaatgtttcactcattgtttttgtaagtattgagtaaaatcactgaactggtgataaaataccaggtataaaactgacaatctatccaaattgatttttgtcttaacacattcagggcagaagaaaatgagaaaaaataaaacaggccgggcgccgtggctcacacctgtaatcccagcactttgggaggctgaggcgggctgatcaagaggtcaggagttctagaccagcctggccaacatggtgaaaccccgtctctactaaaatacaaaaatattagccagacgtggtggcttgtgcctgtagtcccagctactcgggaggctaaggcaggggaatcgcttgaacccaggaggcagaggttgcagtgagccgagattgtgccactgcactccagcctggcaacagagtgagactctgtctcaaaaaaaaaaaaggagagaaaaagaaaaaacaaaaccaaaccctaaaaacatggatacccaaatagagtaaattaagaatctagagacattagttatctgaaaactattcagaaactctgcacaaacttttgatattggattgattaactttgataatgaccttatttttggagtaaagtgaacacaaatatcagtgtattagcccatcctaaaatattatttcataaaaaattaattcatcataaaataacactacatatcaccctgctttcattttcttaactacattatagaatgatagcacatttagaagatgatgtcatctttcaattaataaagatagttgtgcctcttagagaaaggtaataatttcaagaagctggatgagctgcaaatctacacaaatatttttaagaacatatatctatttaacaattttgtgctctctcaattttatttttgctgtttttagacatatggatgtttctatttttgaaattctttcttgtttttgtttgtgatttctgttttttagtcttcctccaccaaagctgtttagtaatctagtttttttccatttcattatttgattagttatatttgattattaatctatcaaaaattacttcttcagttgtgcaacgtggcgatcaaaattgattctcaagtaaatacctcaggttcctagtaccaattattgtctcatcttaatatttattccttagtttattatttctcctttatttatattaattatttatgtattgtacaatataactcctacatatataacaggttatatttttgcattgccatttctggttgattggtctgtctattcgtaggttaataccagaccattttattgattttattcttacatttccagatcttctcttttgggcaatactttctgatttgaaaggaagtagtgaaaaagttttacaaaacagagaggaggaacatgtgttgatcagtcacatggtttgtaaagcaaaatattggggtttgttgtatagtgtttacttattttaaatattaattttttctattcaaagaaaatatttaatggtgaaaatcatgaattttggatatagatgtgggttcgaatttgaactttgtaacttaatggttttttaatctctggtaaaatccattaaattctttcaagctccttcctctctgaatgggattattaatatgaatctcatcagtttagaatgagtcctaagtgagattacagaggaataaataaagcacagcttacttgtgattgtaagttcctgtcttcttatattaataagaaaaataaaacgaaatagtgctaaagtgttgggacagcgaaaatttttggagatggtatggagagataatgggcgatgtttctcagggctgcttcgagcgggattaggggcggtgtgggaacctagagtgggagagattaagctgaaggaagattttgtggtaaggggtgatattgtggggttgttagaaggaacatttgtaatttagaattattggtgatggcctggatacggttttgtatgaattgaaaaactaaatggaataagagaaggagaaaaacaggtataaaaggtctaagaattgggacgactcaggacatctgattagagagtgcctaaggaggttcagcatagtcctgccagcaaagattatttatttacttcaagagttaagagtggcagtttggggatagcaccaggaggtatcagctttgatgacttggagaaacagtgtaaaccggcagtgtaaacaagagcagggcatgcatgagtagttgagaacggtgaataggagtatgactagacacaagatagtaggaatgacaagttttttgggggcacagtctaagttgatctggtgtctggaatgagactggggcctaataaaaaggagcgtctatacaggagctcaaatggcctgtaccttgtagcattctgaggacaggtctgacttctgagaagggtaagtggtaaaagtattgtccagtcctttttaagttggtggctgagcttggtgaggtgtgtttttaaaagacctttagtccattctacttttcctgaagacggaggaccataaaggatataaaggtttcactgaatactaagagcctgaaaaactgcttggctgatttgactaataaaggctggtctgttatcagactgtatagaggtgggaaggctaaactgaggagttatgtctgacagaagggaagaaatgactgcggtggccttctcagaccctgtaggaaaggactctacctatccagtgaaagtgtctacctaggctaagaggtattttagttatctgactcggggcatgttgagtaaagctaatttgccagtcctgggtgggggcaaatcctcgagcttgatgtgtagggaagggagggggcctgaataatccctgaggagtagtagaatagcagatggaacactgagaagttatttccttgaggatagatttccatgatggaaaggaaatgagagcttctaagaggcgggctagtggcttgtactatagcatagcctgcctttgcttgtgtgtggcgattaggcctggtggaactgccatcaataaatcaagcgtgatcagggtgaggaacaggaaagaaggaaatatggggaaatggggtgaatgtcaggtggatcagagagatacagtcatgggggtcaggtgtggtatcaggaataatgtgggaggccagattgaagtccgggccaggaacaatggtaattgtgggacttaacaaagagtgagtacagctgaaggagccagggagcagaaagtatatgcgtcagctatgaggaagaaaatagattttggaagttatgagaaatgtagagagtaagttgagcatagtttgtgattttgagggcctctaaaagtattagggcggcagcagccgctgcacgcagacatgacggctaggctaaaacagtaagatccagttgtttgcgcagaaaggctacagggtgcagtcctggctcttgtgtaagaattctgaccacactaaccatgcctaggaaggaaaggagttgttgttttgtaagggattgaggtttgggagattaatcggatacgatcagcaaggaaagcacgtgtgtttttatgagaattatgccgagataggtaacagatgaggatgaagtttgggcttgactgaagtaatgggggctgtctgtgaagccttgcggcagtacagcccaggtaatttgctgagcctaatgggtatcagggtcagtccaagtgaaagcgaagagaggctgggatgacgggtgcaaaggaatagtaaagaaagcatgtttgagatccagaacagaataatggattgtggagggaggtattgaggataggagagaggatagggtttggcaccatgaggtggataggcaaaacaatttggttgataaggcatagatcctgaactaacttgtaaggcttgtctggttttaggacaggtaaaatgggggaattgtaaggagagtttataggctttaaaaggccatgctgtagcaggcaagtgatagcaggctttaatcctttcaaagcatgctatgggatgtgatattggcattgagtggggtaagggtgattaggttttaatgagatggtaaggggtgcatgatcggtcgccaaggagggagtagaagtatcttatacttgtgggttaaggtggggtaatacaagaggaggacgcaaaggaggctttggattgggaagaagggcagcaatgagatgtagctgtaatccaggaatagtcagggaagcagacaatttagttaaagtgtctcggcctaataagggaactgggcaggtggggataactaaaaggagtgcttaaaagagtattgtctaagttggcatgagagtgggggttttaagaggtttagaagcctggccgtcaatacccacaacagttatggaggcaagggaaacaggcccttgaaaagaaggtaatgtggagtgggtagcctcagtattgattaagaaggggacagacttaccctccactgtgagagttacccgaagctcggcgtccctgatggtctagggggcttccgaggcgatccgacagcatcagtcttcagccgctaagccaagaagatctgggaaggagtcagagagccttcggccagagttccaggggctctgggagtggctgccaggtgagttggacagtccgatttctagtggtgtcctgcacagatgggactcggcttaggaggaatcctgggctgcaggcattccttggcctggtggccagatttctggcacttgtagcaagctcctgggggaggaggttctggaggaacgcctggtcgctgcgtttcagatgtttggaagttcttgtgtgctggagatgtggctggggtttgtctcacagtggaggcaaggaattgcaacttttttctattattgtacacgttgaaggcgaggttaattaaatcctgttgtggggtttgagggccagaatttaatttttggagttgtatttaatgtcgggagcagactgggtaataaaatgtattttgagaataagacggccttttgacctttcagggtctagggctgtaaagtgtctcagggttgctgccaaacgagccatgaactgggctggatttttcatatttgatgaaagagcctaaacgcacactgatttgggagaggtctgataaggaaaaaggagcattaaccttgactatgcctttagcttcagccacctttttaagagtaaattgctgagcaggtgccggagggctagaggtggaacgaaactgtaagccggaccgggtgtgaggaggggaggtgataaaaggattatagggtggaggagtggaggctgaggaagaattgggacctagctcagcctggccaggaggggagaggtagaaaaggaagattagaaagactcagcgaagcttggggttgggactgaggggacaggtgggagggaaagaaggaagatttgggatgagttacattgggaacagagactagagatgcactgacatgtaaaagagtgcctggacatcaggcacctcagaccatttgcccattttacgacaataattatttagatcttgcaggatggaaaaattgaaagtgccattttctggctatttggaactactgtcgagtttgtattggggtcaagtggcattgcagaagaaaataagacgcttagattttaggtcaggtgagaggtgaagaggttttaagttcttaataacacaggctaaaggagaagaaggaggaatggagggtggatggttgcccatagtgaaggaggctagcccagagaaaagagtagagacacggagaagggttgggggttcttgccctccagaaaagcagagaaggggttggggcacagagatacgaggtcagggcacggaaataagggatcggggtgcagagatataagaggttggggcacggaaataagggatcggggcacagagatataagaggctggggcacggaaataagggatcggggcacagagatataagaggctggggcatggaaataaggggtcggggcacagagatataagaggctggggcacggaaataagggatcagggcgcagagatataagaggtccgggtgcggaaataagggatcgaggcgcagagatatgaggttggagtatttgcccctcctctagaaaagcaggacttgccgctcagggtgaaggagaaggggttgggggtttcttgccccccagaaaggcggagaagacacggagagaaggggttggggtacttgccctttccccagaaaagtgggacttgccgctaagggtgaaggaccaaggcaggcatccctgcgtggtctgacacctctgaaacctgggtgaataatcagggacgcatccctggaatgattaaacaccaggggaaggctgccttccctagtccatgaccagcgccggagttttgggtccagggataaaacgtgtctcctttgtctctaccagaaaatgaaaggaattgaaattaaaagaagggagagattgacgtgtggcgccaagattgaaaggagaaagaggttgagggatggtgagggaggttggagaagagagtaaaaaggggctgcttaccggattttaaattggtgagatgtttactgggctggtcggtctgaggacctgaggtcgtacgtggatctttctcacgagcaaagaacaggaggacaggggattgatctcccaagggaagtcccctgatccgagtcacggcaccaaatttcatgcgcctccgtgtgaagagaccaccaaacaggctttgtgtgagcaataaaagcttttaatcacctgggtgcaggcaggctgagtccgaaaagagagtcagtgaagggagaaaggggtggggccgttttacaggatttgggtaggtaaaggaaaattacagtcaaagggagggttgttccctggcggtcagagtgggggtcacaaggtactcagtgggggagcttttgagccaggatgagccaggagaaggaatttcacaaaacaatgtcatcagttaaggcaggaacaggccattttcacttcttttgtggtggaatgtcatcagttaaggcaggaaccggccatctggatgtgtacgtgcaggtcacaggggatatgatggcttagcttgggctcagaggcctgacagtaagtgttcagtaaatgtaattagtataattattaaaatattcatgattattattcctttaaaatattctagaaatcttcatgttatctaatctggaaaagaatttttctagctccattgctaaaaaaattcttcaaattcaaatttatttctgtatctcttaatagaaatgaggaaacgtatttcctcttcctgtaatagtagtctcagaacacgtgactgtcacttgtgtgtctctgtgagtgactgtgtggaaagaacttatctgactcactcacttctctgtgccttggctttgggtatatggctgcaagtctctgctaattactcctatgccactttcagcacaaatatcacttattatgtgctgcttgaatattattttctttatttctaagtttggtccattcagtcctctcatggcatgagttgcttttcttatttccacataagtatttgaaaacttgtcagaatgctattttcattagacacttttcattattacgctgtcatcactgaacaagtttatttcaaagccttttgagaaaaatgacagaaaacatagcattttatttccttggccgttcattagattagaaatgtcaagaaagacttagattatacttatttttattaaaaggaatgagagacttttcttgaaaaaaagaaaaaaagaaatttaaattttgaatgctacgtcttagggctctatgcagtgaaacattttctcttcattgtttagaaagacttacattttattttaaaattcctgcccgtctttttctcttgaagagataagatactctaatcattctagaacaccagctattaatctgaaattaaatctattacgtgccagaaacaaattaccccaaagttaacctaaaatatcatcagggtaacaccttcagttacaaattatagtaacatcttagataataaatttcagcagctattaaaagagagatgataatagtacctttgtctgaggcttcttatgataattgactttaaatatgtagagcatctaatactgcatgtgaggctgaattctatgaaattactaatactgaagcatttttggcctacagaaggaacggtttcatgtggttcaaccgaagtgttgctcgttaattttgagtttcccattcaccactgcactgacctttagccaggacagtacttactaattataatttaaaggtcgcatggatagagagcaaggcagacttgttacgacaaacctgtgtcttgtctatcttggtatggtggtgcctcagttagcacagggctttcactctcttactatggccagcttcacagtctctgtgacccttcaacctgtcccatgacttctgcttacccgtggccatggtgtctactgatggcatcactatgctcactgccttcacccatatgattctcatatgtgtaatttactagccagtatccagcaaggcctgctgtgtatgggagctggtgccatagaaagtgtggatgaggttatgtgtaggtatctctgctggtggtgggttgatgataaccatatttgacgcccttaaatttctaaaattaggagtcattgtattcattctagattgaggaggatagcatttaaatggggcttaagtatgccttgtaagtatgtaaaaagatataaaattaccatgcatactgtctttcaataacataacaagactgtagtttagtgagctcaaggtgacaaaatagccattattttcttactgtgagagtcattttgtttattgtttgcatgagtgacaatttttccaatgaaactttcttggttaatagaccctttcttatacataaatatgaaataagagggtgatagaaatcagatattatatctagtttttatgactagcagattacacagaataaaaacatcacaatgacacaaaacataatcttacacattagacaaaggcatacaactttaaaaaatattgcaatcaaaaagatgtaattaaattaccctgattcattgaaactttagcttttaaaaggttcatttttgtgggtataaataaattttgttatcttaattttatacaagttacaattatattattgttaatgacagataccaaatttaataatgtcaccttgttttatgttttataaaatttgcttcatttttccacctaagcagatatgctgtcaaaatgtggtgttacctgaaattttaaaatgcatctcttttccttgtgtaattttataataaaatagttaagaatgaagaattataaaaaagttaagaattttattttgaagactgatattctaagttgcatatagcaaagaagttacgaacttttatagtcaaggacctcataacacatgatagatgctaattttaattaaatttattatttcaactttgaaaaatggggtaggaggagagtatgaatcagaggatgaagtaactcacaatttaggctataggggccacatttttctaacttaatattccatgattatttccaaaggttacttaaatccaatatatgactcagagcttcagacttaacgtcatacattttcacataggttttaatttgtggagaaaggacatattctgatattattatagaaaagccattggattctatggtgtgataataagagatttcaggtctgggtcttctttatcagtcagcttttgtattgcaataacctacaatctcaattctcaaaggcttagagcaagatcatttgctttttgttcatctgaggactgccgggtgagtttgggttggctgggctcagtttcactgggcttttgattccaggagcccagagtgaagcagcagccactatcctgcagttttcaacgcagaggacataccaggggagacagaggctgagccaaatcaaataatcacattgaaaccttttgcttaatcataccaatgtcatggctgctcatattcattagccaaagcagccacatgacttggcagaagttcatagggttctgatgcttattcctcccatagaatgaacaggaattctcatataactataattgactatatcaaatcccattgctggaagtgggtgaatagctgggaatagtaatccactgtattacatatgccaccaaatgattcagcaactttccagtttcctactggacagagagaggcctgtctctctggaaagtcgctcctcctttatatgaccgccctgacagaccttgcacttgcaacttgactccctgctgaaaaccacttctactctgttttcggaaatacctgtagtgtcagtagacaaagtagaacaaaatgagaaaatagagagaggatgggatctgaaaactagtataagtcagggcaggaaaaaaggaagagtctgaaagcaagcttggagagctgactcttagaccagaatagaaaacattttcttcaaaatattcgccccttttcaaatgcagaattaggccagttatgttttaggatacccattgccttatattcttaaaaagaaaagaaaaagaaggaaaagaaagagataacacttaatagtccataacaaagtgtcaacgggatagacacatgcttattcaaaccacagatatgatccagttaatttccttcttaaaatgtgcccatagtgtcttattgcctcatcgtaatgataataatgagagcaacaattataatggcaaaagcaaggactcctgccatttactgtttgtgtattaaatgctccactctacactaaaagctttatgtacagtcttattcctcaaaataaatatgagaaaaacaactttaccaaactcacatagttaataaaagtatttttatgagccaccacaatactcaaaaatggtgcaatactgtgttttcatgaatttcacccaatctagctttcctgactcatctcttgccttcccctctgtgattgctaagtacagacacacagaagtgctgccatttcctcactatactctactatttcacgcctctgtgagtctgtatccatgaatttctccacttggaatggcttttctagccacactactcctttgccaacctaacaaattctgtttctcttctaatgactcttctagacgcagtcctctgccacctgctctaggaaggtatgccataggtagataagttgtctcctgcatttgcttgcagtctccacacactgcagcgatcacatacacctgcacataaaatgtctttgctatacatgcccattcctgggcccacacaagtcttccacccttcctcaggtgtgaataccttaagggtcttctttattcctattttattttatattccagtgtatgttctaacaagtaatcaagtgacttgaatggaaatctcaatagccaaactgagttgttgctgtacatttttaatatttaacagagagatggatctattggaggcagtcatctgagatgatcagatataatggccaatagcaactatgctaatcataaaatttaaaatgtaaaaaattgcttcgtcaaactgttttaaaagatgtatctaaaacatagtaggctgagcatggtgactcatgcctttaatcctagcacattgggaggccaaggtagcaggattgcttgaacctaggagtttgagatgagcctgagaaacatagtgcaaccctgtcactacaaaaaaaaaaaattaaaaattagctccatgtggtggcatgcacctgtagtcccagctatttgggaggctgacatgggaggatttcttgagcccaggaagtcgaggctgcagtgagctgtgatcatgccactgaactccagcctgggtgacagaacaagacactgactcataacaaaacagaacaaaacaaaaagcaaagtcaagatttggatgttcagtgtattcattgctacttgcacacacacacacacacacacacacacacacacaagcaaacacacacaatatagttttatcagaatacacatattctgatagcagaattgaaagcttacataactgtgcaagctttggattctgctattctctggtttactcatccccagttttccaatccatcaataaggatagcctcaattatctaataagcatttcatgtgtatttcaataaaataatgcattttaatgaaaaattcttagaatagttcttggcacatgccatatttaaatgtcgccactgcctcattcatacagatcgtacccaagtaaaagtgtatatatggagaataaaaatgaaaacaggaagtaagacagtaaatggaggaagtcatttagatttgatagcatggtttccaaaggcagtgtcctattagaagtgttcaggtaaataaaacgttattggcagagacagatggtaaagccattttagaaataaaaattaaccaggtaagcacatgccaattttgggaaaacaatttattgtacctttttttctggagcttatttcaatgtaaaagtactttaaaaacttagaaaatagggtacatattaggtaaaagagagtcttgcaaaaatggatccagcaaatattagtgaagagaaaaagatgatcagaactctgagtttcagtgatttgtcttgtaccatattcaagctgtaatcactgaaggtaggaaacaaaccagcaaaacatttgtaaggtgatggtatcatttaaaaaaaatagagaaacattacagacaacttaaattggaaacaaattggaaacaatttttaaagttatataaacaccacatttcaaaaggattgcatgatatcagaatgggaatttctagtagaaagttgaaaaaaaaaatgagactcaagggagactgttagtgtggtggtaagattgggtagaataattcagatctcaaccatgggaataacctgttgaataatcatgtgaatactaacaggtcacaataatcccgtgaatgaacatgttgaatttcggcatagagagacagcattgttattgccaaaagagctgagtagaaaggaattttgtgatgagtgatttcaagctacatttctctgagtatcaatgtgcccatctggaaaatgcaacaataaacagccctcacataattgtgaatattaaaagattatttgaagtgtctaccactttgctgatagggattcaacaaaattaaatttttcataccgaagagtagaattttccgtcagtacctcatggggcatcaacaatgatgataagcagtagaggctgacttgatattagataacattaggtgaccagtgagccaagacattcacttctttggctttccttcagtaaagtaagttacctaaaatctgaattagagtaagcagatgttgacagggataaatgaataggaaaagcatgcagagagttaagaaagaaggcatctaggatatttgtcaagaaggattaaaggcaggttttatgtatgcaaacctggatggtgaaaatggatagtttactgtgctgacttcgttcagaggtggtataattagacagagagacaaagccgcaaatgtgacttaacttgggcacagactatgagatagttggcatttgtagctggaaagtgtaagggccggttccagaggtttgcactgtagcagtccattgtgatgacaagatcctggaattcatcatgagacagagtgaattatgtggagaaggaaagtgaaaacaagaaggatgaacccagtctggtggaatttatgtcttcctcccttctaaattttgactgtgaataaatcttgttgcaaaagaaaaggtcattattaatagcatcagtcatggatgaaaacaaattagaaaacttgtttgttttattgaacatgattcagcagcagaggtgatttgaaatatcctatagggaaggaattcatgcatgcataaagtgtgttggggcaaaccctactggaagcttctttgggtcataggtcttcctggccttttcatttgtgcagcctcttggcaggtcatcactactttctaattctaagtcctgaaaattgcctatgaggtaagtttctatttcattaaatgttctattaagacaagttttctattgtcagttttgttatgaccaaattcataaatggaacatataataaaatgttaggaaatttggacattttatttcatgattattgatttctaaatttatgtaaggtccattctgtgaaattcctagagaaatttaaagagttttctttagaatattttatttgcagttattgatacatgtaacaaaaatatgggtagtatttttgctttctatgacaaaatatttatagttaagatattaaaaatataacgaatattaattatacaaaaataatacattttagaatgataattcaaatacagaacccatcaaaatcaataactatatgttagtatcaataaaatgccaattaaaaatataagaaaatatgagaaaatactaagaaaatataagaaaataatttaagaaaacctcttaagagatagcttaagaaactttcttttacccataaaatcccatgccttaccacaacacggcaatgcagatatttccttcaattactggtgggaaaaaaaaacatgagatttgaaatatcaaataaaatgtgtaaaatcaaaaaaataaacagtaagctaaaacttggaggtttttattttttccctactacatctctaaggcgttgtgagattcatttaagctagaacaagtagaatgtgttctagaaatggcatccataggatagtttaataaccggaaaacaattatccacaatgtttcaaagcatacatttggtttgtttgtttttagcattttaatttgtaggttcattcaagttaccacatccaccaattaattgcaaaagacctagccacaggcaatagttgactacttttgctttcctttatttgaacaactgttattatgcagatttcttgttagaattattctgctgtaagagagtgaagtctacctaatttcatgaatataaagggggagatgaattatgagaaatatacaggagtactccatgaaacccagcaacaaaaagtacaactggaaattacaaccagagccagaagcaagagtggtataggaagaaagatggctacttcttacatctctgcctctttttcttatctttctatatatctgctctgtttccctttctgtgtcagtaaggcaataccttctgctgtttacaaggccccaaaatgactgttttacttatacctaggtgtacttgactttccattttcaaaaactatcacgtacttccagatgtaaaaggattatgtctcttggattaaattctagaggaataaaatgggattggcccaggtgttctaatggacagtatttctttctgtgagaatgaagggaagagacagcagaatatgaacatggaagccctggcccaatactttagcctaagccagtggttttcaaacttgagtccccatcagaatcactgggaggctgtgttaagacacagattgccagcaagttttcaggtgataataaggtcactggaccagagaacatactttgaaaatcactagttatgctgtgggattgtaacagttctcaacaagaggaaatggacaaatattccaacgatgtgctatctgtacctttttgtgcaattgagccgctttgattatccagcaatttttttttttttggagacgtggtcttgctctgtcacccagactggagtgcagtggtgtgatctcggcctcagctcactgcagcctccacctcctgggttcaagcgattctcctgtctcagcttcccaagtagctgggattataggtgtgcaccaccattgcctgactaatttttgtattttcagtagagacagggtttcactatgttggccatgctgatctcgaactcctgacctcaagtgatccacctgcctcgcccttccagagtgctgagattacaggcgtgggccaccatacctggtctatccagctatttgtcttcattcatttattaaagaattattgagaagttactatataagaaaatagacatttatattcctatatatacaaaaattaattccttaataaatatagttcatgtatgtgcctggatactaagcctcacagcacatattattatacattttttaatatgtaataccattttactattttattatctaagtacagaacaatcaaattttcagaaaatgcaatcatttatattttatgctttatttattttcccaaatatttatgcataccatatgtgttatattgtaaataaaaacaaaacaagtgaaatagcttgttgatgttggaggttctcttatttacaataatttttcttcatgaagaaagatgtgtacccatatagtgatggatcaaatataaagtttacttgttaccatatattaagggtcaaaatatcctgagaggaataaactctctaaactgtttcttctgaaacctggttccacagtaacatagtctcctgatttacgaatataaagccaatcaatcctcagagatgagccattcttttcgtcactgctactctcttttgaagtgacattttcctagctgcataatctgagataatgtttggttgtataaaatatgctactattatcacatgtatgtgctgaaaaattacaaataagccatgtttcttaattatgttatcatactgagtgatatggtttggctctgtgtccctacccaagtctcatgtcaagttgtaatcgcgaagtgttgagggagagacctggtgggaggttattggatcttggaggtggtttcccccatgctgctctcatgatagtgagggagttctcatgaaatctgatggtttaaaagtggaagtttcccctgcacgctgtctctctcctgccaccttgtaagaatgtgcttgcttatccttcaccttttactgtgattgtaagtttcctgaggcctccccaatcatgcataactgtgagtcaattagacctctttcctttataaatttaccactctcaggtagtatctttatagcagtgtgagaattgattaatacagagaattggtaccgagagtggggtactgctttaaagataacctgaaaatgtggaagtaactttggaactgggtaacaggcagagattggaacagtttggagggctctgaagaaggcaggaagatgtggggaaggtcagaatttcctagaggtatgttgaatggtgttgaccaaaatgctatagtgatatggacaattaagtccaggccttggtagtcacagatgcagatgaggaacttcgtgagaactggagtaaaggtcacttatgctgtgctttagcaaaaagcctggcagcattttgcccctgccctagagctctgtggaacttcaaacttaggagagatgatttagggtatctggtggaagaaatttctaagcaacaaagcattgaagacgtgacctggctgagtctgaaagcattcagtcatatgcattcacaaagagattacctaaaactgatacttatattttaaaggaaagcagagcataaaagtttggaaaatttgcagcgtgaccatgtagaaaagaaaaacctattttcttgggagaaattcaagccagctgctgaaatttatgttaagtaatgaggagctgaatgttaatagccaagagaatgaggaaaatgtctccaggccacatcagagatcttgacagcagcccctcccatcacagacctgtagtcctaggagggaaaaatagtttcctgggccaagcccagggcgatgctgttctgtgtaacctcgggacttggtgccctgtgtcccagccactctagcttttgctgtggctaaaaggaggccaaggagcagcttgagccattgcttcagagggtgcaagccccaagccttggcagcttccacatgtgttgggcctgagggtgcatagaagacaagagttgagttttaggagcctccacctagatttcagaggacataaggaaacatctggatgtccaggcagaaatttacttcatgggcagagccctcatggagaacctcaattagggcaatgcagaggggaaatgtggggttggagcctgaacacagagtccccacctggggcactgcctagtggagctgtgagaaaaaggccactgtcctccagaccctgaaacagtagatccacagacagcttggattttgtgcttggaaaagttgcaggcactcaatgccagcccatgaaagtagccatgggggctgtatcctgcagagccacagaggtagagctgttcaaggccttgggagcctcccctccttgcatcagcatgctctggatgtgagacatggagtcaaaagagattattttgaagctataagatttaatggccagcctgctggaattggacttgaatggggcctgtagcccctttgttttcatctatttctccgttttggaatgagagcatttgtcccgtgcctgcacccccactctatcttggaattagctaacttgttttttattttaaaggcttatagaaggaagggacttaccttgtctaagatgagactttggactttaacttttgggttaatcctggaattagttaatactttaggggactgttgagaaggcatgactggtttcgaagtgtgaaaaggacatgacatttggaaggtggcagaggtggaataatatggttgggctctgtgttcccacccaaatctcatctcaaattgtaatccccacgttttgagggagagacttggtgagaggtgattggttcatggcagtggtttctcccaggctgttcttgagatagtgaaggagttctcacaggatataattgtttaaaagggctagtttcctctgcacactctttctcctgccaccatgtcagacgtgccttgcttcccctttgccttctgccatgattgtaagtttcctgaggcctccccagccacatggaactgtgagtcaattaaacctcttttgtttgtaaattacccagtgtcaggtagtatctttatagcagtgtgagaatggaataatacacttagttactgagattaatattcaaaaaattaataacattttattgataagaatcacaatgttatgtgaaaagttcccacaatttttctatgtgtaactcaattagaactagccccttctgcttgcctgctctcatttaagtcatctctcaactcccaactatatcccaaatacacatgcaattataataaataatatagaatttatagttttatgaagagataaaaatgagagggagggcacaccaaaaaatcacacaattatgcttcttaaatttccctattacctatatgcagtaattattaaaatttcctttcccaaactagctactacatcactctactcaaatcttctaaaaatttctagggtatcggtttctttttctcctcaacagaaagtctcaaaattctgataactcatatattgtagtctgcaaaggttgtagctgaacagttttagaaattcagtctttagctcagaactattctgctgagggagactaaatttattttcttccaaataaaataaatattatgtctctatttgaaaatgtatcctgtaatacctagacatgttttttcatagaaggttttgaatattttatgtttgaaaggcattgaaaccaatgattctatggataggaagaaatgaaattaaactgactaatgaacaagcacctctgaaaaatttcaagaataatttttaaatattcgactgcattgattgttagaaacatgctcagtgtgtgtgttgctgtttcttttattgttctgcttggaaagcgtgaaggacccagaagggtgataattttccacactggtcctctcctgtccctgccactcagccatttcatttcaacccctttagcacatgaccttagccactaacttctttttcaccagtcatgataaactcaaactagtggatctaattagctattagcacagctaataatcgtgagaacaaactttgtctcttccatgcattttaaaccataattcctaaaatgatcagaacttcagctgacccccttggtaaccatcactaaaatccttgcccccctcaattgcacgttagacaactcctttggtctttacttatctgacattttttcaaaatggcctatagtatcagtgctctggataatttccttcccctagatggttccaggaaatccagttgagcaaagtcatacttttgtatgccttttaagatacagaaagaaatatttcttctcttccaatgcatataacatttttccaatatgtacaaatcaaaatttctattggtaataaaaaacaagcaaccaactaccaagcaagaaaatattacatcagcaattgtttttatgataaattttgccaaataacaaatagatttcttgatggcagctactactgaaaaagcttcatatttaatcaaagtttagtaacagtgtgaaaatgaggggaagttggggttaaggatgatgtcattgttttagtcgctgtgataaaaaataatagacatctaattttggcattgtttaaaaaatatgattttacatttagaaatacttagttttaggtaggaacaaggcatgtgcttacaaatatgcagaaagtaattgggaatatatataagaatcaccttaactatctgatccttaaaaccttaataacaattgtgccaggcaaggtgtgagagccctggcatcacaaagtggtgggcttgtgggtagtggggtagtaagaagaacttaccaacaacattatagttttgaaagggaaagttttggccaggcgtggtggctcatgcatgtaatcccagcactttgggaggatgaggcggacaaatcatgaggtcaggagttcaaggccagcctggccaatatggtgaaaccctgtctctaccaaagatacaaaaaaattagccgggcttggtgacgtgcgcctgtgatcccagctaattgagaggctgaggcaagagaatcccttgaaggaaaggagggagggagtgagcgagggagggagggaggaaggaaggaaggaaggaaggacggaaggaaggaaataaaaagcctcatgtttaaaatgattcttcgctctcttctgacttgtaaatctccctttctcccttactcttaagcgtagttccatttcattgtcttctcttcttcaattctaacctctctggagaaatatgaaagaaaatcgtagaaaaatataatcttgggtttttttatcagagtaattcagctttttctaacctcatgggcagattaggccttacattttcaagtaaaactttgaaatgataatttgtaaaggcctgtccgattaactatttagataaaaatttacctcttgtagcttcctagaggttgtagacagagcagggtatggttggcttcatttttctcacttacaagtagagaacggaaaatctggaatgagatcagggataccatatgggattggaaatcacctgtgaaataatatttgtaaagccaattaaagagagtcaaagacagacctctaagtgcaagtataaagggaaaatagaaacatctcaatgttcacccatttaagggacagggaaatacattaaatccagataaattacctgagaggtaatcataatagttgtgtgagttagtgcaattatcttaatttacttatagagaaagtgagatacagaaatgaacggagctaaatgaagaagtcattatcaaatgtctttgacttaaagactgtgtcctttttaggacagtaggacctccctaatgaatttattctccttcgcagggtcagaattgagaataagtaagttagaaagtgatttcactttggtagattccaatgctgtcagtcaacaagagaagaataaaaacattgccctgtagaaaagcaatctatccaggccaggaggggtggctcatgcctgtaatcccagcactttgggaggccgaggtgggcagatcacctgaggtcaggagtttgaaaccagtctggccaacgtgatgaaaccccatctctactaaaaaatacaaaaactaaaaattagctgggcgtggtggcgggcgcctgtaatcccagctcctcagaggctgagacaggagagtcgcttgaaccaaggaggcagaggttgcagtgagccgagatcatgccactgcactccagcctgggcaatacagtgagactccatctgaaaaataaaaaaaaaagaaagaaagaaagaaagaaaagaaaagtaatctatccagtaaattgagtaacttaatatgtttttattattctttccattagtctaataaatagttggcaagaatgatggtgggagcaatccaaacgttgacaatgaaaacagagacatgaggaaacagaaatagcacgtggggttatctgatggtagggaagaaagcctgaaataatagggtaaagtgcaagtgaagcgaggaagcgagaaaaaacgaagcagaaggagttgaaatgccagaggtgtcagttactaacaacacatttaatgtgagagaggcagatcgttgtggaagctagaggtgatagccattcaaagcagatagggggatcgcagcctatgatgctccaaatgctactgccaaatgacagccactggaaatgccactctggtcattgtatcataagatgttaaaggtttgccattcattagtttcaaaggaatctgaatgagtaaccacattcattatagagacaaacaacagattatgaatgtgtactttaatactttaggggctgaaaggagaaaaaaacaaagacaataaaattctaatggctgtatttaaaagtgaacattgtgtgagtctaagaaagctaacagttcacagttcagtttgtcttaaaaaatatgtgtgtctgtgtataacgctcgtattacatatatctcatattaccatgttatataactatcatacataataccattatgacataataccattatgtatgtatgtactatagattattaccattatgtatggttatttacattatacattatatgccatttaataacatttaaagtgttataaagatgcaattttaaattacaagtggatttgtgacaagataattgaatccacaatttatgtcaacagagttggaaattgttgaggcatgtttctaaacttttaaaataggtcttcatttgagtagattttctttttttttctttctttcttttttttttttttccttgagacagggtttcactcccgtcatccagactggagtgcagtggtgtgatctcagctcgctacaacttctgcctcctgggctcaagtgattctcatgcctcagcctcctgagtagctgggattacaggcatgcaccacagtgcccagctaatttttgtatttttttatagagacggggttttgccatgttggccaggctgatctcaaactcttgagcttaagtgattcacctaccttggcctcccaaaatgctatgattataggcatgagccactgcgcctgtgctgagtatattttcaaatgtagaatactgaattcagtgcaatttgatcatattttgaaaatttctgcattattatgttgttgtattggaacatttgggttttcgtagttgttttgttttgtgtccctaaggggagatgaaccttctttgtttgcttgaagaatacataacatatgggtcttggtggttgagaagaccatggaagcctaaaagaacaaatttgccctctcccagcctcgcttgcaattagctattaaagttctatgggtgatacacatattatcaaagtttactgttagggaaagccagagcataagccataatcacatgacttcagctgagccaattgtaagcaccagactgagaacaaataatgcaaggagagaagattagcaaaggctccctttgggacctggcagttcacagtgatacttagagacaaaggcaatgtaagctgaagcagctagtactgagaaaaagtagcattattgtcttcactagacagtgaagtgtggagtggtttttgactttgatcctgagtgtctagccttccattgttgcttctggttttctgagccagtgtttgaaagcatcccacagttctatatgctaacacaattaactcttaaaaaattctgtttttctttaaatcccccagagttagcttctgttgccttcaactaaaaaccttgacaagtacagtagataaggcatggtttgggatcacaacttgattttttttattttgggaatacaaatttaacttgtggagagactgatgttctctatctcaccaaaaattgtttttgttataagctgtattcataagtgagctgtaatgttaaagagaaaaaagaaaaggattttaaattgctttctgcagcagaatgggaggcagtaaaaaggacaaactgctaaacagagaaaacaagacaatagaaaggaaagactgttctaaggaggagctgacagggctgctatgaaagaaatgtagagtctggctttaaattgcacatgtgacaagaaagatgtgatggaaaaaaaaatgtttgtttactcacactccgtccacatcctcactgcaacacacccacagcacactcttctaaggaaggttcacattgctgaattttttttttttttttttttagttgggtgtatagctgccttcaataaaatatttagtcacatacttgaacacagtgtgaagtcataggtatttgtgtatcacgacaacagcagataggtatttcaatatcaaaacaaaattggagaaacctgtgtagttgtaaaaaacactgcataaaataaagggagattgaggatgggtggtagagaggaggcaaatatcaggaaagaagggaagatgtccatgtctgatacggattttctcagctgtaaatgctgaggactgtttagtaaccctctttttatgtgctcatcaaatggacattaaaatatctatttgtcatagtggtttgtgagatatattcatatagcaattaatactgtgaagcgctgaaacttgctctaagttatacaaagagtggagacagagatagccaattggaagccggttacatctaggccatgtgttatttctgtatttacgtagtcttctctgtgtaattagaactgctataggtgctaattgaaggagaactttagatcctagatattataaaaaataaatagaaaataccattgctatggactgaatgtttgtgtccccaacatttatatcttgaaatttaaaccccaaggtgatgataataggaggtggagctattgggaggtgattagttcatggagttagtgcccttgttaaagaagccccagggaactgcgttggccttttcaccacgtgaggacacagggtgaaagcgccagctaatgatgaatcagaaagacttcatcagacactgaatctgtggatgccttgaacttggactttccagtctccagaactgtgagatgcacattcccgtggtttgcaaggcactgagtctacagtattttgttatagtagcactaatggactaagattactatgggggcataaatcctctaaaccagattttctatagatataaaaattaaaaagagctatgatacaaagagtccccatttgctctatatcccatgatttattcatttgatcaataaacatatgtgcagggatctaggtataacaacatgagaaagcaacaatcctcgtggaaatggtggaagcaagagaaattagaatttataaatgtgtagtggtcatacatggacttcataataatctagtgaaaaacaccacatgatttgttcttaatcatgttaatattataacttcttcagagctctcgctaaacacagcagcaagaaaatcagcctcaatcaactttgggagaacttttaactttgcctagtgtcagtcgaatgaatatccaggaagctcatgttatactcagaaaacaggaaagctctgaccattagtctgtggtgtttatcgtagttacctttgctctttctactataaggtggtgctgaatcttgtcctctgccctctattgaaaccctgaccctccacgcagaaatctttagaaccacagtttaatggctatcttttatggtcatcctatagtcagttaactaaccaattggaggtgccacaagtggaccaaataaatcttcatgttgcaaaggaattaaaaaacaaaacagtacctggacccagccctaagtaggagaggcatgactccatctcccctctggctgaataaccatccatcttataactccctgcctttcagagttcttttgtttacttctatctggatctgcttttccatctccaccaccaaaacagctcctgagtagagtggtctgtttttcaaacttgcaacctaaagacacccaaatgaaaagaggaaaatgaaagaataattcatttagttttttcttggaatagaattaagggaaaaatagctcacattctttcaagagggaacaaaaggtaaattaatattttaccatgttatccagtagcatatccattatttacgtggtcttattttattgattggtcaaaagattcacaagaagaagatagttcaacatacacctgtgttttgagggtgaaactcagctgaaatacactggaaacaatagctgtgaaagtctacaaggcaatgggagtgaaaagcataatttaaaaccatcatctttacctaatgatcaaagcctttggcctctaacagagattcttcatagcagttcacaaaagagtgccatactggggacataagagggtgggccaggtggggtggctcacgcctgtaatcccagaactttgggaggctgaggtgggcaggtcacgaggtcaggagatcgagacaatcctggccaacatggtcaaaccccgtctctactaaaatacaaaaaattggccaggcacggtggcacgcgcctgtggtcccaggcacttgggaggctgaggcaggggaatcgcttgaacctgggaggtggaggttgcagtgagctgagatggcgccactgcattccagcctggtgacagagcgagactccatctcaaatcaatcaatcaatcaatcaatcaatcaattagggtgtaatgggagagttaggaagggatcctatcctacagatggggtaaaggaaatgttatgtaaggtggcattggtaccacctattgattatgctaactgatgcattccaagttaccaaattagatctcttataaacttgaaattttatgattaagtattgctagttttggtttggaaaaatgatccaaaatttatgttgcataacttatagttaaaggaaaatgtagtacaatgatactgtattttactgttgaagtctttgtgttgggattaagtattaagaagaaaattactgttcaacataacaaccgaaagggtaaacatatttaaataattacttaaacaaatgtaaacattattaattccaactaactctgtatacactttccagcggttgcactgccttgttcagatagctgttgcttcatgtgtggcatggccaattggcttcatattatgaaggatgagaggcaacctgaactggccaaccatgacagcagacctttcttagggaagtcaagtccatcattgcctttttcactcttcagtttcaaatattgtaagatcttttatatgctgctgtctttgttaaacatgggaggctcaaacatgtcatcactcaggacttcatacctgattcctctttcagtgtttatggctactgtcttaccccaggctttcattttactcttattgggaccatttcaagggtcttctaactggactttctcccattactcactccatcctccacattttcacgatggttatttttaaattaggagtctaatcatgttgttcgtctgccccactgcctacagcgtaaactatagtttatgtatagaattttgtatagaattcttttgtatagaattcaagaccctccatattcaaccattaatgattcttgtccgtaagcacttagcacagtgctcaacgtatggcagacactgagtagataaatgtgtgctaggtaaaatgaattaagggcaattgagtggcccttccaccagatgatgtcctggtgtctagaaatagatgaattttgattgtttttggcaattatcttaaagatttcatatccagaaacttcaatttcataatttttctgattagcccattccattttattcagttgctttgatgataatcaataatagtaatattgttgacttcatacagaagaaaagaagataacttttaaacaattttaatatttccaaaagatgttttatgatcattttttacataaatattatattctttgaatagattatctgaaatagaattccaggaccaaagattatctaccactttaagccttagattgtaaaatggtctcttaaaaaagcacatcagctcagacccagatttataatgttctgactaaattataacattttatttaattgtcgataaaaagcacactgtttcacacataacacaaatttaactttttaaatttaaataccttaaagggtcaattattgcaaaagacagattgagacattcaacaaacatttcttgaatacctaatatgtacaagaccccatcccagaaaactatatagagttatagaaattaaattaagtgaaaaaatgagtatgtaaacatcaaaataaaaaagttagtttggagtcaaatgtaagcatttgttcttaaaaatattatggtttcctccaggattattctttagtagtacttgccaattttttctcagaatgtgttgtcctatggtttgctttttttaatttcacaaatgtcagaggtacaaaagagtcttacaccttttcttgcaggatttctaaaaatcgtatttagtcatcaagaccaaatttatcatcaaaccttaacccctgaaaccaagaaatttatgtatacattttatttatattttcatttatatttacatctcagcagtggcaaatgatacttatatggttttatgtattttgtacagaatcaccataggattattgttttgatgtatctaatattagactgtctagttagcaagataattggaagaattttacaaatttctgtaatattttaattcttatctaattgaattaactccttagcttcaaagtccctaataaaaagtataaaataatcaaaagtatttttaaaaagcttttaatttttaaagtaaataatatacggtttattcactcatacattaagaacttgtgaaaacagaaacatacttcataatgttaagttaaaattgttctattttagttttcaaatatttttaattttcttcaaggagaaatgttaaatgaaattataaccattagtttttataattttgaaaaattttctctattactctgatactttagagagccacaattttcacaaatctttgacattttaagttgtttcttgatattttcttaaattaaaaaccatgtttattcagatttatgcacatctttatttcagataaactattgctacaacttggttaaaacaaaaataaatattttacaatttttaaaatgctggcttatattaaagttggtttacattagaaaaaggctcaaagaacttgtattggaattcttctaccaataaattccatcttctaccaataaattcatgaaaacatttaaaactttataagtaatcaaataaaactaaaataatctaacactgtgtattagtccatttttacactgctaataaggccatacccaagactgggtaatttacaaaggaaagagttttaattgactcacagttcagaatggctggggaggcctcaggatcctcacaatcattgtggaaggggaagcaaacacgtccttcttcacatggcagcagcaaagagaaatgctgagcaaaagggggaaaatctccctataaaactatcagagctgagaactcagtcactatcatgagaacaggagcatggaggtaatcactctaatgattctattactttccaccctgtctctccaatggcacgtggggattatgggaactacaactcaagatgagatctgggtggagacacagagctaacccatattacattgcaacactgttattctcctttctccaattggctacattttaataaatgataatatgccactttcagcaatgaccttggagtgaagtactctggctccccgctggtagaagtccaagcacggctttttgaaaaggttaagatgtgacctatcctttaactcggcaattccactattgtgaattaatcataaagaagtaatgagcatttacaaaaatgtgtatgtgtttgtatatcagtgtgtgtgtgtgtatgtgcacacacacatccacatacaaatatgtgccctcatgtgtgtgtgtggacaagaagtcagaggcaatagattgaggagtaaatggtgacaaaggcattgattgtaaacaagtcttcctaggaaattacttatgaaagatagaagaacaaagtagctggagcaagaggtaagacctgaggaatctttttatgttagggaagatttgaacctgcgtaaacattaatgagaaagaacaaataggctaaaatagatgagaccaaaggagaagtgaaggaggagttcaccaagaagcgagaggtatagaattggcagcacaggtggaggaagcacctattacattgggctgggagggagtgaggtacagattggcacatgtgtgggatggtgagggtggaagggtgagagaaagagaaagagagagagagagagagagagagagatcagaaaggagacatggggagatatggaaaatttaaccagaggcaaagccacaaatttctgctttgggaaatgtatttttagtattaaatgcgtcacgtgcaaaaaaaaaaaacaacaaaaatcagaactcattccatctgtattataaggactgatattttcctaagactgcctaataataataaaaaagattattcacaactataactaggccaagtgtaatataaaaatgtaagataatttcttatgattttgaacaggagttgatgatctttatctgtgaagtgccagctagtaagtatttcggctctgtaagccacacaatatatgtctcaaatactcaatcctgtgattgtggctgtaacacaaaatcagccatggattatacctaaagaaatgggggtgggtgtgtttcaataaaattttatttacaaaaatagatgacgggccagatgtgctaacttctggtctgaaataaaatcagtgaagaacttgacactggtaagctaaatttttgttctctcagggtattttaagctcatgcctgattatcattatatatttctgtggatcaaagagattttcttctatttatagcagaacaagggaaagaacacctattctgcggtctgtggtcctagattttaaggacgacccttttacttgtactggccggttacttaaaacctctgagccctagtttccttcttcgtaaaacaaggcgatgaccctgtatttaatcctcacagatcagaatgagaataaaatgtaaatactataaaaatggtatattattcatacataaggaaatggtcatttgcaaccaaatcagaaaatgttagttcgatctccttatgtgtaagaccttgacattatatatacatatatatgtgtatatatacacatacatatgtaatagttgtaactattaagtgaaataataatatatgcaaagtgcttggctgcagtgcctaatataccttatatgctcagtaaatgccagataatgttcttaatttctaaaggcccattaaaattctccagtgcttgtgacacatagcgcctgaaggggcaaaatcaagttattccaagtcaagcacaatgctggcaatgccagccatgggcagggcagtcacagcaacataccttttaagtaagcctcccagggctgctttgcaaatggcgtaagaaatgggtattgacaattgtcatggagcccagtgactcggaagctgagttttgcgttctgagttgaatatcaggagagagttttcattcttctatgatttggaagttacagccccagactaaaaggaaggcatctgtttgattctatagtaacacaaacataaagagaccagatgagacggcatagctaccccggggcagttttaaaataaactgcaaatgtactcatcagccctttggaggaacatttgcccctatttgttcagtatgtgcagtttgttcaccagaccagggaatgcttagttattatgtgattccaccccattaaagttcttcaagccacccaggagaggcagggtaagcagcaatcggttttccatggatgaagaaggattcaatgagggagaaatgggcagtgcaggagcaattctaactcatttctgagtaaatatatagaaaactttgtgtcaggtgtgattcaacagaaggaaaagcattctctataacagttaacctacatttcgagcaaagagtgggcttttgttccttgtcttttaaacatttttatttttagtttttatctcagtgaaatcagtgggaatctacactgatgccaggttatgcggtgttattcaaacatgaaccttcacctgggacacctgttatctgcaacagagatgatttggcttttggcacttaataagctatttgccctctatagttttaaatcccaggctttcatatagacttgtttttgacatggtgcatttttagatcctgaatatgaagataatacgcactatgcatttggttcaaacatcggatacaagtgtccattgaaagtcaattctccctctcattttctgtatcaaatagataagatttttcacatggatcttttgtcatgttcatattcatcatctcaaaaattcatgacacttattgtttataatatttatttgtaatcattcaattgtagaactttttaaaaatgttaaaaaatagtaacttaacaagactatagtgaccatgaatagaggaaggattcaaacccagatcttctgactccgaataagtttttaaaatagtatttcttattcagaatgatcaactttaacataaataaaaacacttaaaatagaagggtattgatataaagaatgatatgatataaagaacacagaaaatatattgtataagaagtttgcttcagtctgtatttctgtaaatgattatttccaaagctgaagatcaaagtaaacccacatgtgtgtggggtgtgttcacaaattatattaaacttgtgtctcccttctggcaaattggctatagataagaaatgtaaatcacataagatgctacacgttggtttacatgagcctctatatcttcctaagcacacatatccactggcaaccacaagaatgcgatgtaggcacaatactagtcgatttaatgtgattctatgattctcgtttatagaactggaggtttcgcatttcccattcctacctaattcaataactcagattgcttgatttacttttagagcaatgattccctcctgggagcaattttgcttcctagcaaaatttggcaatgcctggagacatttttgtttgtcacaagagggggttgtgtgctactggcatcttgtgggtcaaggccgtggatactaccaaatatcctataatgtacaagacagtcacccacaactaagaaatatcctgcaaaatgtcagtggcaccagaggagatgaatgcaaacatgctaaccacattcctagagactagtacgtgaaccagaatgccatttattaatttgcaatgatagctagaactgtcaaggggaccaagacaatcatatttactgatgaatatatttactccctctggaaaacctatacaaaaagccaaattagaaccagacatttatttgctaaacataaagtcaattctaagaagatagatactcctcatagaacttatcacaatgaaaactgatcatttgtgtgattatatatgtattcctcctctttaagtctaaaaactctattgggatatggaacctatctcaatatgcatcatcttaaccaaggcatctaactgtactgcctgtcatgtagtaggtactaacaaatgtttattgaatccatgaatgaatgaatctttaatgtttcagtttaaaaatacatattaaacgtataacatatacaaagcacaatttgaagcactgggattacaaaatataataagataatccctacttgtgtggaagttcctgaattctgatggactagatggacacttccagttatgtcaggctgctgaagccatagcctgccctgccaacaggcaccatgaaagagctgagcctcagcagccatgttaggtatcatgtgactctgtgccttgaccacatttgaatggactgaggtgaaagagtatgaaagcaggaactggcggcatcctatcatctgagctttagcaagaagatgtggaccctgacaaatcagattcctgtgcttgggtatttaaataaaaatactaaatgactgaattagaagtgtaaagagaagttgcaaagatactgtagtggtttgaatggtggccccccaaaagacatccacccagtacctgtgaatgtgacctaatttgaaaaatgtctttgtactggtaattaagtgaaagatttaaagatgagatcatcctgaattaagtgggtggtcataaatccaatgagcgtgtctttatgcaatagacagaaaggtagaggacacacaggagaggttcatgtgaatgaaggcacagacagacagtgcacatatgtagccacaaaccaacggaggcctggagcaaccagaggctggaagaaggaaggaaggatcctcccctggagacttcagagggagtgtggtcctgccgacaccttgatttttgaacttctggctttcagaactgtcagagaatatgtttctgtttctttcaggccccacactttgttacggagccttaggaaactaatataaatacctagaaagaagaaatatataggagtaaaagtcatgaacggcagcttgcaaccactgatgttacattgaacaaggaactgaataaacaaaaagctttgcagtagggaaataacacagtctggaggaaaatactgagccagtcagtggtaaaagacacatagaattggatcatagagagcagccacgtcacttctctggttaagttctggtgtaaagatacacagattcctgctcttgataatcctgctgctttggaagaagcttttatttcctgcttatccattaagaagtcaggcatgtttggggtttatatttgtttaatcttacaggaaacttcccatcatttcctaaggctgaaacattttgtaaagaattgtaaatagaaaattgcaatataaaacagaaagtagtaaacaagtccagcatgccaatgaactaatggactccaaacaggaacacttggtctggctagaaatttcatgaaaagcttcctggatgaattcattaaattatccctggcatatcttgaaagtggagtgggtacttttcaactgactaataagagatgaaaggacaagaaagaaaaattttcaaaaaagaaaataaaaagaaaactgaaagcagagatgcataaaatcatttgggttatcatcttactatgtaacgggatcgagctatgggcacgtgagggagacacagaagcaaaagatactgaaatgttattgtcagcagattagcatgccctgcctcccacagactttttttggttctatgataagcaacctcttgagacaactgatgtgcctatagttttagatgggctaatacaattccattcctatgagattgcttcaaagttactaactcaagatatatttgagatttttccattttgccccttctgcagatagctgatgtaatttcctgcatttcttcttcccaatcttttgacaaagtaaacatttgaaattctgagtgtcttgaaatatagggaaacaaaggtctctgttctttttttctggaatttgaattaatgccttttatgtaacatcagtgtgaagatgatgaataaagaatactccatagatgagaaatcaaaggagaagaaaagtttaaaaaatatatgtgaaaataatctataaaatagtaatgttctatcagactcccactcactaaaaaaatgaaaaaagtgtggtttctatttagtccctttggttgtaagtaaatgatgtgtctagtctgtgccaaacactgtgctagcttcttagtataaaaaggtaactaaaagcacagcttcactcaaacataaattatgatttagtatgtcttgaaggtatcattttgcctgacagtataagcaaaaagcagaaaatagtgattgattaaccttattttgtagtgatgcaggaatctaataaacccaaattaaggattgaaatgaagataacaaaattgaagtaaccaatatttctggttggagcccacttttattacagcgctaaaaatagtcattgacataagaaaggatagatgaatgccatcttgttattttccagcactgagataggtttagatgagtatgtcggagataggaacattaagaagttggtagccctcgcacatatgatgaataaagatagatcattataaatggcttcaaaactcttttcttcgaaggttcttactgggcttattataaaaggaacaaagattgttagaagatatgctgtcttcactgtctcaaaaacaatactttttgaaaccttctcaagaatatagtgaaatggataaagaacctctctgagaaactcctgttgtcattggattttgaaagttgtcataaaccacctctgtacctaacctaaataatgaatgttgttgtctttgttgtgtttaaaatataagtattgctaccaagtatattacaatattatgctgtatcactaatgtaaaattgtgttttgttaaaacaaagttatgcatttttattgaaaataaatatggaataatataaatgtttagaagctggttagaagaaattattcatctttttcatagaagttcttgttacttcattaaaaaattcatttccttaaacacacacacacacacacacacacacacacacacttccacacactaatcagtttctgtgaacaggtaactttgtagtatcctatttgtatccacatttatatccatgttattagaaattctaataatcttatttaaaggtagaaatttccaagttaaaaattaatattcaagttaatgaaaaaataatttgtttagaatttccacatgaataagacataaaaataataagtataatttataaaagagggaataaaattgcaaagtacagaaaaaatataactgtagtagtcatcaaagaaatgctaatttaaacatggacacaatttttcattcagcaaaattattttgcaaccttttaaaaaataatatgcataataatttttaaaacatgcttaaggaatcaatcaataattataaatatataaataggatattagacatctaaaacaaacttaaaaaaatatataatgtagaaaaaagtactatatactaataagtgaaaggaactgtagaattataaattactatacgtatcatattatgaatatactataattatgttataaatgttaaaagtttaaactagattgaagtaactataccaacatgttcaattagcagtgtttaagttaacggtaggatttttactgtgtgtgcgtgtcgatgtgtgtgtgaatgtttgtgtggaagtcacgtctatcttttttagtaaaagcagttgcttttatcagaacaattcttgtccgaccaaatcaggaaactccaaaattcagctaaaatatgacatatgcaaaaaacaataggtgagaaaatactttccaaaaatactttatgtaagtggaagtgataattgttgtctttgcaatgatcaagaatgagccttaagtgaagtagttgatacgaacttttattttctttcctactttctttttttctatatttcttcctccctgtcaacaggtgtctgcccttttttcacgtctcaaggaattaattcctatctcactcttcttctgtcatcaatacttgccttttgatattaaggccaggtgaattgctgatcactccctgcacttggccgctcctatcttgtcttgcagccacatgaattaggtactagtaatgaaccctcattggagagtctgagcctcagtgattctgaattctgtctccacattatgtatcatttgggcagattttcataagtagggtcatcggctgcccacttcatgcatgctttcacacctccacccctagaatctgatccttacttttctggaatatggttcaggcatagacattttcaaagctcctggggttgtttggaggcccagccagctttactaactcctggcctaatcctaccaatagaatctcattctctttgctacagtgcttgctgcaagcttgggaagctctaagccattcagtgaccagccacagggactggctcaggaaccttctgagccaaagagacaccatgcaagattacctgaggaacttctcagggtgaggatgggagcagaaacttccttttcctttcctgaacatttcagaagtgaccgtcaattcctggaaaccttggccatcttgctccctctgtgaggatgagggttgacctacaagaattacagagagaaggaggcagaattctacatgggccaaggcgggtcacagctctatgtttaattttttagatcatctgaaccaaaatatatgcatttttctggtgttagttcaagtttgatttttctgttaaaacgagtacattccaatgaacacagtttttcttcacacagaggtgtaaaaaattgatatgacataatatgatcctataaccagaggtattttcattttaataaaggttgagtaacttcctactaaataataaaccttttatggtagaattttaagcatcggcaagctgatgaggtaaagagggtactttcctggcatttctgaaatcaattttaactaattgaacacttaacaaaaatatattgaaattgaaggactctgattcgtacctcagtcttagcttttcacttacctcgtgtatgacttcagttaaattacttaatttcagctgggcgcagtggctcacgcctgtaatcctaacactttgggaggctgaggcgggtggatcacaaggtcaggagtttgagaccagcctgatcaacatggtgaaaccctgtctctattaaaaatacaaaaattagccaggtgtggtggcgcattcctgttatcccagcaactcgggagactgaggcaggagagtcacttgcacccgggaggtggaggttgcagtgagccaagatctcaccgttgcactccagcctggcaaccaagtgagattccatctaaaaaaaaaaaaaaattacttaatttctttaggtttccttacttgtaaaagtgtaactatatcataggattctagtgaggataaaatatgaaataatgtgcataaaatttattagtgtgcagtggctggtgaattaataaagatgggacattctattttattataaattgtaccttaccatatgcctatatgctttgttcctcttagtaacatagtagagacctaaaagccctaaaatcaaaaagtaaaggaagaggagaaagaaaaagtttatgttagcattgctgtttgagtctccacagatgtatgttcatcagtgcttgcctattgaccagtcttttatttgatagctggtagacatgtgaacacacgccaattgtgtatagactcatgacaatgctacacctaaatggtctcgcttatccgtgatctttcacctctgaccggacgtttgtatcttttgcccccaacgtggcagctaaaaaggcaaaggagaaatgttttaaagctccaaagcaaagcttggttctctgatgcttgcagacactgtctacatacctagctccatcgactgcatctgtgaccttgtctgtctctcctcctggtatgaaatgattatatgtaggcagagactttccaaacctgccaacactttggataattgttaaaacaggtttaatgtgtaggtgaaatccaaaccaaaagttaggacacagaaaagtgattcagggaggtgcatttatactatttcatttgatattaatgaagttttaaaaactgagattatgtcctagagtaacatatgtttgctctcagaaaaatcactagataagataagggactatttaggagtaagttcctgagacatctggaattttctatcagtgataccgttccctatcagttaaaggtaggctacagttttaaaatggacaaaattctgtgtatgagttttgagtaatagatactgtggctgtattcttaaaacacagaatgctccagtaataggtcagagtatttgaagttttgaaacatcctagtgaagtttgaactacacattgctgaagttaggactgctgtcttctacgtggcacagctgaatttggtagatgattccaatgattaattttaatattaaagttttacattttaaataaaacatgatcctgaaactagaatatcacatcttcaaatatttataaaacgctgtgtcctaagtcctagcaattattgtaagacacataacattgcctgaaattatttagatggacacagtgaatgtttacgtaaccttttaataggaaactcgagttttgtgttctcttcaatacaagctaagacacatttctaactaagttgatatttaaaatacataccacctaagtgaacactttgtaagttcaaatttggtattattgtgaaaacttaaaaacatcaaatatacctttgaaagtttcaagtgaatattgactcctaaatgagtatgaaacagatcagacaattccaaatctctatttaattcaacatttatttatactactaacatcatgggagaaaaatgagtggttctgtttttcgttttgttttgtttttttaacaaggtcttgctctgtggctcaggctggagtgcagttgtgggatcacaggtgagtgtagtctcaacctcccaggctcaaatcatcttcccacctcagcctcccgagtagcagggaccacaggtgtgagccactgtgcctggctggttccagatcattttaaagaaattaagatgtatttatttgttttattggcaattcttagttttatttaggaattgattctcaaagtaaaggtgctagcaggatatggaaaatgaaatatgggaagaaaaacttaaacctatttttaaaatttttatctacaaatagaaataaattaggaaataattcggctttgttcatatttaatatatggatagacactggtgtttccacttccatatgtcacatgatcatattttatgtgtggtgccaaggtttcccagggagaagatgggttgactacacacctattgtatttgtcttctacgtcttctaaaatgaaaggtggctaaagaagattcttaaaaaaagtctcagaaccagtcttacaataaaaatgcaaacaaaatcaacaagaaaatgacagggttgttatttatactcccaatacaaactctttctttgtcacatcatgaggtaaaaatcaatgatgatttacaagagattgatcagagataaaaaaattacctagaaagcaatttgaaatgtgaattcatccactattgttattaaatctgactttgtatgtgtattattgatgattagctagtgttcgttttagaatggaaacaatgtgtagaaatagaagcattatttttcaaaacacacattttgggagaatgtaaactcaaaattgtatcgttagcattgcacaatctaaaatattcggagatgagtaatgtagcgccaaagtatattaaaatgatttcacctggtggctaaaataacaccaaaaacaatttatagacattttataatttatcaatttctttttaaatatattatatattaaattacataaaagctttacaaggttgatgctgttttccccactatataaatgcaataatcaagattttgaaagattacaacttgtccatgggcgtaattaataaatagaacagcataatctgattgctgatcttttgattttaaattctatatttttctagcttccagttttagttgcacacaatctacttagctaaaactgaatttggttaattgtcaaccaagactccaaaacatctttgttatctgatgttcttcatttttactttttaaaaataattgaaatgtcactattatattgacagtaaattcaccagttgttcgatgagattaaccttcttaaaggatgatcaaagcatgcagtgaagggaacctgacggggtttgactgctcagtttatcactgaacagggcacaggtaggctgagtgataacaccactcgtctctgatcagggactcatttgtgccatctggattagcaaagatttcccttccatttctctgctccctgcctcccacaggctatgactatgcttcttgtggtttcatcgcttgctgctgagcggtgttaataactacttgacatttggtttcccaatgatgttcacccaatttttctctaatatacagattctctgcaacacttctcacagtaattccagtgctgtagatatttcttggacatttatacaaaacatttaacttgtttccctgtaatagatagtgtaagttaaggttcacaaagaggaacataatttgcaaattttaaaattgtcctccctttactttaagtaggtaaaaataaagatgcaattgaccctgtcgatattgacttcatagagacatggatattaatatgtaaaacaataatctaaaatgagttttgaaaagaggtataatataaatccttaactaattaaccttgactatcataagtgcattcacatttcacttgcttatagtccatgacatggaaaactactcaatcaatagttattatacagaaacatctgaatcaggcataaagaatttggctaacatcaatcctttatgttagtgaaaactgtaaaaaatttgtataccaccgagaaaacatttaaggttttattaagaaggttttattaagaagtgaactatttttaggtaaactgtgaatccttgggaagaaaatgttatctttctcttttggagtggaggtgtcaaaatttacaaattagggtcaatagtagactagagtttgcttcacagtgaccaagctgaagttttctttatttttccctccctcccctcctcttccctcatctcccttcccctcccctcccctcccctcccctcccctcccttcccctcccctcgcctcctctccgctcctttcccctcccccctcccttcccctcccccctcccctcccctcccctcccctcccttcccctcccctcgcctcctctccgctcccttcccctcccccctcccttcccctcccccctcccttcccctcccccttcccttcccctcccctcccctcccttcccctcccctcccctcccttcccctcccctcccccttttccttccttccttccttccttccttctctgtgtgtgtgtgtgtgtgtgtgtgtgtgtgtgtgtgtgtgtgtgtctctgcctgtctttctgtctttttttcaaggagttgaagtttcccaggcagttggtttataggggggactctctggttcatgggcaatcgaatttcttacaacatagtctatgtgctgaggtggggaaagcatgggagatttggaatcagacagagcaaatgagctcattttaatccctaactaactttgtcacttgggagaattatctgctttatctgagtcttagttccttcctctctaaaatgagaacaatgataacttctctctctctctctttttaacttttgatgtttcattgattgtacataaaacctccataataagagctgagttcagtccaattgttggtgaccgtgcaaagctagacagtggtaaattcatcagggtacatgccacttagtcacactaagtctttgcaatagaaacttctgcagagaccagtctacctttttttgttgtctttagagcaatttaccaaatcattaagaactttgcttttcttaacacttgccatcttcatactcagccagaatgttcttttcaaacaaaaatgtgattttgccactccctgttaaaaacccctgaatgacttcctgtcattcctgagacaacagcccaaatcctgaatacaacttctagggccttccttgtctgacctcatccgacccctacagaaacagagccatgatccataaacgttctactgttcacctccctgactgtggaaagtgattgtccttcagtcttgacttgacccagtgcatttctttaaatctatatgtaataatcagaatataggagctgagcacagtggctcaggcctgtaataccaggactttgtgaggctgaggtggaaggatcacctgaggccaatagtttgagaccagcctggcaacctagggagaccctgcctctacaaaaacaaaacaaaggaacaaacacaaattccccccaaaacaggtgatgagaacgtccctctggagcaaacagaacaacctcaataagaagagcaagtattgctaagagtcacctaaaagcaactgcaaaatgaatgtgaacttaaagtaaaagcaaataaggtagacagggacatttctgttgttaccacctttttctaaagaataaaaatgtttttaaattattctttctgcctttttacaaactaacaaaatttgatcttcctggggagtgggaaggagggatgactcatactgctgaaactcacgtgagatcaatttgtgtgctctaagatcaatttaataatttacactggaaatatctcttcaaagtaggtgtccccactgggacattaaattagcattggaaggcttgcttggcgaatattgaggctgacttaggcaggtgctgagaggcagataagccttctgaacgtaacaggttgcctgtaggggcaacttctccttagtgttttgaagacatattatgatttttctcctccccacaatccttgtttgcaaagatatgagcttattttccaactcattcttacctccatgttgacctcaggaaaaaactgaatgcttcagggagagagctttcaacagacgctcatcttttcttaaggcttgtgacttctaatcacaagcctccaactaagcaaaatatgcttacatacacagatactgcctaaatggggagattatatttagatatatttgagcgcatagagttgatatgacaagattctcaaactaagtaattttcaagtttactagaattttgctgcttaaagttcctgttaatacaagaaaggaccagaagatatctcatttgagccttggaattctaactttgtgttaaaaattattgttatcttacctggagaaagacatctctaaatgctttgtaaatgttacatctgcttaagtagaagtataaaaatagttgtctccaaaaatttaaatttgtattaaattttctcttatgtcttaaaattagaaaatcgattcctatgcacttaaacaagtgataaagaatttgtgttttgggccaggagcagtggcccacacccataattccaggattttgggaggcctaggtggaggattgcttaagaccagcctgggcaacatagggaccccgtctctactaaaaattaaaaaattagccagtcctggtggtgtttgcctgtgttcccagctactctagaggctgaggtgggaggattgcttggacctgggaggccgaggctacagtgagctgtgactgagccactgcactccagcctgggtgacagaatgagatcctgcctcaaaaaaaaaaaaaaaaaaaaatttgtgttttcttggtttgacctttggagtgtacaagaaggcttggaagttatagaaaagttaattgtttttggtgatttcagaatatgtacagcaggtcttcaagtctttgataggttcttagaaactgtgactttaagtgaaaggctgtatagcaggccctcagataatgttgtttgattagacgttgttttattataacgttgatgagaaaaaaaagtgttttattttatgccattttacttaagtcccagtttccaaaaaccttaaggacttactctatttgaaaaatgaaatgaatattattaatattaatatttgttgactgaataaagctgtgtaatagcccaataggctaaatgtttaaaatcaggaaattacaattactactgtattttacagaactgtaggtcacttaattacttttgtaatctgcctataagtgtaaaggcaaagggtagagtaaaattagtaatttttttttttttttttttttttttttttgagacagaatctagctttgttgcccaggctggagtgtagtggtgcactctcggctcactgcaacctctgcctcccaggttcaagcgattctcctgcctcagcctctggagtagctgggattattggtgcgcaccaccaccctggctaatttttgtatttttagtagagatggggttttatcatgttggccaggctcgtctggaactcctgacctcaagtggtctgcccgccttggcttcccaaagtgctgggatgacaggcatgagccaccgcgccctggcagatgaatacatcttatgccatatgcctgaccactccctcagacaaatgagaaccaatgtaatggctgaagaaatggctgcttttttccattgaccttggtgcatagtttctctcctctccttacacaaaaagtaaatttaaatgaacaaagttaagaaggcatattttatgtttataaagctttgattcatggtacaaaatacaagttttcttggagaaacagaagctatttaaaatgtagaatgcagagagttgcattgagccacattccttcttttatctatctcatgggaattaacagacaatgaaaatattgactgtgtttatgcttaattttccctcacccttaatacatttttctgttatgattaattactttcctgtaaaattttgaatgaaattatttaaagagtgctatagataagtgtgtttttactaattttcattattcaccattgtggtataaaatcaacaggtacaagtcaaattaagccctgctgtctgcatgggtactcattattaaatatgagcgatttgggccttcagcaaacgaccatttatattccaaatcgtatttaaaattaatttactcttttatcagaacaaagaaaatttcacacacacaatctcttttactaaaaaataaattttatcataggaaattatctcattttatattccagagcagaaacatacaaaggtgagatgaatctttgtacaatatgtctttctgtcaaacattctaaaacattgtcaatttcattttttctagtattttcaatatttattttgtgtttggcaataaacggagctaatacgaccacttttctcttatgcttggttattattattttaagaaatgaaaacttataaatcatatagcttggaagattgctggcagaataagaaaaaataattttatcttttgtatacatgaaaagtttaaaatatcaaactataataattagtaattacatatgtaacctaggttacatgtatgtatgaggtatggctcacacccatcatcccaggattttgggaggccaaagttggaagattgcttgagaccaggagtccaagaccagcctgaacaatgtagggcaacacatccccaggcctgggtaattttttatggctccatttaaagaagcagcatgacaatgaaccttagatgtcatccagttgagttctcctacttgagcatgaatcccgtcttaaccctcagtttagcaaaccctatcagttatggagagcagataaatctcagcctacttaaacatgaagacagaactcagaaacagttcttcaaggcgctgccccttgttaagctggttctttaagaagcttatccgccaattcacaattctgaagcacagcaaagctgtttctgtattggtgttaattatttattaatgcagtgaaaacactttaaattcctattaaattgtcactaattacttgtgaactaaaacgtaagatgtttagttttttgcttccttctgagaaaatatatttgtatcgccatctttgaagtcagttctactgtaaagagcgtgtatttgggaatcagaaaaaactagatcgaaactgtttgtgttttattgggcaagctacttaaacactttgaacatcatcaggtttttaatttatgatgtaagaagttcagacgaatgaactgagtttatttgcctgcttaaattaaaacatatagaatccctatgtttcccccagtctactcaaatgttttcattgcagtatcaatgccaagaatattgtcactgcatagcaaagcattggagtgaagtagctgatatgtattggatgacttagtttcaaaagctgtttttcctataataccgtaattccttcctcaaacggaggcaacagaaattgcagtagagttcccttgccaactacaaaatgttccatttcattctgcttttctccatttcctagaatcagttacatcaatttgaatctaactagactaagataaaacatgatgaatatgtttgtgaaataaaaacttgacaataaatccttaagatttttctaagaaagaagtttatgaaacttcagagaataggagaatatttcctaataaaaaatagaaagcatgtaagaatatcttctgtcttttaatacaacaaaccaggggcctgcaaactgtatctcatgggccaaattcagctaggtgcttttttgcgtagcccttgagctaaaaatgatttttaaatttataaatgattgaaagaataaaaggataataatatttcatggtgcatgactatatgaagttcacgtctcagtgcctataaactttattggaacacagccatccccatttgtttatgtgttgtctatgttactttgagagaggtgagtggcagccacagaaaccatatgtgtccaataaagcctaaaatatttgctacttagaccttcacagaaacaatttgctgccccatgttcaataaacagctgaaggcagggatggtatcaaatctcaacacctgcttaagtacttgacacatagatctgcacagaatgagtaacagcagaaagaatagatttaaaaaattaaaattattttctcattataaaaaggaccaaatatctataatttttaaaaagccaatagacttacacataagatctgtaatgtaaaactactagaaaaaacacaggtgaatatctatgaggtataagtctgggcaatgattattttggatttgaccccaaaagcataaacaataacagcaaagatagacaaatgagattacatcaaaataaaaatgtcgtgcacataaaaggaaacaatggaatgaagagacagccctatggattgggaaagaatatatttgcaagccacatgtctgataaggggttgatatcccaaatatataagaaactcaaacaaatatatagaaagaatacaaataatttgattagaaaatgggcaaaggagctgagtagacatttttcaaaagaagacacaaaatgaccaaaaggtatatgaaaaaatgctgagcatcattaattatcagagaatgaaaatcaaaaccacagtggataccacctcactcttgttaaaatgactgttgttcccctccctttgtgcatgtgttctcactgttcatcttccacttataagtgagaacatgagatgtttgattccctgttcctgcattagtttgttgaggataatggcttccagctccgtccatgtccctgcaaaggacatgatcttgttccttttgataggtgcagcaaactaccatggcgtatttacctatgtaacaaaactgcccattagcacagaacttagaataaaaattttaaaaaatgagtgttatcaaaaagaaacaagagaacaagtgttggtgagaatgtggagaaaaggaactcttaacacactgttgatgggaatgtaaattagtacaagcgtaatagcaaacaatatggaggttcctcagatattaaaaatagaactgccatatgattgagcaatcccattactgggtatactgggaactgaaatcaacatgttggagagatgtctgcactcccatggttagtgcagcactattcagctttacaaaagaaatgttgtcatttgtgacaacagtgaaattggaaaacgttttgctaagtaatataaattaggaacagaaagtcaaatacgttatactctcacgtatatgtggaatctaaaacagtcaaattgaaagaagcagagagtagaatagtggttatccgagacgctgggagagaggggaatgaggagttaatggtcaagggtacaaagctttaattacacaagagaaatacattattctttgggatatattgtaaagcatggtgaatataggaaataacatattgttatttcaaatgttctcaccacaaaatatggtatttaagatgatgaacatattaattagcttgatttaattattcaatattgtattcacgaactataacaccagtttgtgtcacataaatatatacagctataatttatcaatttacaattaaaaaataaatgaaataaaattggatttaaatgaaacagtgaaaagtcttcatatagatgacaagcacaataacttcattttaaaatttataataccatgaacataggaattcccaggagaaaatttaggtttatgagactatatccattgaaaactctgttggacattttttctgaagttgttcagttttagacctgaaacaattatcttttatcatttaataaaaatggattagaaaatcgctctgtataattaatagtttgacctagtcttctatgatggtttattgattgtttcaactccagagctggctagcaacatgaaactctcatggaaaacctgtttataatgaaggatgcttctgaaacaatatacactattatatcttgattgatagttaacatttagtaactaagtacactagtacatttgacttacaggccatcattttcccttaggagacagtaactttgagtctatcccattcatctcctctagaactttgtcaaacagaggtatatatggcttttgatgctctcctttcatttcacgttgttctttcatgtttgatttgcttaatgctcattgggtttctttttaattcctctaaattatctaatttgaaaaaataactattattaatatactctcaaaaactgtagaaaaaataatttctaaataatttaaaaggtaaaaaatatcaacatggagaccttccataatgtaaaagtggttctttttttaataaagccttttctctactcatttaaaaaagtggagttggaggggctgcctttcaaaatttccacataaaagcaaccaaaaatttgttctaggaggagcactgatggcagtttctgaaaagatttccgtgacaccttagataagagtgaaaaaatcaaccccataaggaatttgtcttcattcactccatactttctggactgggctttcccttctggctagtgattagagctgacagacaattcgacagaatcacaaagtggagaagttctttttaaatacaagttaatggttttgtaaatttagtgccttaagcaaaattgaattaaacattcagtcattcatcttaagcatccttaaaaattgaaagcttcacaatatgcccagaacccagaaattcaagtaacttttacccagagcctacccagccggactgcgcaaaggactgatgagacgaaaggatatttggacgctgccctctaggaaaggtagcctagaagaggagaggacactaacagactaacgactccttcagaggggaggaccacataatcagccaatgtcagctggcccagatccaaacagctttctgcttatgcaaaccttgtgtggtcgttgtgttaactaatgcaaagatatatgattaatgtacttgtcagtgtcctgtgtttagttttctcacaaaacatttcttatataattgagataattactttcacttacaatgccattggtttaagttttaattgataatgatgactttacttttcagtttaccactatagacttttatttttagagtaccattcagagtcagagcctgaaccttagagaattaaactcacttaagattgaagtagtagtcatttcatactttgtgtatttatccatgttttgagctaattccagaatgttgtcagtcatattgggatgcgatatagtaatttggtttttaagtatgattttggaactctaagttactaaaatagtagcttaatttttgttcaccaaaagaatttataactgaaacttccattagagattatatgctttttatttactacttttagccattaaccaattaattataaaatatagagattttatgttttcatctacatatacaaaattaccattaagatgaaagtaattgaattgattgcatattcagttatagaattccaaatttaagtagacacagaaagtcataagtttacatctaaaaattcacgaggtagtcagtcatagtcactacattttagccaactatggaacgtgtactatcatgtactatgagtcagtccctgtactgaagatatcaaaatgaatttgacaatctggtataaaatccaggactattatttgtactgccagcctcagggagagatgaataaaatggatttgtaagttagaggctgcaaaaactgttttttttggtttgttttgctttttgtttgtttgttttcctgcaaaagcatgtattcagggtacaggtggtggttctacccttccagttttctaggctggctgatctttataacttgttgttcataaagatgtatgtaaataagcaccatgtctcaaatttagattgagaattgttctcccagagtattcaaatttttaagagataaaacaattaaaatctaaaatatgtgataatctaaatacatattatacccccattcacccattaaaatattttttcttgctaataaaagaaaaaatcgtttttatggattttcctatccctcaaaaataaggacaataacattttgcctatttttaaaagatattggttagatgaatcttgtagatctagctcaattgttcccattctagaaagcttagaattattatcctgaaagcagaaataattgttaaaaatgaaaacatgaaaactttacataaatgacttcattttcacctcgtaaactttattgcacagcaccgcactccagcctgggcgacagagtgagactccatctcaaaaaaaaaaaaacaaagaaaagaaaaaaagaaaaattttattgatttagaatgcttgacagagcaaagtgaagctgtcctcacagggttagtaagtattctggacagaaacatagttataattaagcattagtcaggctgtattttgacctacttccttacaaccaaagtcacatagcactagatactgaccatttgcatcccattgcttgtatagataggattctgatgtaggatagataggatctctgatgttggaatcacaaggctttttaggaattgcttaagcagatcctaaattccagcagaacagcggaccccagccagtttgaagacactcacagaggaactgagtcacctgagaatagtttctttatctccccattccatgacctcaccctgcactcttcaaccaattcatgatctccacactttgggctacttcagagcctgtgaaaaccctagtcccagactccccaaggtgatgtgtgtgaggttttctcctgtctcctcctttggctgccctgcaatgaaacccctttctttgctgcaaactggtgtctccatgtattgacttgttgagcatcaggcaacagacatatggttacaaaagcagaattttctcttgagtatttagagagctcctaggctgttctgattccaggcagcagacttcaggaggtagcatttctaattttctatcatgatgttaagggaaatatgctgcctgataagtgtttggatattggatattgcatggttgtcccatgtcccagtaaaacacacatttttgctttgtcctggtaattaacaatacaaacaatataaattaatttggccacgtattttagtataaataacacagttacaaataatggtctgtttgtcatcctgtcacctaaatctaaaataccgagatccagatgaaatgaaagagtgcacattttaagttgcataaattatatatatgtatgaagacttaaagttcagattttcagaaaactaaaaagttcttaatcatttttagaaagtagatcagcaaagtactgagttattttgtataaagattaaagcaggtattatctgtgtgtgtgtgtgtgtgtgtttctgtgtgtgtgtttgtgttgttctaatattaatagaaacaatagaaacaatatttctttaatattacttttcaagaagatagtaaaagccaagaagtaaaagtgttttaattcttgagctgttaattcaatttttttcttgaatgattgaatattatttccatcatttgttcattgtaacatttcccaatacttatagatgatatatagaaaaacaatttaaattgaaaatcattaatttcccagtgcatttcctaatatatctatattcagatctgtatgttttcttgttccataaagaaaaagataccttcgtttttttcaaattaatatcaagagcattaagttttattgaactaataatcttcagtgttgtctatggatttaaattccattttattgccattttgggagactaaagacagaaagagaaaaggaagaaatatagatgggtgatcaaagtaggtaaaaccataaagatgtgtgaaataaaagtgaaatagaagaaagagatagccaaatgaggaaaacaaatcacagaagagaataaaggcatgtaaagcatacaaaactagaaaaagtgcaggaaagagaaagaaataggtagataatatagaaaaagttttgaaagtttcagtaaatatgataaggattccatgtaggtaataactatcagagagttataaatttatatgtacttctttgaaatgtatagtaattggcattaatagcttttaggttattccaatgtttatttgtagtgctatactcataagcataccttctataaataagcacattctttatgctagaaagataatgaaagctctatctggtaacttgttttccatgttgaatgctacaaacacactctctaaacgtgttaatgtgaatgtgtgtacccttgcatacacagacacacacgtaaataaaaaaaactttattatatgaactgctagcacaaatatgtgtattttgtttgaagaaatactctggtaagtttcttgacacttactataaaacgtgagatgctgtgagcatgaaagaaagtggtcattaacatacccaaaggaagagatgatccttctatgctataaggaaaggaaactattggttttcttacagaaaacaggaggtagaatcaaagaataaggcaagggaggacaagagaaaaagacagtctgggactttgtgaagagccactatttgcaagttgaatgtggttttttgctttgttttgttttgtttttcttgctattattgagttattgttctgtgtttcttcacgagtcttcaaaaagtctatactgttcacagtgcttggagtgacagggttttcctgcagaaggctacacattcaagcataaaaaaagaatgtacagcagcttagctcaagaaacagaagatattactagtaaatacatcacccccacagctttaataactgcccaccccctgcaaaaccttaggaaaagtttggaaaggatttgacatctataatctgtaaagttgcagtaacagcagagtctcaaggcaattttgcctaaatttctgagaagctgagggtcatgaggttgcaaagccttctgtccagatgtggggctatcaggggatttggagtttagctttgtttggttgttccctatctcatcaatttacttttcacaaaatctgcctctgaacgttcgatccactgtgaatatgtttgaagcatgtttttgaatgcatgttcaacactggagaaagtagattacagttctgctcttggacagctctggtccagcactgcaggtggtgaatgtaagagtgatagtgatgtgatctcttagagaagaatgatgtgttaattaatttgaggaatggaagagcatgcccttgacagtcactgtgacttgagtttgcgtgctagcacctccatttgagctcagatttatttaccttgtaattcctgtagaatatagatgatatgctgtacttcaaaatttcattgtgaatattaaaagaaataatacggccaggtgtggtggatcacgcctgttatcccagcactttgggacacccaggtgggatcacttgaagtcaggagctcgagaccagcctggccaagatggtgaaaccccatctctactaaaaatacaaaattagccaggtgtggtggcatgtgcctgtaatcccagctacttgggagggtgagccaggagaattgcttgaacccaggaggtggaggttgcagtgagccgagatcatgccactgcactccagcctgggcaacacgagcaaaactccatctaaaaaaataaaaataaaataagatagaaataatacacacagtgttcttagcaaattccttggtgcacaattatatggtagttattattatcaaaattataaagcagaaaaaagtctcaaagccaatgattatttatttatttattttagagttggagtcacggagtgcagtgtcacgatcatagctcacagcagcctagaacccctgggctcaagtaatcctcccatttcagcctctgaatacctaggactaaaggcatgggccaccatgcagctaattttttagttattttattttattttattttattttgtagatacagggtctcactttgttgtccaggatggtcaccaacactggcctcaagcagtcctcctgcctcagttttccaaaatgcagggataacaagcatgagccactgcaccaggcctgggaacttacagcctagtatattccgcaattatggagggggtacgacttatgtgaaaccttcaggaatgcatacccttttagagagaaataagtcttaagttagagatgagaaaaagcatgggaggctaccttctgaatattgaaggtaggtgtaagattataatggtagagaataagttcagatatgaagaataggcctaggttatggcagaccttgaacttcagagaaattttagctaaatatgaaggttagaaagagccattatacatttcagaccatggaagtaatataagctggtcgtttagaaaatttcatcaattgcgttatgcaagagtaactgaagttcaaagagatggtttttgagaaggtgactggaaggatttgcagttatcaagaaatgaggtgaagaggacttggagtaattttggctgagaaaaataaacctttacatacagctctaagtctataagaacaaagaatatataacaatccacatgtagagtataaaataataagaatgctatcagtaaaacaatagtgaaaaagaagcatcacatttagtccataaattaaatcgtgtccttaacttagtataaaaagatctaaggattatggtataaatattgcacactttttatgtggtggacatgaaagcaatttctgtgagtttaaccaatggaaaattggtactcttggataaatgattggccctatacttgaaccattaaaagagagaacattaaactaagtagacataattttgagagttccactacattaaaattgaagaacagcttactaaaaacagccagacttaagggtaccatattgtataaaaatgttatattttccatattataaatggtttggctgatagatacttaagaggaaaaatatagccagagtcttttaggttggccatatagtttcaagttttcaagttatcgaaaatcaacccatttatttatttaaaactcatactcacctgcttggagacataatttggaaatttataagttgtatatacaacttcataaaatctgaagaaataaatcaaaataggcattattgaaaagcagcaacataaatgtatgtcattgggattctacaatgggtttgctgtaattatatcgtacattgatgttaactctcagtttcctgacagctaaaacaaagagaaaaaaatattataggtattaaaatgtttatacaaatcatttaaatctgcagagacatgcatgcttgtatttaagtgctgagggtggactgttcaacataacagatgattagctttcacctgaattttacaaacatgctatttaaggcaacaaatacattaattctatatagaagttaagagaccatacttcagtggagggatttccttaagagaccagcagacccaacattccaggtcaacagaatcaaagcaaatgctgtttataataatacaatttagggatagttgtggtaaattttaatgacatttccaaaaccaattggagcctatgcaccttaatttgaaacattgtgaaatggactcaggattaatttgagaatagaagaaaagaagactattccataatttcttttacagaaaattatttatcttctttccatttaagaagacatacatggtgaccgggcacagtgactcacgcctgtaatcccagcactttggaaggctgagacgggcagatcacaaggtcaggagatcgagaccatcatggctaacatggtgaaaccccatctctactaaaaatacaaaaaaaattagccaagtgtgacggcagatacctgcagtcccagctgctagggagggtgaggcaggagaatggtgtgaacccgggaggcggagcttgtagtgagcccaaattgtgccactgcactccagcctgggtgacagagtgagactctgtctcaacaataacaacaacaacaacaacaacaacaaaaagatatacatggtatcatttcaagaccactgcctacctataatgtccaaagttgcatgaatgatctccaaataaatgcacatgtacattcacagtggtgcaaggaattttctggaaggagcaaacataaacacgggagggacagcctgtgtgctgggtgtggaagtaaccaaagaaattgttgtggtattgtgaaggaggttgatggtaaacctcttgtcaactaatgaaagaggaatgattatggctaagttgtaagttccacctccctcctcatttccaaaaatttcctgttcaagctacctcgtaggacttggaaaaggtacaactcttcttccactctttctgaaaaattaatgggagtctgttttccacaaggatagaagaatattatcctgagtagtttgtcagtggttgtagtggataatttttagtgtacagcaaaaatataatgacatagtgataggacaaatattttctgcaaagcaaaaagaaagtaaggcatcatatacaatttgttgctacatgacaaaatgaaagatttaaaaatttaaaatttatgcaccccttttcagtcccatataatagaagtttgttttgttattatttacagatgatttaaaaatatttagacaatcgcaacttctgtatccatcaatttggtaaggtaatattaaatgacacaacttgtcaactaagttagtcaaaatggtttatatatgtgatctttcattcacttagtcaaaaatcttaagtgcctattgtatggcagaaatattaacagctgacacatatagtatctattctatttcagagatagtattaaatgcctgatgtatattaacacatttaatcctgacaaagattcttcaagatttatggaaggaaaaaactgaagcaaaaaagctaagtaatttgcacaatattgcgtatctaaaacgtgttggagttgagatatgaaaagacagttcaacgttagaggccgaactcttaaacagcacggcatatggcctcttgagtcccgagtgataagctcagaataaaatgtgggtcaaaccatacaattccagccataaaagtgatgaatgtagagctcttaccatcaccatcatcatcttattattactatgttattactttgctcttacagacatgtgctatacttctgttactagaaattcatctctggagacatatttgttattcaaacaggtgaaaaagttatccccataaaaatatgacctttgtaataaatgtattattcaacaagagttaccagttttctgtagtatagcagacacagcttttggctggtagaaacaggtaagtacatgattaaatctaaagtaataggtactaaagtaatggtattgagattcagagatgggagaaactaggtacacctttgtgtgcatgtgtgtgtgtgtgtgtgtgtgtgtgtgtgtgtgtgcgcatgcatacatgaacacgtgtcatgggagacatgggtagggattcacaaagggattgagaaaatcaaaagtgatggggaaacaagagaaaagaacactataggaaatgacacttaggcatagcttttaaatctgttttcaaacatgaacaaaaattgagagaatgacataataaacactcatgtacctctcatttgcctcaattataagcaatttgccagtctcaaatcatgtaccctcctcagtttttaaaccttattttaaagtaaatacaaaacagaagttttttttttaattattgtagtaagcatacaacatgaaatctacccttttaaaattttaagttcacaatacattgatgctagctataggtagaatgttgtacagcagttctgttgaacttattcctgttgcataactgaactttatactggagcaggtttttcagtttccatgtagttgagcagttttgagtgagtttcttaatcctgagttctagtttgattgcactgtggtctgagagacagtttgttataatttctgttcttttacatttgcttaggagtgctttacttccaactatgtggtcaattttggaataagtgtgttgtggtgctgagaagaatgtataatcttgatttggggtgaagagttctgtaaatgtctattaggtctgcttggtgcagagctgagttcaattcctggatatcctttttaactttctgtctcgttgatctgtctaatgttgacagtggggtgttaaagtctcccattattattgtgtgagagtctaagtctctttgtaggtctctaaggacttcctttatgaatctgggtgctcctatattgggtgcatatatatttaggatagttagctcttcttgttgaattgatccctttaccattatgtaatggtcttctttgtctctttcgatctttgttggtttaaagtctgttttatcagagactaggattgcaaaccctgctttttttttttttttccatttgcttggtagatcttcctctgtcccttttttttgagcctatgtgtgtctctgcatgtgagatgggtctcctgaatacaacacactgatgggtcttgactctttatccagttttccagtctgcatcttttaattggagcacttaggcaatttacagttaaggttaatattgttatgtgtgaatttgatcctgtcattgtgatgttagctggctcttttgctcgttagttgatgcaatttcttcctagcattgatggtctttacaatttggcatgtcattgcagtggctggtaccggttgttcctttccatgtttagtgcttccttcaggagctcttgtaaggcaggcctggtggtgacaaaatctctcagtgtttgtttgtctgtaaaggattttatttctccttcactcatgaagcttagttcggctggatatgaaattctgggttggaaactcttttctttaagaatgttgaatattggcccccactctctgctggcttgtagaatttctgtcaagagatctgctgttagtctcatgggcttccctttgtgggtaacctgacctttctctctggctgcccttaacatttttttccttcatttcaactttggtgaatctgacaattatgtgtcttggagttgctcttctcgaggagtatctttgtggaattctctgtatttcctaaatttgaatgttggcctgccttgctattttggggaagttcccctggataatatcctgcagtgttttccaacttggttccattctccccctcactttcaggtacaccaatcagatgtagatttggtcttttcacatacttccatatttcttggaggctttgttcatttctttttactctttttttctctaaacttctcttctcacttcatttcattcatttgatcttcaatcacagacaccttttcttccacttgatcaaataggctactgaagcttgtccatgcatcacgtcgttctcatgccatggtttttagctccatcaggtcatttaaggacttctctacactgtttattctaattagccatttgtctaatcctttttcaaggtttttagcttctttgcgatgggttcgtacatccttctttagctcagagaagtttgttgttgccagtcgtctgaagccttcttctctcaactcgtcaaagtctttctccgtccagttttgttccgttgctggcgaggaactgcatacctttggaggagaagaggcgctctgatttttagaattttcagcttttctgctctggtttctccccatctttgtggttttatctacctttggtctttgatgatggtgacatacagatggggttttggtgtggatgtcctttctgtttcttagctttccttctaacattcaggaccctcagctgcaggtctgttggagtttcctggaggtccactccataccctatttgcctgggtatcaccagtggagtctgcagaacggcaaatattgctgcctgatccttcctctggaagctttgtctcagaggggcaccctacgaggtccataacaaaatggaggcagaaataaagatgttctttgaagccaatgagaacaaagacacaacataccagaatctctgggacacatttaaagcagcgtgtagggggaaatttatagcactaaatgcccacaagagaaagcaggaaagatctaaaattgacatcctaacatcacaattaaaagaactagagaagcaagagcaaacacattcaaaagctagcagaaggcaagaaataactaagatcagagcagaactgaaggagatagagacacaaaatacccttcaaaaaatcaatgaatccaggagctggttttttgaaaaaataaacaaaattgatagaccgctagcaagacaaataaaggagaaaagagagaagaatcaaatagacgcaataaaaaattataaaggcgatatcaccaccaatcccacagaaatacaaactaccatcagagaatactataaacacctctatgcaaataacctagaaaatctaaaagaaatggataaattcctgcacacatacaccctcccaggactaaaccaggaaggagttgaatcactgaatagaccaataacaggttctgaaattgaggcaataattaatagcctaccaaccaaaaacgtccaggaccagatggactcagagctgaattctaccagagggacaaagaggagctggtaccattccttctgaaactattccaatcaatagaaaaagagggaatcctctctaattcattttttgaggccaacatcagcctgataacaaagcctggcagaaacacaacaaaaaaagagaattttagaccaatatccctgatgaacattgatgcaaaaatcctcaataaaatactggcaaactcaatccagcagcacatcaaaaagcttatccaccacgatcaagttggcttcatccctaggatgcaaggctggttcaacatacacaaatcaataaacgtaatccatcatataaatagaaccaaagacaagttggcttcatccctgggattcaaggctggttcaacatacacaaatcaataaatgtaatccagcatataaacagaaccaaagacaaaaaccacatgattatctcagtagatgctgaaaggcctttgacaaaatgcaacatcccttcatgctaaaagctctcaataaactaggtcttgatgtacatatctcaaaataataagagctatttatgacaaacccacagccaatatcatactgaatgggcaaaaactggaagcattccctttgaaaacgggcacaaggcagggatgccctctctcaccactcctattcaacatagtgttggaagttctggccagggcaatcaggcaagagaaagaaataaagggtattcatttaggaaaagaggaagtcaaattgtccctgtttgcagatgacatgattgtatatttagaaaaccccatcgtctcagcccaaaatctccttaagctgataagcaacttcagcagtctcaggatacaaaatcaatgtgcaaaaatcacaagtattcttacacaccaataacagacaaacagagagccaaatcatgagtgaactcccattcacaattgcttcaaaaagaataaaatacctaggaatgcaacttagaagggatgtgaaggacatcttcaaagagaactacaaaccactgctcaatgaaataaaagaggacgcaaacaaatggaagaacattccatgctcatggataggaagaatcaatattgtgaaaattgccatactgcccaaggtaatttatagattcaatgccatccccatcaagctaccagtgactttcttcacagaacttgaaaaaactactttaaagttcatatggaaccaaaaaagagtcagcattgccaagacaatcctaagccaaaagaacaaagctggaggcatcacactacctgacttcaaactatactacaaggctacagtaaccaaaacagcatggtactggtaccaaaacagagatacagaccaatggaacagaatagagccctcagaaatactaccacacatctacaaccatctgatctttgacaaacctgacaataacatgaaatgagtaaaggattccctatttaataaatggtgctgggaaaactcgctagccatatgtagaaagctgaaactggatcccttccttacaccttatacagaaattaattcaagatggattaaagacttaaatgttagacctaaaaccataaaaaccctagaaaacccaggcaataccattcaggccataggcatgggcaaggacttcatgactaaaacaccaaaagaaatgacaacaaaagtcaacattgacaaatgggatctaattaaactaaagagcttctgcacagcaaaagaaactaccatcagagtgaacaggcaacctacagaatgagagaaaatttttacaatctacccatctgacaaagggctaatatccagaatctacaaagaacttaacaaatttacaagaaaaaaatcaaacaaccccatcaaaaagtgggcaaaggatatgaacagacacttctcaaaagaagacatttatgcagccaacagacacatgaaaaaatgctcatcatcactggccatcagagaaatgcaaatcaaaaacacaatgagataccatctcacaccagttagaatggcaatcattaaaaagtcaggaaacaacaggtgctggagaggatgtggagaaatagaaatgcttttacaccattggtgggattgtaaactagttcaaccattgtggaagacagtgtggcgattcctcagggatctagaactagaaataccatttgacccagccatcccattactgcgcatatacccaaaagattataaatcatgctgctatgaagacacatgcacatgtatgtttattgcggcactattcacaatagcaaagacttggaaccaacccaaacgtccatcaatgatagactggattaagaaaatgtggcacatatacaccatggaatactattcagctgtaaaaaatgatgagttcatgtcctcttagggacatggatgaagctggaaaccagcattctgagcaaactattgcaaggacagaaaaccaaacaccacatgttctcactgataggtggtaattgaacaataaaaacacttggacacacggcggggaacatcacataccggggcctgttgtagggtggggagacgggggagggatagcattaggagatatacctaatgtaaatgacaagttagtgggtgcatcacaccaacatggcacatgtgtacatatgtaacaaacctgcatgttgtgcacatgtaccacagaacctaaattataataataataataaagaaagaaagaaactttgtacttactgaacagcaaacaacagactatcttttaaacccattttactctgcttagttttaaatattgagtgcaggtgggagaactagatatgagaagaaccacctttttattattggaaatgaccaagggcattgttttggttaaagtaattttaggatgtttccattgaccattgatatcttacatacatttcctgttttaacttcggagcgagtcattttgaaggattttgctggactttcagaacgtgtgatttgttttaacggtgctctcgggctgccatatgtgtttatgtaggctgtgtcctgaagaaggggtctctgttagggggtatgagtacgctgaaaatgaagcactctccaagcagcacagaggtgcattttctcatctgcagtaaggcatcttagcggccagtggtcctgacagcagcaagtagatctcaaagccatttcacgggccttctcatattcacactaattctaaatcagacttctgttaagaaaggagaaataggtggggcgcggtggctcatgcatgtaatcccagcattttgggaggctgaggcaggtggatcacctaaggtcaggagttcgagaccagcctggacaacatggtgaaaccctgtctttactgaaaatacaaaaattaatcgggcgtgttggcgggcgactgtaatcccagctactcggaggatgaggcaggagactcgcttgaaccctggaggcggaggttgcagtgagccaagatcagcccattgcactccagcctgggtgacccagtgagactctgtcaaagaaaacaaaaaaaagaaagaagaaaggaaaggaaggaaggaaggaaggaaggaaagaaagaaggaaggaagggaaagaggaaatagaatttaacaatttgaacaaaaaaagggggaatagaatttaacaatttgaactaaatacaaataaagtcctttgctgctatcaaaatgcaattgtgacatagagttagtgcaaatatgttattgtgtaatgactgtgcaaattgcttttctgtatgtttgtcttatataatattgacagtactacatagtgtgtcaaaaaactaaacttggtatttttaatgctaaaatgagtaaacactaatcagaatgccagcaggtacaatatctttgaatgaaaataacacattcaaactgctgtttctgttctctttggtacacggtctgcatagttagtatgataaatgcgaatagaattttcatgctgacatttaattaaaatgaaattacctatcattgttacccactacacagaagctattatttatgttgatattattctaatattgtattaagctgatattgaatttgtatcagtgttttttatgaactgaattatttctgattcctcagttgtttttaaaagccaaggagtagatactattgcattgtgcgtggatagagcatattttcctcttatttgaaaagttagaggtggaaatcatgtagttcagtgtaactataattgtactattttcctgtttttttttcttttgtcttctttggctattttgatgccttttaatgcatccccctgttgatgtacagtttaatatctgatataacactaagattaattttttaattgttaatatatctttgactagtctttccctatattattaccattgtgattacttttacttactacgatcaaagtagcaacttgtagtcagatagcagtgatattcacggtctatcaatttatccattcatccatttatccatcctacttttcttcccttcccccatccatccattatgtactgtggatttgcactgaagtcaattggaattaagtattataaaactctattttactaatagccatataaaacccttaagaggcaattcagacattcacaatacttggaattttaacagttacctctattgactattacaatatagcataatctgtaaaatcactctggcaaaaatgtgtatctatgttttagttctaaggaagcaccactcagtacaatgaaacaggaagaaatgctagtgatttacattgttcttgaggaagttaaaaaaaatcaattcattgtgattctgaagctttctctttaggtcagatattgttatattgataacaaagcaatgacaccacacagtttttgtgctccaataaatgtgatttcaaattttacaaataaacatttttcccttttaaaaagtatatacgtctatctgtttagttggacaaatgaagacaaagcaaatttctgtgacccaaatccaagtctgagtactcaagtttgggtttgtacagtttagtttaacttaaaaacaagtgacttgttcatttctacgccacaaatacctaaaacaacaaatattacacatcatttttggttgagaggaatgactaaatcattgtttctagtgattgcttcttatgacaaatcaacattgtttattaaaaatatgagattttatagaggtcaggcatggtggctcagacctgtaattctagcccttgggaagcggaggctggagaatccctcgaagcctggagtttgagaccagcctgggcaacaaagcaagaccttgtctttacaaaaaaaaaaaaaaaaaaaaagaaagaaagacagaaattaggaaagaaagcaaagaaagaaaggaaagagaaagaaaagaagaaaagaaagaaataaagaaagaaaaagattggctgatctgagtgcagtggtgtttacaactaattcatcacaaccagttacagagatttatttgtcccatctctacacctaactccttcatttaactagaaaaatatatatatatattagattttataagaaggaaagtagaacatacaaataatattaagtacttatctattacttgagatataccaactagggaagacagaggaaggacaatcaatataaatcatatttaaacaactactctagtaaattgatcaaagtctggttagtattatctgctttaagtttttctaaggattttcaatgagagaagaccgtatcatttccccacaacccaacctatccagcgtttttctggaagaggctattagcaacacataagctgccagcaatgtaaaatccccttatttgctgccttaacatttgggataaaaagtgttgacaccattattttttaacctcgatctcattgaggaacttcctgaattttctaacatcaatttactgctaaagatctatataataaggagattttgaatgttaggaacctgtgattatgggtgagagttagttgatgagagggtgagagttagttgatgagaggattcgaagctctaacatctcggaataactggtaacacatatctttgcaacatagcttcatttcactgttaggctttggtgtgttggcgattttttatgtgtgtaattaacatattttattgacaatatttatgtatatctgtaattacatatatctgtacaatgtgacatttaatctatgtaggcattatagaaagtttcagtcaagtgaattaacatgcccttcacctcaccaatttatcacttttctgtggtgagaacattaaaactttttaaaaacaaatctgaaatatacattattattatctgtggtcaacatacaatgcattacatcactaaagttcattccttcagtctaactaattctttgtacctctgattaacatcttctcttccctccactcctagtttctggtatccacatttctattccttgtttctgaaatagaccactttagagtccatatataagtgagatcataccgtatttgtctttctgtgtttagcttatttcatttagcatattgttctacagtttcatccatgttattgcaaatgataaaatttccttcttttttaagggtatatagtattccatagtgtatatatactgcattttctgtatgcattcatctgttcctggatacttatattgctttcatatcttggctattgtgaataatctaaaagaaatctgggaatgccgatatctccttgacatacagatttcactacctttggaatatatccagaagtgggattgctgaatcacatagtaattctatttttagatttacgagttactcccatgctattttccaaaataggtgtactaatatactttcccatcaacaatgtacaagggttaccttttctccacatccttgccaatacttgttggcatcagtcgttttgataatagccattctaatgggcatgtggtgatatcccactgtggctttaatttgcatttctctgatgattggagatgtggagcagtttttcatatatctattggccattcatatctcttcttttgagaaatgtctgttcagattctttgcacattttataattgggttgttttcttgtcatgagttaaattcctcatatgacgtggatataaacccctcatcaggtgtatagtttgcgaatattttctttaaatctggtttctctcttcatcgagttgtttcctttgctatgcagaagctgtttagtttgaggcaattccgtttgtctatttttgcttttgctgcctgtgcctttggagttccatctaaaaaataattacccagaccaaagctgtggagatcttcccctgttttcttatagtatctttgtagttttaggtcttatatttaagtcctttatcaattttaaattgatatttgggcctggcacggtggctcacagctgtaatcccagcattgtgggaggcagaggcgggcagatcacctgaggtcaggactttgagaccagcctggccaacatgctgaaactccgtctctactaagaacacaaaaattagccaggtgtggtagcacatacctgtagtcccagttactcaggaggctgaggcaggggaatctcttgaacccgtgaagcggaggttgcagtgaactaagatggcaccactgcactccggtctgtatgaaagaaagagactccatctcaaaaaattatatatgtatatatatataaattgatatttgtatttctagtgatatggggtctgatttcgttcttctgaatatgaatattcggttttcccatcagcatttgttgaataaaatccgtcatttcctattatgtattcttgtcacctttgaaagaaatcaattgatcataaatacttgagcttattttctgggctttctaacctgttccattcgtcagtgttcctccttaatcagcccagtcagagattctaagtgcctctaagttttgtgtttgtccagcctgctgtctttgttcttagtggccccaatacatgggagagtatcaagttgtgctatcgccttgagagacatttgatagaagccagtccctaggaatgtggctggagaggtcggggtgttagatgcgtgttccagttctttctgtctctcttttcagagaagctgagagccagagtttctttctcatccattctgccttactccaaggaatgaagctgagatagatgcctgtacccttgatcatactgctcactttgaacctggggagatacttgttgaatgtttgcaagtttaaaagtcaccttttgttccctgtggtctaggagattcaggagcgtggagttctgtcaactcccagagccaggtgatttaggagccagtcccaagcaaagactgtaaaagttgaagtatttgatgcatgtagaaactgcctccagggagggtcttcagatctatatttactgctgggtcaagctggggaagaaggtgcagagagtgcccacagtcctgcttgagcattcagaagacgccctccctcatagcaggggagacttctggtctggagtgcccactttcctttaagacatgaagaggtctctctgcttccttccaataagagattgcggagtttatctctagagcaagctgagggagaaggcacaggagtgctgtccctcccagtcttgctgggagaagacttcaactcttcacagagagactgcagggctgggattagcactggagaaagccagggaaggccctcgtaggtgctgtgcttcctgtttaggctcaagttggctttttctttattgctttgtaggctcccagagactgacctgttaaaggccaaaaccacagggaactgctgtgaagccaaaccctctccaggggaagggtggaagctggacagatctaggggctaccgctgctgagagtgccctcagaggcagttcaaattcttctttgtttttgtgcttgagggaaatctcccaatgtgctgtctctgacattctgcaagtggggtgatctaagagcccctcccccttgcagtgatggtaaaagttgggcattataggtgtggtgcaagcctgttacccctcaggaagaagctgggagttgaggtttctttccaaatgtaaggcactgtgctcagggtggggttatgcctgagtgtatctccactttttctactcatttgggtgtattttcatagttgtcaggtgtgtaggagtctttgagctggattctggctttctctgggacagaactgatccactcatggctatttacttggtgtgtctgtgggaggagggagcatcaagagtctcctctctgccaccttgctgacttcctgtgttgaatatttttgacttgtgtttatttacattttgtttatacatttgtattttttcaattagtgatactacaattcatgaattctgctttatgctatcaattatgagtagccttaggttaattgctatatttaatttcctgttacagctatagcttcttgtggcttagaattgccttagaatgtaataattctagcaacaaaagaaaatagattgaaatgggccagacagacattcatctgttctctcttttcataaaaaggaaaactaaaaagtgcttataatttgagatattgctgcccatttgaaattataaaaagtctctaaattaagacataactgcttatttctttcagttttttgaaacaaatcaagtaaactatacacagaagatacatgatcatttctctcatgatttaattttagacaatgccttttaatctttttatttcattttaagttaaaaaggccatttgccttctgtattaattattttgtttatcaagtcatctgtaattgtttgtagataatgataatgtattttgaaagcagctttttttttgttcctatataccccaaatgttacttcataacatttttattttatttttctttcttgatcttcaagtgaaagagataaagcctggtgcttccctttcttgtcagttttagaaattaaaggagagagaaaagaggctgaacaacagatgcaaggtcagattaaatgtctcattagagccttttatgcaaatgctgaaccctgcagtcttgaaccgacagacatttcactgtttgggatcctgatgagtcaagtagagacaaggtaagagtcatattggttatttagataaaagacttaaaccaaaacatagggctgagaattaggaccccgggggtgataaaaaattacatattaaaaaaaattatgtcataagtccacccgtggtgggagataactttcatgaagctgtgtttggtcatgagaagttgctagactccatggtggaacatacttaacatacgtccataagatacgtttacgcaaaggataagcaggatgttttctatttataactgtgtcctgtatgacagaagttttaaatgtgttcaggttttttaattttttttttttttaataaaaactactactccaatcactgtgtggcttctccaagcacacctactctttccaagagctatcactctatcagaggggcactgctgctcttctcacccacctacgggaggtcgtcagaggagggacactgaatccagaagcataggggccttgttcaatggggattcattcattcattcattcaatacatatttacaaatcactcaaactaaacactttcaattgaaaattgtgttatgtaccgcataccatgatggataataccacaacttggtacgtcatagagttatgaagattgataaacatttgtattttcttagtccctttttatttattcatatacattttaatatctgattatcatgtttgaatttcctttgattataatgttctttataaatgcaatacattaaaattagaagttagcagttgactttataagaatcattacaaaatttataattattcaaacaacacaagcaaataggtaatcatctatactaagctctaatataagttccaagacaggctaaatccagtatactgccttgtatttttttgtcccatctttctgagaatctttgtataatttgacaataatgtcaagtggaaagagaaataaatccctctttttcttttcctgcatgttgtacctgagagtgttttttccttttctgacactccttttgtatagttctttcagcagtagcaatttattctaataaataggcactcatcacatgatctggaaactactgatttcgtctcagtctgccacaaatacaattaagctgttctgtttccatggttagccatcctgttttctaaaataggaggtttctaaacctctccattttctacaagttaaaaactggagctattcttttttaattggttcttctgtattggatcaaagcatgctatgcaattactgatgctgtcatattggcagaaagaatacgcagaagttcaagctaacattacacatgtcatctttccttgaagaagtacacacagttaactcaatcaaagcaatgtaaagcttgttttttgaggcattgtttccaataaaaagatgaaattggccgggcatggcggctcacgcctgtaatcctagcactttgggaggcgaaggagggcggatcacgaggtcaggagatcgagacaatcctggctaacacggtgaaacctcatctctactaaaaatacaaaaaattagccaggtgtggtggcacgcacttgtagtcccagctactgtggaggctgaggcaggagaatcgcttgaacccggtaggtggatgttgcagtgagccaagatcgcaccactgcactccagcttgagcaacagagcaagactccatctcaaaaaaaaaaaaaagatgaaattaacatttttatcatactattattggatgtaaactagtgattataatgattatgaaatatatagcaaaatggatcagagttttacacatttagttctgttttgattgtttttcatatttaaaataataaagtgttgagaattctactaaagctataaaataaaaagctttcatcttaaaacaatcttatcattgtagatgatctgattttcataccgataaacatgccatgttacttcattgtcaatatattatacaggcaaaataagacaaaatatacgtcacttaaaaatttaaaaaatgtcttataggcttctgaaaatgattaggcacatactatcactttttcctgtgaaataaaaagagatagtctttaatatttagaatgattgttcaacttaatgccttctctccctatttacaaacactctgtgtttggaaaacacacaccttaagcaaaatgcaggtatatgtaaaagaaacagatcttgtttcaagagagaagatacgaagaaagcatttaaaacagtgaatgtcttcaccattactcctcaaatggagtaatggtgaagccggtgtggagggagtgtataaaatttttgtaacacagttggcaatacctgaatacttaaatatgtaaattgttaggataccttagaattcagtatagaaatgttatatataataatcttacataataaagtaatgcaatacataatatgtatgtataatcttaactcttatgaatgctttgtaaatataaccgattgacagccaaaacagtccttggagacagatatctcttctattatcccattttgcagttgagaaaactgaggcacaaaaggtagagtaatacgcccactgtcacagatccaacatgtcttaggggtgggatttgagctccggcaacctggctctagaggtgttggtctcgaatgcctcaatctttttgttctccatgataagatgtggcatcacagaaccctccttatcctctaggtcagataacttttactgtgcttaggattttaatgtctttctaagacttaaatgataatttttccttctcagcatgcatttaattttgaatacatcatgctattgtactctaagtcatgtatatagatccacagcaataaaaatactttaaaaaacttgtcataattacacattgataaagggatttcactgtcatatcatcattttcagaggctatcatattagtataatttaaaatatagtagtaaaagcttgaatctatgtgtctggataagactttctcaacaagagagattttagtagaccggggtacaaattggacaaacaaatgttagaaaataatgctgaagacaaaatatactcaactcacttcttatagcaaatgtgttaaaagtgtacagctcataaatttgaactcacattgttttgatttcttatactctttgaagccaggcttgacgtatggatgcatatttaagatgtgatcggcttcaaacatgaattgattattctgtttgatgttcattaacattaaataatttgagtggggcactgaatctgattgtgtttattttagtgtgtgttagtgaaaacagatttctgtgtagctgatctaatgtaggtggacagcaagtgtctgggctgtgtctgcattcccatcgttcgggcatggctgtgttgtcagctgctgactaatatgtcccttgagtgacaccacagttctgctacatgaagggaggaaaaggcgagttcattcttttgattttacacagtaaacatgccaatttcctcttaatgtatttcataggtaagcaaaataatgtaactgtcgccccccccaccccagttttagtacaaaaataattaaaactccattaatggttttatttggaaacagacatctgaattaatattttttctccattactgcagcaaaaaaagactctgagtataaattgtttaaaatgttgatgaggattatatcattaaaaaattgacatcatgttttgaaattgtcatttttgtaataataaatcatcatatatttaattttgaatttttttctagctataacctgaactttgcagatattatacctctgtagtttgaggttttgtttctgttttgtgtggtgtcctagagtggctgttgtagttatactccaaaaaagatgttaatgcaaaaatataatgcttataggataaggggtataaatagttcactttctttcccttcaggaacaagttacgtaaattcattattatactgaggcagaatgttatacataagaagaagaaaatggcaccagactaaatagtacctcttgaaatgtttcatttattttcatgttacggttacaatgtgaattgatcttccttcccttcttcccctaggaatctgactctatgatcagaactaatttttttcttccctttaagcatactgagggtttggagatagctcctatggttttcaaagtggtggattgatttaattgaccaaaacatagcagggagtagtcatctgattatacaagtataaaataatacagaaagggattttttatttccactgatacaattcaatcaagtttctttgagttgctgagttcaaacattaaagttaaaaaaattcttgatttataaagaaaataaaagttattttctaaatggtttgatttccaaggaacagggaaaaaatgaaatattgttaagattttctgaacaatgaaataaatattgagtattaaataaaagatataatatcttttaaagaacagatatcagttaagggctattaaaattacttttgttctagagttcttatcagaagctctaccaagtttttcagtgtttacaaacagactaacagaccaatttcataataattttcaaaaaaatattgtaaagtaaagtataaggtaacatgatgtgatttttaaggtcaataatatttttaccttaaagatgatgatgcgcttattaggaaaacagtggggtaaaatagggtagccgaaatgaaaccaaagattaaaaaacaaaataaaacaaaccccaagttatcaagtacttaaatggggcattatttcctttgagtatttttattgtcatagaatcagatataaattatgaaagaattaaaacgagaagtttttaaatttgttttactttttagggatggaaagattagtgccattctatctggttttcactttaaaatcgagaacatccctctgagcctttggagtggagagaactcactgtgtggatctcagatccctcttgtttaatttgcctgagtgcttcactgagcttgcaccttcctccacactgagaacaaaagcaggctactgaattaccttttgaagcactacctcctaacagaccccttggattgagaatatggcaaataacagtggctgcagccgccttaaaaacagaagagaatggagtgtggaatgcagacttaacctcagtgtgattttgctccagaataaagcgacatagctctaagtcaggacataccatggggcaagggagtgatggacaaagctaggaaaagagatgttctacacacacacaaagaggttcttctgagtgtggatgcttaaaatctcaagaaggaaaatgtttttcatctgtggtcacaaaggcacaagtaatctagtttaaaatatctagaatggaaagcagcctctgtatgggattagtggctccattatttctttttttcacagcaattttacatgagatctgaaattctttcctttgtaatctaaaccttttcagtttttagatatatcatttaaatatgaaaaaaaattcagggaaaagtaattttattgttttagtacaggtcatggaccttggagtcttcataatggccaggccacatggaaataaattcatagggaaaaccatgctgtaaggacaaagggatctggagtgggttgaggggaaggaaggtattaggtaaccttcactttttattctgcctaaggccaatactagtggtttcaatctagtgacatgcatgttagggcacattttagagcatgtcactgatagctgcctgaaacagccagtatttgcactgtcagataaaagatattgcctgcttcacagtaaagaattcccctttccaggttttaacaggacaagggacggctaactcagatgtatgagctttggtagtacctcagctggtccattaaaaatgtgcatgatgtttagaggcattttatgatttttacaagcataatgttttcactggaaacgtagcagttatctaaatgttcagggaaggttttcttccaggtattgttgcttgtatcctagaatgatttcattcataggtgcagtctcagaatgaaacatacaaatttaaatttgggaaatctattggatcctcttttatttttagggactttttttctcctgtgaataagaggagactgttgtgttcattctcttttttttttttttttttgctggctatgacggtaactgacactcagtaggtcttccctcaatatttgttgagtgaatagatgaaagtacagtggggaaaggaagcagggcataaacacaaaaacggataataatagaggtggtgttaatgacattgaggccaaaatagaaaatttgattctagtggatggtttatcgcatgatacatataatgggttatgaactggaaatcagagggtgtgaatttgcttttattatagtaggagagaggagctgatgagcattagaaaataatgaaaatgagtcattttcttacaaaatattatctttcagataatatagcatcatcagagtctttggatttagagccaaaagagccttatatgccatctaattaaatgtcttatttctaatgtgtatggggagattttctggaaaattacctatatgtgacctaaagtttttggaaatgccgtgtaagaagtttttcttttcatgggaactggaagggataaaaatctgattgcttttcttcagcaaagcataccagcgtccccattaggcaagtgattatgcagtgttgaaaggtattttcttgagaatgttatttttttccttttcattaattatgctttgtctaaaggttctttgtcaaagctctggctagtacttgaaattgtaattgatagggaataaaagaaagtaaaatctttgatctctctctcggtgttatgcaatatctttattcttgagatcaaaagactccgagtataatgctgaccaaacagaggctacagtactgattttgacagagaccaaggacaacagctatgaaagttaacggctatataggcatgaaatgacaaaatcaaaacaaacaaaactgtgagagtgcctctatgctaaacatccttgcatccttacataacataaacagacacattaaaataataaattcataaaataggtacacaatattatccataatatggatctatgataggtccataaataatattgttcaggagaagaggtattgctcttctaggagaaactataggacaagcatatttccaggaaggcatcaaaataaacatttattacagaaaatcctgaaggaatagcttgtacctattcttacagttgaaggcttctagggaaaactggtatctagaacacatagagttccttatttcataataaatgcatcatttattaacattgctccattccctgtatcacttgaccctaagagcaattatgaagttaataaagtttatctttgatgtaatggacatccctttctattctccccagattctttttgtctcaagtatttatttctcgtcatatggcctaaagacatttctcttataaggactgtgcattggtaaactaactctcagaagacttaaagtgacatcatgctttgccactctgggaattatttgaatttaaaatacccttaaaaagataacaaggcttgggcatgatggtgggtgcctgtaatcccaggtacttgggaggctgaggtgggagatttgcttgaacccaggagggggaggttgcagtgagctgagatggaacgattacacttcagcctggatgacagagagactctgtctcaaaagcaaagcaaaacaaaacaaaacaaaagaaaaagagtaaggcttaacctaagaggtctgaaacctaagtagggagagttatcatggggtattgtaaccaatggtgctctcattcagttaagaccatgaaggtacataaatagacacatcatcggtggtagttttgctgtgtgattcctagccactctcacaaaagcttcccctgtgtctcctgtttaaattgaaattagcagtatctggtacttttctctagacgtagtagaaatacttagatggcagaggatttctacttcctttcagtattacattgattcctgacatctttcagtcagggttctttgattaaagttgaatcatctatcattttattctatttttaattgctttgctttttctaataaatatatattcccctcttttaatgatatcatgaactttgaaaatgtttcttcctttgtccttccaaaaattaacttatttcagtagggaaggctacaaaaatattggaagagtaattatatatatatatatgtgctgatataaaactattttatcaaaaccaaaacgaaaacgaacttgaaaatcaattatataggaatatgcaattttagtataagaaaataggaagtcaaaaatcatggatcattacttaataaaacaaaatagtaaaaatgacaatatagtttttttggatacagattcccactctgttgcacaggctggattgcagtggcacagcaatggctcactgcatcctctacgttctgtaatcaagcgatcctcccgcctgagcctcctgagtagctgcaaccacaggtgcacactactaccaattttttgttttttttctttagagaggaagcctcactctgttgcccaggctggtcttgaactcctaggctcaagaaatcctcctgcctcaacctcccaaagtgctgggattacagacaatatacttctaatttatatttgcaaaacatcaaatgtaagacaattagaaagtagaaaaatcttgatgagttttaaaaaattataacataagtttcttaaaatgtacaatatatgtacaatattaagaagtagtaaaaaagtcatatttctgactttgtgaatcaaagccaatgtattcaacttgcattcttccccattttgcatataggtatttctccggccaatgaaaacctacaatattcagatctacatggcttactgaatattgtctttccttttgtcctgttttacatatgtttttatagccccttgtataatttctatttagaatctcagttgaaaaactgaaggggaaaaagacagacagatggacacgcccccctatacacacacacacatgcacacacacacagggagagagagagagattaaatatgaatatggaggtgaacataggcaggactggcacatgacaggtatttaatgcatcatttccttacttccatatttctttccatcttccttcattcctactttccctgcttaagacattttcaataaaaaaaaactttaacatttaaattgggtcaacaagacacatcatgtgcacatagtttgggtaataataattaacttcacggttaaatatgacatgatatgatgacatcagacatgtttattaagatgttgtctagctatccatctggccacaaactgagcttactttaccagtcttcaaaagaattgctcaggctagaaaaatgttaatttccctgtttatgttgcttaaaccctgaaaagttatattctaactaacagtattaagatctaagttaatgattctatctacaattataggtaattattaagtgcttaatgcaatgctcagacatggtagatctaacaaatattctcactgttcaatttctcaaaatcctattttactaaagatcacacacacgcatacacatacacatgcactctcacacacacatgcctgataatgcagaggaaaaaacatatttgtagtgatgccagtggaaggactgttgcattaatttttcactcatttatatacacgattcagaaaatcaataaactattcttgtttgttttctcaaagtcttcaaaacgaattaatgcatttcaaagttttggagctagccttgcatatctcttttcctgaatgctcctgaatctttattccatgtcagagctttgatgaatcagttacatgacagtgaatgccatttgctgatagcaaatgaattcaaatagccctcaatccatgtaggacaagactgtcgtatacttcttggtactattccttgtgttataaaattgaggtaattgagcatttaatatcccatttacaattttgtgtatgttgatgacacaccacagccgcaggaagctattaaagtgcatagacaggtacatacaccaatcaaacttttgccacagaaaagcatctccgtggatgaaaagagtggcgactttttattttaaattatgacagctctgggcagcactactggcagccaactcacagaactaatttactatcacctttgtgatagaaacagcttgatctaaaatttgttaactatgtaaccagttggttaacatgctgtaaattggatgttcagttcttatggaaggaaattcacatttcatttattatatttttatgtcaattatgtcgaagaaaatatttctcttcctatgcaaataagtaatctgatatatttttattcccccagagaaaagtataaaaatggaactattgccctgtagaatattcaagaccatggtgccacttattttatactgcaagtagtaaaatctgacatggtaataatatagatagtaaaatctcactgggatggagggatcaagggagaaatttcactaattccctaaacttaattattcaagggtatttgaagaaaaaaaagaagatatttaatatttataggactccatggttccatttcattcagtggagcttacacaaaattttgatttaagagcaatctgaactagtcaaatagtagactgtactgtaaacaatatgctatataactgtttgtatacaatgaagtggtaatattggttaaacattaaatttacaagaaaattagcatcaggcagatggcagaaggcaactcttaagtaataaacacaattgtatatctggttgcacagaaagaatgaaactttgataaacacaaattctcttctgttcattctgcaaaatttcacaactgtaatagaatgtaactcctgaaatactacaaatgaaattaaaatttgaaaagccacatccatgacttacagttcatctagcaagcagtccatacattgtttcattgcttatcaacaaatgagaaagctataaatgcccaatgcattttgaaggtcaatttttatggtggcataattttaaactagctcatcctcagtggcttttgtaataaaaagggataaattaatggccccttaactaaagtgaacttttgatacggaaacaaaaagaatattaagcatgtcctattttaagtagaaggattaagagctttattccatgaaataaattgggcaggacctaagattcaagactttgaattggtttctaggacattaacataaggagaacaagagaatttgacattgctagaaagaggcacaaaaggatgtagtatctgttagaggaaagattttcacactagctgacagtaactacaggacgtatggtggactgaagtgtttttctcagtttaatctgtgtcttcaaaaggcggcctcaacccttgggccacagaccggtactggtccatggcctgttagggacgtggctgctcagccggaggtgagcagcaggcaagtgagcactgctgcctgagctcagcctcttgtcagatcaacgatggcatttagattctcataggagcacgaaccctatggtgaactgcacctgcgagggatctaggttgcgcactccttatgagaatctaactaattaatgcctgatgatctgaggtgaaacagtttcatcctaaaacatcccctcctgtccatggaaaaattgtcttctatgaaactggtccccggtgccaaaaagtttggggaccactgttctatcaaaatatcttctcctttgtttttccagctttattgaggtatgatcaataaagaaacaacgtatatatttaaggtataaaagtgatatattgataaatttgtacattgtgaaaagactacgacaagttaattaacacatccataattcacttagcgacctgtgtgtgtgtgtgtgtgtgtgtgtgtgtatggtgagaacacttggaatgcattctcacagcaaatttgaagtatacaatatatcattaactagtcactacattgtatataggtcctcagaacttgttcatcttataaatgaaagtttgtactctttgaccagtatctcctcttctctccagcccccagctcctcctaatcaccattctcctctctgttaccaagaatttaacttttgctttagactccacatctacgtgagatcacgcaatatttgtctttctgtgcctggcttatttcactcagcacaatgtttgtcagattgatccatgttgtcacaagtggtatgatttccttttttactaccgaataatattctaaagtttctataccacattttctttaccaatttatctgctgaaggacacgtaggttgtttatgtatttggctatcatgaataaatgttacagtgaacatgagagtgcaaatagctcttcaagacactgattttatttcttttgaccatatacccagaagtaggattgctagaccatatgggagttttatttttcatttttaagaaacttccataatgactttactaatttccattcccaccagcaggacaccagggttcccttttctctacatcgtggtcaacagccatcctaacaggtgtgaggttctatcacattgtcatttggatttgcgtttccctgatgattaataacaagacatattctccttgccaaaattacaaccagaccatttttaaaataactttaacctatcatgttccaaacaaaaaataccatcctctccataagtggctatggaaattatttcttcttttctgttctttccctttttatttgtgctcacatctgacatatatggaggctagctgcccatttgtatctttgcccagtattacttcaagcgtgagtgttcatcttactcattttttaaaaatatattttgggagtccagcagaagtcttgcatatagcatgtattaaataaatacttgctggctttaatttggtttaatgttgccaagtgtctttgccaatatattgccagtcactttcacttgaaaacctcagcttcgatttttattatgtcagtttctctactctcttgttatgtaccaaattctaatgatattttaagtcagttctattctcaccaaccagccttttcttttaacacatcggtattactgcaacactttctagctgacctccttgcccaacctaaggttcttctaacttgaaggcattctatgtacaactgtggtactgaatagccacattacttccctgctcaagcattatataacgagtcttcactacctactgcatcaaagtgtaaaattatttcccaaattttatacccccataatttagttttttatttttctccaactttatttttcattatgctgaaatattttcttcgttaaaaatctcatttattgattcaacaagtactttctttttttttttttttttttttttttttgagacagagtttcactcttgttgcccaggctggagtgcaatggcacaatcttggctcactgcaacctccgcctcccgggttcaagcaattctcctgcctcagcctcccaagtagctgggactacaggcatgcaccaccatgcccagctaattttgtatttttagtagagacagggtttctccatgttgatcaggctggtctcgaactcccgacctcaggtgatccacccacctcggcctcccaaagtgctgggattacaggcgtgagccactgcgcccggctcgacaagtactttcttatcaccagtaatatgacaagcactgttttagattctggaagcatcacaaagttcctgtatcttttttgaaggtggtgatatgggtggctataaaacaaacctgttctcacagagcacacaatcaattgtatgtataaaaattactaaaatatgtcaagtggtgataagtgctatgaagaaaagtaaagtatgatacaaggacagagaataatggggacatggagggttttattttatttaaagtgctcaagaaaagcctttctcatacttcaatgaagggagaaacaaaccatacatatatctggttattaaacttttcatcgaaagagaacagaaagaccaaaaaccctgaggctggtttatacttggctgttggaggaaaagcaagtggcgattttatggtggcttggattaggatagtagcgacaaaaatggggggaaatgttaaaggcagctacaatttttaaatttgcctattggcagtatgtgctagtaatatattacatgtccgggccagtacagggacctcatcctttcttttcaattagcccaattataattgtgatgaggatttctggagaaaagtaatactatgctttaatgattctaaggtctaaaatataaccaaattgcctgtaagatataagcaatgatcagaaggtgttgttcaataaccaactatcatggccgggcgcggtggctcacgcctgtaatcccagcactttgggaggccgagtcgggcggatcacgaggtcaggagatcgagaccatcctggctaacacggtgaaaccccgtctctactaaaaatacaaaaaattagccgggcgtggtagcgagcgcctgtagtcccagctactcgggaggctgaggcaggagaatggcgtgaacccgggaagcggagcttgcagtgagccgagatcgcgccactgcactccagcctgggcgacagagcgagactccgtctcaaaaaaaaaaaaaataaaaataaccaactatcatataaattattcggccctttattgagtatattccatttatccagcagtgtgatttctggctgtctcagttattcagtatataggctcagatcagagtaagcagaagaggactttgaacatcagagagcagtcagaactggagaatctacttgcagatgagggatttattacaggtctagtgactcattgctgtttggtatctcatcctccaggggtcctccaggtggtctgggtttgttgtgggatggtgggttctgggcatcatactttctccatggctgctgattggcctcagagccagtgttccaaggaaactcaaaaaaaaactgcagggtctctgccgacctcacctctgacattccacatcactcctgctgcattctgttggggaagcatgtttcataaatagaaattggactctacttgtcaatggaaggagtaacaaagaatgtgcagtcatctctaactggtcacacagataatgcagaatttaatgttaatgcagtagaatataattattacatacgtgaaggtgcttttaatgtttctgagaacaagttaaagcatgttcaaagaactgtttcactaaaggaagcaggctatcacatatttttaaaagattttcattgaaaaatttaaaagtaatctttaaattctcagttatttattaccacgtacatatatatgtatgtgtatttatgtaaaaatatatatacatatgtgtgcatgtctatgtagatacacacacaaatatatatggtatatttatgcaaagatcccactgataaatacatgtatctattttatttattaaatttattatataactaaatttaaatttctaaaaatgtagtaaaatttttattattgaaggcccaaagtaactcaaactgttaacttttataatcgaatgcatatttttatcttgggattgtttaattttaaaactatttattcaaaaataaacatataaaaataatagtaaaactcacacattcatactgtttgtttctgctgtaaaacaaaattggaaacaacaggaaattgattgcctaaaggaaaacttaaattaaatataatagcttaactattatgtgagcagtaataaagttgaaaatgcatgccctttgttgtaggactttgagccaactgttattttcattgaataatttctgatttatttatctagtcaatccgaaatcagcagttatccttagaaatatgtcacatattctattatctccaagcatgaattatcagatcttagagaaatttccaaatagaaagctatatctatgaaagtcaaagtgaatcgttaatacaggcttccattgtctataaacaatgatcacttgagaattaactgttcattaacatgcttcatttttgaagccaacagtaaatattatttaacatgaaaataatttttcagttttacttttttggatcctagattcttgtctgatttttacttgtgaaacatatccctaacccagaaagtatcattctatgcatgtccaaatttactatgaggggtaaatgaattaaagtgctcccagagggattagaacctgagggcaatttcttcttctttttcttcttctatttttttttttttttttttttttgacaggtctcactctgtaacccagattggaatgcagtggtgcgatctcggcttactgcaatctccgcctcccaggctcaagtgattctcctgcctcagcctctcgagtaggtaggattataggcgtgtgccactactgcctggctaatttttatatttttagtagagatggggtttcaccatgttggccagcctggtcttgaactcctgacctcaaataatccacccgcctcggcctcccaaagtgttgggattactagcatgagccacgatgcccggcccccatttcttcttgtagaagaatagattacatcaacctgaaactgctttaagagtcaaaatgatgcagctattcttgcaatgttgggtgatcagggtgatgattgtaatttacttttgaattttcaaatgttttgttgacctaaactataagtaaagatgcactgctcagagaagccagtgaatatcagagtagaaacacaagcctgttatctcatgcccggaaaaaaagtaagaattaagtatgttaacttcttagactataacacacatttaatttctcactgagtattagttttccatggtgcatgtttttatgtaaggagaggaaaaatccattttcaaatccaagtcacatttctctcttagtaatcatattattaatatcagttaaggagtattttatttaaggcaacaagtgttaaaaaataaattcctaaaggtgtcatggctcaaacatgatagaaaattatttcttgctcatttacaaaactggtactttcggttggtaactcttttcaaagcaataattcaaagactctagctcatttccccaatgtctatggaatcctcatcattggcttctaggatcaccatgcttatctgtactagactgaagaaatatggagaattgtgcctggaaagttttcaagggtcagtcctggaataaatgcatttatttaaaactcagtcacatgaccatacctatctgccaaggttccagaaaatataatcctgatccatgactaggaagaagataaaataagtttgatgaatagttacccagtctccaccatagcagaagaagcccattctatttgagattcagagatcggcaaaataaactcagtaggcaagaggcatagagaaggttggaagtcctatagcagcttaattaaagcgccctggccgggcgcggtggctcacgcctgtaatcccagcactttgggaggctgaggaaagcagattaggaggtcaggagatcgagaccatcctggctaacacggtgaaaccccgtctctactaaaaataccaaaaatgagctgggcgtggtggcaggcgcctgtagtcccagctactcgggaggctgaggcaggagaatggcgtgaacccggcaggtggaggttgcagtgagccaagatcgtgccactgcactccagcctgggcgacagagcaagactccgtctcaaaaaaaaaaaaaaaaagcatccaatcagtctccaacactcaagaattatttgtgagattcttatagaactaaaatctgtcactagctagttctcctgtcttctttcatggcacctgagagtttgaaaaataaaaggttatgaattgtatgcatgccattttttttttctgtattgtatgcatgaaaccatcaaagatggaattctttctacctgtagatatccatttctcctccaagagatctcaggtcccatgacaatgtcaccacttctgctcctcctctgcaagtgtaatgaagagggtatttcagtggaagcaatgtattactttccctctcttggattatgacttgaaagaataacattcacacatttgtgaacctgttcatgccccacttcagttatcagtattattcctcattgcttccctgcacatgtaggttaatatcctcactcaccttttctattcttgcaccccttccatgcaggcaaaatgttatacagttttcaaccctcattgatcacatcccaaactccctccactttgatcacttgtagtagagtcagtgtctctcacccataagactttgagttctcattaaactgtgaagtcagagcttattacatttttatctttgcatccctagtacctagcaaaatgtctgccagtggccaaatgctcagaaattactggtaaatgatttgaagatttccactgactatgctggtctaccctgttctgaacttcacatcaaaacctatatgttgagagttttcattatgacaaaaatatactgtggtcaacatcttgaatgtagtgttagttatgatgatatataccgtttctaaaatttctccatatgcacattgaaaatgaatacattttattacatgtaaattcttaagagatgtaattttaaaaaagagctactgaaatgctaaacaagacagaaaaatgtccctcgagattcttgctattgagctgacgaccaaattcaggcacttgcagagtagttgaccttctcttaagaaggagccctcctctgtgccctcactataagaaggagcctcccaacattagattttctcttgaagagccctttggactgttgttctgtctgagagctactggagaatctctttgatagctttgcttttgacggttttctctggagaaaggtctaatagaagcaaacagttaaaacccttttccatccttcacgttttttaaaaaaagtctcccttttaatatgattttctaactctgtagcttctttgtgtcattttgttcctacaagtgttcatatatacttttaggtcacatgcatttccacacacaatctgaatgtttcctacaccatagagaaggtgttagagactggatacttatacaatgttatttaggggtcggggaagagggagactctattccttaaaacaaggaacacaaaattaaaaatataaaacatgatataaaagtaaatattggccagggcgcggtgacccactcttgtaatcccagcactttgggaggctgaggtgggcagatcacctaaggctgggagtttgagaccagcctgaccaacatggagaaaccctgtctctactaaaaatacaaaattagccaggtgtggtggcacatgcctgtaatcccagctactcgggaggatgaggcaggagaattccttgaacctgggaggcggaggttgtggtgagccgagatcacaccattgcactccagcctgggcaacacgagtgaaactccgtctaaaaaaaaaaaaaaaagtaaaaacaatgtaaatatttatctatagtgagacaagtaatcaaaaccaaaatatggaggcttggagatataggtccctttcttccaggagctctcggtaatttactagaaatgcttccacagaaatacttttgatttaaagatagatttttctttcacccagaactttctctaagttctaccaaattatctcaatttgattgtaatttaaatggaaaacataaaactacaaacttttagaatataacatcgaggcacatttttgagccccagggcctgctgacatgttcttagacatgataccgaaagcataatccataaaggaaaaaaaaaacagaattaattggactttatcaaaactaaaaatatttcatctacgaaagtaaaaaatgtatgtatgcacaacaatctgtacatgattgttcacagcatttctatttttaacggccctaaactggaaaaactaaaatactcctcaataagtgaatagttaaacaggttgtggtacatctatatcatgaaatactgctcagcaaaaacaaaagaagacctaacaacaagaagaacaacaaaagtgttgttagatgcaccaacttggatggatctcaagggcagtatgctgagtgaaaaaagccaatctcataaggtcacaaccttcttgaaataaagacaatacagggattggaaacagattagtggtggtcatgggttaaccatggctgtagtgcagggagaggatgggtctgagatggaacagttttgcatttagattgtggtagtgcctataccttacacatgtgattaactgatataaactatatacatatattgtatcaatgtcaatttcctggtttaaatagtgtgctatagttacgttaaatgaattcatggcagaaacttgatgaaaagtacccaggacccccctgtctttgcaccttctagtgaattcataattatttcaaaataaaaaatttaaagcttaaatgttagcacttacacaagtggattactttattacttctgggatatgtacaaatttgggtcctcttagtgtctccatgattttacatgaggttgttctaacataaaaaaaaaaaaacaaactacgtaaagagtgtttttaaaagtgagaagaaactactgctagtttgagaaagggctagatcctaatcagtaaatagaaaatcagttaacattcaaatcatgtttaattattttatcttggaatgcacacgattactgttttattttttactttttagagacagcgtctagctctgtcacccaggctggagcacagtggcatgaacacagctcactgcaacctcctcatcccaggctcatgtgatactccaacctcagcctcctgagtggctgggaccactggaatatggcacatacctggcttttttgtttgtttgttttaatttttcttgtagagatgaggtctcattatgttgcccaggctggtctcaaactcctgggttcaagcggttctcctgctttccagcctcccaaagtgctgggattacaggtgttagccaccacacccagcctatgattatgattttattcattagtctatgtaccaatatttaaaagaagaatttgtatcttgcatgtgtgcacaattataccttacacataaatgagtttgaaatggtaaaacggcaaacctctagactatgacagccaaagacaggtatttgatccttgaaaatagaaaataatataggcaatgacttttgcaaaatagtgagatatttccaggtaacatttattctgaaggatttgctttcctatcactgcaaagatggccttttcaaccctctcaccatcatctcatttgctgagatgagagagaggagagaggggacaaatggatatacagatatatgggggctgggggagacagagagaaactgtgttttctggggcaggcataggtaacatttacagatacctgtccaaagtacacacatatatttctatagtcctagcattgcacacgtattactctaaaatgctggcattttctgtcaatctgcttggtagcaaatgctgaggaacaaaccaatcactggatctaggagccaagaactaacagagactctgtgctttatgtgtgagcatttaactactgtagatggagacctgcacgtatttaaattgaatatcagtcctgtgtaaagagtgattattctgatgcttctccgcatcagatataaagttatatggagtccaaagaccatcaatagaggattactcgtagcccatctaattttggaaaacaatagaggagttttctggtgtgaggtgaacagcctgctgttttctttgcctggaatgcattttcctcctcttccatgcttcacctccactccccttacctagttaatacccactcatggctcaacatttgctcagctggtgtttacctacgaagccttcttattccttagatgaaaataattaccccatgttccactgcccagtcagagttaaacagaacttctttttttttatttttctttttaagaatatagagtctttaatgtggtcagaattaagttgctatcagtttaaaatagcctgttacaagtgtattttatataagcctcatagtaaccacaagcaaaatctatattagatacagaaaagattttttttttaaaaaaggtttcaggccaggcactatggctcatgcctgtaatcccagcactttgggaggccgaggtgggtggatcacctgaggtcaggagttcaagaccagcgtggccaacatggtgaaaccccttctctaataaaaaaatacaaaaattagctgggcgtggtggcaggtgcctgtaatcccagctacttgggaggctgaggcaggagaatcccttgaacctgggaggtctctctgtctctctcagtcattatctctctcttcttcaaacctgtaacaaaactccataaggaaagaaatttcattgtgtttgtatttgtctccatagaatctagtataatgctatgtgtacatatgtacacatatgcgtgtacatacgtgcatgcacacacagacttacatacacagggcttgcagaggaataaattctgcttttaaattttctatttaaaaagatacttcaaaattcccttcaaatttgatgaaaccaaaagtttgatttacccagacgttgaggttttttcttttatgggatatacaattattccatagtgacatgtcctaagataattttcatattcatagaggaggctgaaggtaggattttgtgaatctttgataatagttacatgaatgttgaatgtttgtatattgaacttgcatattctattaataccatctctggaaatagggtcatttggttataccaagttttttgtatttacatatttcaagaatatctatttaaatatatgtaactagagctactggcagataacttaggtctatatggaaattatgaataaacaaaagtagatgtgaatgaagccaagaaactcctagtgatataacatgaagtctttactcaagctttgtttagaaccagtaacaggggattttactcttttcgtgcaatggtccatttgtcagtctaattaaaaaaaaccacaaaacaccctcctcggagtaatataatgttattaaatacataaaatgaaatacagcggggcatggtggctcacgcctctaatgccagcactttgggaggccgaggcgggcggatcacgaggtcaggagatcgaaaccatccggctaacacggtgaaaccccgtctctactagaaatacaaaaaattagccgggcatggtggtgggtgcctgtaatcccagctactcagcaggctgaggcaggagaatggcgtgaacccgggaggctgagcttgcagtgagcggagatcgcgccactgcactccagcctgggcgatagagcgagactccgcctcaaaaaaaaaaaaaaaaaaaaaaagaaatacatagggttgaagagagaaatgaatcatattgaaagccaattttaactcaggagacaggataacctttttttgtttgttgttgttgttgttttttttttttttttggttaagcaacttggctttcctaacatctaatacttttcaaagttttccatatttgtttgctgcttatgaaaaccaaattaatgatgttttttcctgaataatctcatcatgaccttattcttataatgaaagaaaacagaatgctaaagctagggttgacagataaaatatagaacatagcttaattgaattttagataaataatttaaaaatagtataaatatgtaccaagtattgcatgggtcttactaaaaatttgttatttatctcaaattcaaatttaaatggacatcctgtatttttatttgctaagcaggcaacccttcaaaaactggtctaggttaacaaatgttagcgataaaattgccatgatcatgccctaaggaagtagaatcggatctactaagattcttattttatctccgcctgaaaaatattagccttatgggttggtttcagacctgtccctacatcatattttatgagttttgggaaggcaaatatttgctaaaataagatttaattctgtgctttaatgttttattgatgataatataaaagtggtaataaaagaatacttcacttttgcaaaaggcaattgaatatactgactgatatttttccagaaagtctgtctagttgtagtgacaagaagaaaatatctcttcctagattatctattgaaattccttttatcagcaagaaagtgtaattcactacgttttctcttttgcctttctgcaaaaggctaagagttcagataataatgtttaatagttattaaagtgaacttatctatccttttgtttaaacattttgatacatgtccgcattttattttcattttaactatcttattttattcatgttatttttctaagcctgatcaatttttacagaatgatcagattataagtcctaaatgaaatgccactaatttgaatcatattcagaatgtaatttgttaagtaacaaattttacaagaaatgtgatagatcatgcaaaaattataggtcttaaatcctacatatctcgaatcaaattattttaatactaattttcattgcaattaaaggattcagtaaggattgtaagtactttccattatactgaagacttggaacaagttctgattattacatattttagcatagatgacaggatgcatgcaatgtatcagcatgtaaaatgaaggaaagatagaaaaacagttgcgacaattttgtgcagtagtactatcgtgctgctatacaagtaaaacaatttaatcacacataacatagtaataatgcttacttattgctagaaaaacaggattttaattattttaatgataaatctgctttataattaggcagaaaagcaagctgtgaaaaagcaactttagtatttaattctagtgttaatttcaaaaacaaaaacaaaaaaaacccctgaaaaacaaaagaacacaaagacaggttgaaatgttccttttagggtattacatgctgtacagtgctttgtagtttaaaaagttttatgcccatgcctgaatgcattttgattctcaaagcatcttttggggtaggtttggcaggcactattgttcattcctacaaatagtttaaaatttttaagaaaaacattttagtactttattgaaaatcctatatttgcagccttcattcttaatgtttgtagcacattgaattttattgattgtaagacaaatttatttcaactggattgttgaaataaactctaaataactctaaaaataaactctaaaaatcatggtcacggaggttgagtcagattatgcttgccatttacctgtgcatgtgcaaacctcaaatacctcagccttaaaacttggagaatgagtgttcctgtggaagattattcttcagagatgatagtggagtactcttgaaaaccctaggtaccaaattgctgcagaagtatttgaaggacctggtgaatctaatatgttttaccaacatactacaagttgaaatcaaaagttgactgctcgtacataattgcaaagtcagatgtcagatgccaacatcaaaagctcttcaaaaataccacataaccaatgctctttgtaacccaagggatgacactgtgtggaaaagcacaaacatcaagaactctaaacctaaaagtgatttagacaagttaaattccaaatgtgaagtaattatagactgttaatatatttgccttataaatttgtatgtatatgcatgataaaaatctatcactaattaagggtaaaaaacttgcaacaaaaataagctttctagatattaaaaagcatatcatttaattgaatagatgttttccttcttgttacacagaataaggtgtatctatgtaataaagacgtgtaggatttgagtaatgctgtgctaaatacttactatcttgagttctggtttggagctatattgtcccatttatctgtctgtcaattcttatgctagtaccacaacatttcaattattttatgcctgtaagacatgctaacattttagggtaagatattatttctctattattcttcatttgcaaaattcgcttggctattatttcatattagtttttcaaatgtaactgcagaattagaatgcagaattgcttctcaagcacaccacactgtgcagcaagtgaaactgcactggagtcatgagcaataggcattttccacacttgggatctagaaacacaagatgcctttccattttttctgtttttcaaacgttactgtgtttggtaaagaaggttgttttttttttgtttgttttttgttttctgctctgggctatatatctttcaatgttaactttattctctaatagattatttcttctgcttattgctgaaagatgaacaacaaattttatgaagatttgtgtaagaatagtggatgaaaattttggtagatgttagcatttgcttatttggaaacacacgcttagagaacattcccactctgaccagactagaaatctgaggtttgacaagagtgacttaatttcacaccttctctctctgtcttttttttttcgtgtaaagaaaacagtcatcagcataagatttaaaatcttaaatgtacaatatgtttgactcatctgatacgttccgcctttgctgcaatggccttcaatacagtaaaaataaccacactcatgcgttagaatcatctgtgcaaactaaagtatatggcaaaattttaaagaaatcaccaacttcaattaatttattttgaaagaaagaaaaggaatttgcagtaatacttgaaacatttaaaatgaggattttttaaaaatatgctattaaaaatatgaatttatttaagacaatctgagatgactgaattataaattgtgtaaaaggcaatttagaatttttaaattatcaatgtatgtaaaatataggatatttcatttgttgcattgttaaattattgcttattttttaatagcataaaataaagtaaaggctatgttttagaccaatgttagtttttactcttatctatatataattggtaaatggagaaaatgtcagtgagaaatctaaaatcaaaataagatatgatttttaaataaattgtacagtaatttttctgttgaaattatgaacaatataaatattttatcatagttttctgtagttttcaaaatatcatatttgtggatataacccctgtttaatcataaaaaattataaatgactaaagataaaagaggaaaggaaatagagaagaagctattgtaaaaagaattgaaaagcagtgttttcctgctatttaactttgaaacagaaaactttttttgttgcaatgattcttcactacaataccaaaattctgaagagaatgttttcaggttaccatatcaccaaatcagcatagccagagaccaaacagtgagctctaaactatctttactagatttgaaactccagcatattatatttaccaaggtaaattatccctcttatgacaagtttttgttatcctaactgataatttagaaaactaaaggtcatttagtgtaaaaaacatagttgaaatacaattactttctcatatgtatcttaaaatgatatttcaaacttccttatgcagtgttgctatctgttaattctcccatatatcttattgaactagctttttttttttttctttttctttttttgagacacagtctcactttgtagcccaggctggagttcaatggcatgatctcggctcacttcaacctctgcccccaagttcaagccattctcttgcctcagcctcccaaatagctgggactacaggcatgggccaccatgccctgctaattttcatatttttagtagagacggggtttcaccatgttgggcaggctggtctagaactcctgacctaagggatcagcccacctcggcctcccaaagtgctggattgctggcatgagccactgctcccggccaactagctttaactagaatattatcttcagcctggcagttaaacaatttagtccagtagttacataccttaagaacatttagagaaaacaccaaaaaattactaaaaattctggtaaaattaatacccatgactagagatatgaaagtctggcattaactaagttgagaaagagctgttggaacagtctggagaataatatgaaatgttagaatgcaaggtcaatgaacagatggttctgcatttttatagctaacactactaattggaatggatttaaaatttagcaaacagagttcttcaagtgcaaattgttaagaaagagaggcatacattctttctaagtggcttggtggttgtacttgattattatggactggatgtggactagataataagatataaaattgacaagagataccatggcctgataatggtactcattttttatgtgtatgcataatttaagctatgtttttcactcatatgttctaatcactttgcattttttctcctgtactgtgtgggatttgagagtcgaggtgaaaggaagaacccaaacaaagagattgttcttaaaggcatgttagggtcctttgggttaattatacaaggtttgctgacagcgcctgataagaccgttgaggtcattctgttgttgacgtctcttcaatctcaatacgccactcagcaaaggccaaggcagatagagcttttccactatctttatagcacaaaatgctacgctgaagagagaaaacacacactctctctctcattcttacacccacacaaaacctgagaagcccaaactgccacacactttgttgatgacaaggtcagcatgataccttagaaccattcatttctttccactccacttcactttcaatatgcaattttaaacatcataatttttaccaccagaatgttacaaaaaatgtctgctaattgctttgtgtccaaaaaagaaaccaaaagaaaatggtattttgctttagacactaacaaaatgtaaagggtaaatgaagctatgtcttagtagtatggcagaggcagaggagcagggcaagaaacggtatgtaagacacgaactagtcactagtctcacagttctactgaaaagtgagctttatctagttgatgacatcatgcagccccatgaataataaatgaatacatatttattgagtgcttattaagacctccgcaaagctctgcctctgtataaatgagtgagatgaaagcactgttctcacaggaaggttataaaggagctgggggaaacattaatgcaagacacagatcataagagagaaacttcatagtaaaaacgataaagaacacatgagttcttccagagcaggggtccccaacccctgggccgtggacctggtacctgtagtggcctgttaggaaccaggctgcacagcaggaggtgagcagcggtgagccaggaaagcttcatctgtatttacagccgctccccattgctcacattaccacctgagcttggcctcctgtcagatcgtctgtggcattagagtctcacaggagagtgaatcctattgtcaactgtgcatgcaaatgagctgggttgtgtattccttgtaagaatgtaactggctgggtgccatggctcatgcctataatcccagcactttgggaggctaaggtgggtggatcatttgaggtcaggagttcaaaatcagcctgaccagcatggtgaaaccctgtctctactaaaaatacacaaattagctgggagtgattgtgcatgcctgtaatcccagctactcaggaggctgaggcaggagaagtgcttgagcccgggaggcaaaggttgcagtgagcagagatcactgctctccagcctgggtgacagaagatcactgctctccagcctgggtgacagagcaagactcggtccaaaggaaaaaaaaagaaaaagagagacagagagaatctaactaatgcctgatgatctaacgtgggacagttccatcctgaaatatttaccctacacccaagtttcatgggaaacccatccctgctgccaaaaatggatgggggctgctgctccagaggaccgatagtgcatgaccattaatctgtgtcatgggagaataaggtttttttgtttgattgttttttattgttttttattttatttttttttggagcccccttctgggcaagaaagaaagggatcgatgaaaaatatgcctcctatacagaaccaagactaaaagggtcgaggtggaataaaatgttcctatagttcgtaagcagccgtagtttggagtgctttggcatgtatcaatggaaagccaggatagtgtggttaggaatccatactctgtaaaaaaaaaaaaaaaaaaaaaaaccctgcctgtgccatttggcatgcttagttcaattattttgaatgctataaaaatagagatggaggagaaaaaaagatttcaaagtaggaaatgaaataggaagaatgttcaggcagagattgaggcaagaagggagtagagcccaggcagatcttatcaatgtgaatcagtctcaccataagtcctaacttccctgttgggaaagcaacagctcaaccagagaccagaatcataggttactgaaattgaagggcccagagaagtcatcttgtcaagcttctgcatcttttttatctcatggatcctactgactggtcataccctccaaaattctgagatttaaaaaatgcttacaataagttatttttctctgttaaatttctcagtcagcattggctttttttatttgtttgtttgttttgagacagagacttgttttgtcacccagcctggagtgcagtggtgtgatctcagctcactgcaacctccacctccctgcttcaagcgattctcctgcctcagactcccaaatagttgggattacaggcacccaacaaaacaccttgctaatttttgtatttttagtagagatggagtttcaccatgttggccaggctggtattgaactcctgatctcaattgatccactctccttgtcctcccatagtgttgggattacaggtgtgagccacgcattttcttctcttgtttctttcaaagtgaaacattacatgcccaccacaggaaattctttaaatgtgaacttcggaaattctaagaagcctgcatctgaaacagttatcatcagttggagttttattaacggccctgcgagactaaacaaaaatctgtgggcctttacagctagttcagagaactgggaatgagatgagttgtggttgctaaaaacataaacttactaccactctatgatattatttttccacactggcttttaataaatacgaagccacaggctgggcgcagtggctcactcctgtaatcccagcactttaggaggcctagtgggcgagtcacctgaagtcaggagttcaagatcagcctggccaatatagcaaaaccctgtctctactaaaaatataaaaaaacaaattagctgggcatggtggcaggcaccagtaatcccagctatttgggagactgaggcaggagaatcgcttgaacctgggaagtgaaggttgcagtgagtggagatcgtgccactgcactccagcctgggcaataagagcaaaactctgcctcaaaataaataaataagaagccacagaaacatggattaaagcaaaatttccacacataaccttagtgaaagttaaaacaaactaggattctaaatagtccccaaagtgtatattaatttacaattaatttattcagaagttttacttgaaaacttttctctagcatttataactcttcttatttatgctgttaagtgtcatggtatatatttaaatcacacttgtttggaataacaagtttgttttcactaaacatttctgatgtattaatatcatctgctttttacctgctatcagtaggaatgttaacagatttcgatatcttgtctcgttaacaccaaacaatgggtgttaagatgttttttaaaaaaattccttgttctcatgattatatataatatatgttatatattatatataatatacttaatttataactattgtatatagtgcataattttcaaagacaaaaacaattgaataagagatagactttcttcttataagttcatcagtttcaaataatcttgcatgtattacccttcctttttattgtcgtgttaataaagcagttttaaatatagctgagcttaaaatcagaatgtgtgacttttctgttagttcatagtaagttaccacaaggcctgggcccttggttaaagggtttgcctgattaggtcaggcttattcaggatgatttccactttgattaattcagagtcagcttgtaagagttcctaattacatctaaaaaattctgccaaattctattcgccagaaataaatcacaagttctgtcaatattcatggtaggatgtgggtggggaacgaggtcatacataggtgtccggtactaaggtgtgacaatcacagatgccatcatagaattctcattactacctaagaacgaattcaacagcagtatttcacccggaacatagtagctctcatttctaacttctctcctgtctgagctacttatggcataatgaaaacaaaaacgaagagctaattgcaaacttatgcatctataaaaattttcatttaaagttaatattgttatgtgtgtatttggtcctgtcattaggatgttagctggttattttgctcgttagttgacgcagttttcttcctagccttgatggtctttacattttggcatgtttttgcagtggctggtactggttgttcctttctatgtttagtgcttccctaaggaggtcttttagggcaggcctggtggtgacaaaatctctcagcatttgtttgtctgtaaagtattttatttctccttcacttatgaagcttagtttggctggatatgaaattctgggttgaaaattattttctttaagaatgttgaatattggcccccactctcttctggcttgtagagtttctaccgagagatccgctgttagtctgatgggtttccctttgcaggtaacccgacctttctctctggctacccttaacattttttccttcatttcaactttggtgaatctgacaattatgtgtcttggagttgctcttctcgaggagtatctctgtggcgttctttgtatttcctgaatctgaatgttggcctgccttgctagattggggaagttcttctggataatatcctgcagagtgttttccaacttgattccattctccgtgtcactttcaggtacaccaatcagatgtagatttggtcttttcacatagtcccatatttcttggaggctttgttcatttctttttattcttttttctctaaacttcccttctcgcttcatttcattcatttcgtcttccatcactgataccctttcttccagttgatcgaaaatttttgcaacctactcatctgacaaagggctaatatctagaatctacaatgaactcaaacaaatttacaagaaaaaaacaaacaaccccatcaaaaagtgggcgaaggatatgaacagacacttctcaaaagaagacatttatgcagccaaaaaacacatgaaaaaatgctcatcatcactgtccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactaattcaaccattgtggaagtcagtgtggcaattcctcagggatctagaactataaataccatttgacccagccatcccattactggttatatacccaaaggattataaatcatgctgctataaagacacatgcacacgtatgtttattgcggcactattcacaatagcaaagacttggaaccaacccaaatgtccaacaacgatagactggattaagaaaatgtgacacatatacaccatagaatactatgcagccataaaaaatgaagagttcatgtcctttgtagggacatggatgaaactggaaaccatcattctcagcaaactatcgcaaggacaaaaaaccaaacaccgcatgttctcactcataggtggaaattgaacaatgagagcacatgaacacaggaaggggagcatcacactctggggcttgttgtggggtggggggagggtggagggatagcattaggagatacacctaatgctaaatgatgagttaatgggtgcagcacaccagcatggcacatatatacatatgtaacaaacctgcacattgtgcacatgtaccctaaaacttaaagtataataataataaaattaaaaaaaattttcatgtgaacagaagactgagggtcaaaagaattgagaaaataaaataagtttacttgaaaaaaaagttgcaatgaaatctgattgcagaagaattggctgatcaaataaaaacataatgtgtattttaaggaaacaatgcaaaattatcaaggttaccaagtgtacatcagtctaagaatttgtttgatgggtttttatgtttgcttattttaaagaaaaatcaatttgtaagaatttcaaaacagcaaaaatgcttcatgttgtatttatattaaattgacattgattaaatgatgcctacttattccttagaagtctatccatgtaacatgaatactcttattaatgtcttagaaagtttacctgtatcattaaacccctcaactaaacctctttgattcttcttaatttttttactttatgttcagacagttgaattaaccatattttgttatgatacaaaaactcagttcctgtttattgttttaactttgtgctttttctaagttaaatggctctcacattatattgccatcgtcattagcattatctaagttcttctaaactttattgctgtgacaaaaatgaggaagaaatactgctttctaaaatgacattatgacttctttgctgtgaggtctgtgttgtaaatcatcacctctattccccaactgtgaaaggtaaagtccagtctctattgctctcttgagttttaaaacaacataacgtatttggaggagttaaaagaccttgctaaatattggtctgtgttaggaagtgtcaaaacatagacattacatacagaggaaagaagacttcaagggttaagtacattttcaaggtcatgacactacaaaatggcagagttggggcacacatacagaatttcagagtccaaatttttaaccaattttactttttttatatcgcattaagaggaatttatttgtatttccatgtatttacatgttgtacactattcatcttgtaacagcgtcacagtttttcaagtgaaacattttattatatttaaaatttttgtataaatatagctggaattaaaataattacataaaacaatgtttttaatacttttaacatctttcttttagaatagtcttagatggatcttgcacacgtattccaacaatgatgtaattgattaaaaataattgaaactatttattgaatagtcatctttttaatttatcatatgccttttattatcttaagcatgtaagatttccattgtttgatattagatttgaatttttggaaataagcctaacagtcatagaaaacagacttggtagataaaatatacaaccagcctgaataatacatttctttgtttttcctcaaaatgatttcataatcattaatcggcccatggcttactcctttggtaccatggtgtgtaaaatctataacatttctatgaaatcatcctcatctttgggagatttattataaacaatgacaactgaggtaaaaaaaaatgaaatagatatagtcttctcttataatttcaattagcataattctgtttttttttttttttttttttcgagacagagtctctctctgtcgcccaggctggagttcagtggtgcgatctcggctcactgcaagctccgcctcccgggttcacgccattctcctgcctcagcctccctagtcgctaggactacaggcacccgccaccacgcccggctaattttttgtatttttagtagagacaggatttcaccctgttagccaggatggtctcgatctcctgacctcgtgatctgcccacctcggcctccccaagtgctgggattacaggcctgagccaccgcgcccggccaggggatgtcttatttctctgcaaactttacaacgaaactcttaaaaaagacatgttagtactatggttttaatttttcttgtctcatttttaataatttactctgattaggctttcgtctccaactttctacaaaaactattcttgtcaatgccgtacatattaatgcctcctcctcactgagtctcatgcttagtcctcatctttcttgactcaacagtagtacttgacatggccgaactatttgcatccttaaaacacggtcttcacttggcttcagacattacttgatcttgattttccttttacattatggatcatatttcactcttttcccagtgttcttgaactccaattgttgacatgccattcttctcagtgcttgggcctctttatctacattcatggattgcatagtgttttatgcatttaaaaatcacccattcagtgagtattcccaaatttatatctctaatcctgtcttctcctgaaagcctcagacttgtatcccaactgcttatgtggcaatgtagactaataggcatctgagtgataaaaaattttcaaatctactaaggtagtttgaaatcctcttaaataagaactaagcatgacagtcaagctccttgggaaactttacctggaaagtatgttatatatccatacacctgacaaaggtagtagcagcactgggatttgcaacctcttagattactagggcctattaaaacaataataataataataataataaactcctctgtaggataagagttataattattgatctgtatgaataagataatacatggcaacaaacctttatttaaattgatttacaatttaagtttataatgcattaattacaataaaagctgtatttgttcaaaaatattgctaggcataaaaatagataatatttattaacgttagctaagtcaccataggcccttcacatatactgctaacttaaattgaggaaactattagtaagacttctgctttacactcaacgagataatctgcagccctccagaactctgtgctccacatttagataactactcatgaagataattcaacactaggagtcagagaaatctattcttgttcatttttcgctacttaccagttatgtgactttgataaagccacttatccactgtgagctttagattctaaatgcgtaaacagacatcctgttgcgtggtctgccttgcaaggtttttataagatatacataaaattaaacttgaaaacacctaaatgtgagacattatagttatttctgtagacacagtctaattattattgtagacacaggtatattttattcttcagttcctctcttgttagtatttttttttttttttttgtttgagacagaatctcactctgtcgccccgcctggagtgcagtggtgcaatgtcagttcactgcagtctccacctcccaggttcaggtgattcttttgcctcagcctccctagtagctgggattacaggcacctgccaccacgccaggctagtttttgtatttttagtaaagatggggcttcacaatgttggccaggctgatgtcaaattcctggccttaggtgatccacccacctcagcctcccaaagtgctaggattacggaagtgagccactgtgcccggcccctattttgttagtcctttaagggaccatataatcatataatatagtgggcaacctggtctctttctctacagattcaatttctaatcacgaaggaggagaaagaaattgagttgtgtctttgggtatattcttgtgaaatgaaattcagtggagtaaggaggaaaatatgaggcatatcaatggcataaatatttgtattttgagtggtgtagttggccaaaggattggcactagcttcaggtgtgtcctacttggcagtggtacaagtcaacatggttgtatgtgtcagttttgttacatattcaaatgtacagtataacaggagtctcagaggacactgtgatttctaaaaataagtaaggtaaaaatgggtttgtagttttagctgtttgtcctcttttgttccaattgcatacacatcaaatcaaattattcttgtggactgtttttctttatatgttcttcttctgtacccacatagaagaaatcataaactttaacaagatgataatttacatatcaaaaacttgatttaagccatagccagtacataaaaattcatttttgtttagtaggtttatgtctaattagctgaccaacagggggtgtgctaatagtgtcagataactgaagtaaatggtatttaacagcatggggttccaataacacaggagaacacaggagcaaccttctaggctttatttcattcaagtccataaagtcccctgtggtcgcagcagtgcatatttaaaatcagttaatcatgttactcatgggtgttggatatctttcaaaatggcctctggtaatgagctatttgtcctgcattgtgacaataagtctcttccataatttataaagctcatgcagatgatggttagagattccataagaaaataatgcagggatgttctacttcctgcttaattcctacttaaatacagttagatactataagtgcataaatctacatagtccacaatacttttgtgaaatatcatttcattttattatgatgatttttgcttttgtcttgttcaagtagttttaaattttggatgtgttggtgggtataggagtgactaaaagagagaaatgtctattgacccaactggtacttttcatactttttttccattctgtcattgtttgtcttaagtactctacattttgtaagcattgatctcatctttgcacactgtagtgataaggggtatgcatattcttacacatacagcttctcccctgacttaaccaaatatatcaagcaagaaaaacaaccctcttcagctagaagtcttcatcaagaaaacatatatgaagtatacatacgaatacacacacacacacacacacacacacacacacacacacacacgggagtttacaaccatacattacagagttctgcaaactcaaatagcattccattttctggacaattctatctgtagacatcagatgtactcgcaaaccgtacattgttgtttaaagttcttcaataagagattctaggcttttaacctgtgtttataattctaacaatctttgcatttagaatgcaaagtcttgaactctaacctttaagatgctggttttttacctttcagaggtcttctgacagggccctgccattgtacttccccatttcatatccttattgcccattaattaatagcttcaaggtttaaccgaacatagcctgtggataagttcttcttcatgtgggggtgtgggaggtgtgtacttcctgttctcaattccagctacaggaacatcctctctcaaacattgacatgagaacaagacagtgtaagacagtggaatcaataagctaatgaacatcaatacaaagtaaattctttcacctcaatttgaatgtgaagtaagattaatccttattaagaaagaaaatgatgcaaaatggataaatgtgaccattttgttttatcatgttattcaattcatcctaactgagcagttagagattttctagagtttggatggagaagtggatcatggtttcatgtaaaatattgattcacatggttttcagctttactagatcttggcaaacctttcctcctcccttcaaacacacacacgcactttctttaaacattctactttccattttcctttaagctcctaagcatgacaacctgggagcccactgtaaatgacttttctccaggtcgctgcttatggttacaacttctacacagaaaacaattttgccagtatttccctcatctcatcaagcacagcttcctttctgcaaaaacgacagcatccaacgtgcaatgactgaagttattataacatcttgttcaatgtaagcacagctgagttccttagaacatggtttgcctaaaggtcagatgctcaggctcaggttgggagagaaatgatattgaagggacaaaatagcaaacataagaagccacctttgctcatttctgcttcccagcataatttcccaaagcgcttggccctgtgacaacatacagtgctccaaaaaaaaaaaaaaaaaaagaggtcgaaacaaaataaaacataccccactacgtctcttgcatgagtcagtattccttaaaaaataaatgaccctaatcattgcttttttctaacataaaataatgtctgataggattaaaaattatgcctctataatctgtaatcatgaatcatataatctatcagtatcatataatctataagatcatatcttatcatataatctatatgagtgtagcttatagattacatcttatagataagatatactcttgtccctcattaccttaggggaagctctcgttcactggcagattgccatggctaattccagctgccgttcattcaaatgttaatacggatataggattttatttatttatggtagagttgtaggaaaacaaaatgtctctattaacatttctctattttgctaaaatattctgaaattataggctctgataaataatatgttatatcttataggtaagatacactgttacatccaaactttaatataattttacaggtactaaccccccattacctatatgtaaacatcagaatcaaaaattgatcccttgacttaactgaatatttaaacaagaaaaacaatcatctccaggtaaaagtcttcatcaaggaaacaaataagaagtatacacataaaagaatgcaccccgccccccgccacacacaggactatacaaccacacattaaagagttctgcaaactcaaacaccataccattttctgggcagctttatttatttatttatttatttaattttatttatttatttatttatttattttttgagatggagcctcgctcgcttgcccaggctggagtgcagtggcatgatctcggctcactgcaagctccgcctgccgggttcacgccattctcctgcctcagcctcccgagtagctgggagtacaggtgcccgccaccatgcccggctaattttttgtatttttagtagagacggggtttccccgtgttagccaggatggtctcgatctcctgacctcgtgatccaccctcctcagcctcccaaagtgctgggattacaggcgtgagccacctcgcctggcctgggcagcttgatttatgatccgtaggcatcagatatagatataaagtaaaaccctatgtcaaaagagtctgaagaaacacctgtctaaaagattttcctggactgtagactttagtctatagtcctcaagaaaacttctaaataaaacttacttccattctttaaaaacttaattttctttcactcaacgcagacctgtggagactaatgaaagaaagatcaaaggaagatattccagctggattatgaaggttgaggaaagatcgtattaatatgtatagaatttcaataacagcaagctaaagattgttgattagaattcattattctagagagtgttaaccagtttgaagagtggtctttttctaatttcaaaagaatccaacaacttaaagcagtctaaaatgatgattcaactaatcactaaatttaaaataaactgagcttgatatgattttaggttaagaaacagaatctacaaatgagaaagaaagccagtagtttatcctcctcctttgctgggttatgaggctggagtgggaaggaggtcttggattctgtttctataggtgaagaaaatcaggggcttgatacatcgccttactaggatgatgccaacaataaagatttcactgttagtcctaaatcttgtctgcaaagcagctgctgttatcttctctttgctgtggttcatcttaattagaaagactattttatggtaggaggaagtatagtcccatttattttgattatactacatgagaaattctaaaatcagagggttgaccctataatttagagagaataggaattttcagaagtgaatgtgtgagactgggcacaatgccattgtaatgaagcataaggcatagacatgccacttggaaatacatataattttttatgtaatgagtctgggaagttgaggaaaacctctcaaggctttcaaaactttctcttctgtgttcaagaaatagatatgaagacatgaatcaagttactttcattcctaaggcttcagtcatctcatctgtggaaatcaggcacttggcttccacgatctctaaagtctatctaactccactatgctgtcattctaactcttgaaatttttggtaaccacagaacattctaatgaagaaacagcatattgtcccttattaccttaggggaagcccttgttcactgacagattgccatggctgattgccgctgctcttcactccaatgttattatggatatagggctttatttatttatggtagagttgtaggaaaacataacatctctatgaacatttcactattttgctaaaatattctggaattataggctctgataaataatgttaatattaatcttattataatgtaatagcatattttatgagcttaaattcaaaagtatcccaagtgactttgtaaaaggaattctatgtgaatatatgtgtgtgtgtatgtgtgtgtgtgcgtgcgtgcgcatgcatgtgtgggcgtgtgaagttttgcagcagcaatagaagttgtgatgatatctcaaataaattcagtgactttaatattcttcccttttaatccagagtaaagtattgtggtctgactgatctctttgatttataaatctgaaaaaacttctctttgcttaaggggttcaaattaccttagtataaaatgcaaacttcttaacataaaataaagtacacctcagtaccagaattctgttagcctgtgtaagctttaggtccactgtttctctacctgatacaatctgaaatccagccattctgacctactttcgaatgcctgaattttctattttctttccagtgttaagcctttccagtgtctctctcctttgacagaagtacacttcccttgcctccttgcccgcaaactccttttcattcaggtgtcagctagacacatttgactttcagtgagtgggttataatcctttcatgatatcagttctacatctgagcacaaagatagacctaagattttaattgattagttaactaattcatatttaatgagcatctactactactgtgtaaaaacgtcacaaggaaacataaatatgaacaagatataaacccttgtttaaaatagaaatgtggaaaacacagacttattaatagtatagaatatcacatgcgaaatccaagtgctatgaaggtttagaatagagggagttacattttgttgaatttagagagcaatttatgtggatgttaccatattcaaagtttgcaagctgtatttgccctaaagacctttagctctgaaaggtacctctcaggctgctcttgggtgatttggccaaatatcaagtgagcaggtcttggatccccagattccagttcagatggagcagctccactgtattctggggcttaaattttgaaaaccactgtgtttcgactgcaataatggtatattatgacactaatggatattctccaggtgtttttcactatcaagaaaattgatgtataacaaacgtatccccttgaagtggcacttatttccccagtcactgacatgaaacagtgattcatcaattcgtggccttaagtgatactgaggtaactcaagacactatacacttgtcaggtgcattcattttcttctattagtatttatcagaaattacatataacatcgtgatgtttaagaacagcttagtaccctatgttaattgcaaacatgtcaatattttgtagcaggaattctgggttttgaaagcaagagaaaaggacatttcccttaagaacgacaaattcctgaaatacctgtggaagaaaaatgacatcttaactacagtacgactgacccatgaactccacaggtttgaactgtgcagctctacatacatacagcttatttttcgactaaatgccatttggaaatacaatcttctcaggatgcaaaatttgcatattcagagggcatactttttgtaaatgtgtgttttgtagggctgactgctgggcttgagtatgtgcagatttggtcatacctgggggttctgtaaccagtcccccacgtgtaccaagggactgtattttcttcacttgaatatgtgtcatagtacatgatttaaactactttcaatttctgtcttaatcctgttttgaactaaactaagtatgcttctctaggattcaagtgttcactgtatgaggtaaattaactcttccagtgctctagggtagcaattaatgccccagaggaggtaaattgctaaatggtaccccacagctttcggaagactgattctgtgtcgaatggttatgttcctctctggtggagagtagattactcccagtggttctttataggtcaggatccattttcaagtgggaaattagatttcatctgattggcaagctaaagcttctgaggtgtgtcatacaatagtcacgattagcctattgaagacataaatgtcggttatggaagctcaaaaagacagtaaataaatatgaaggcatgaaacaaaatattgggcagtactgcatatttgaagttttgtaagcaagtgagatttgtattttatcatgagctggaattttatatctttacttagaagcatagactattagtggtactccacaaacaccacaaatagtattcattcctctcttcatttattaaaaaatatataaatagatatatagacatgcagaaaacttttactctcgcctcctctttatgcatggttttgtgtgtattgcttgaatactctcactgattttaaaacacagtgctttttctatggatcttactctttggaaattttactttattttgaaataaaaactactttactatatgttatttgctcataatgtacaaatagttttgagtgcctattaagtatgatgcactacacggtgaaaacaaagcctggaatcctgacttcttgagctttacattctaacgagaaaaacgaaaacaaagctacacacataaattattacattgtgaaaagtgcaaggaggaaaacaggtaaggtatgaggtccaaggtagacagcacctggggtcagggaggtgggaagcagccacagatgaagtcgccattgagcacctcattcataagaagacacgcttcatcccgaagagtgtgaaggagcagcctgtgaatggcagagtggggtcaagtgattaagtgcaaaatcccttgaggcaagaaatatgttttcatatctgaggaacttcaaaaatacccatgtgactagaacaagctgggtggtatgagttcagatggagggaaagttggtgtcaggtcatgtaaggccttgtaagctaaaaataaagaagctgaattctattctaagtctagtggaggaagggttttaggtaggggagtgacacaaactgaattatagcaaaaatagcaatgatattaaatattcacacagcactttttttttttttttttttttttgagacggagtctcgctctgttgccagactggagtgcagtggcacgatctcggctcactgtaacccccgcctcccgggttcaagagattctcctgcctcagcctcccaagtagctgggactacaggcgtgtgccaccacgcccagctaatttttgtatttttagtagagatggggtttcaccatgttggccaggatagtgtcgatctcttgacctcatgatccgcctgcctcgacctcccaaagtgctgggattacaggtgtgagccaccgcgcctggcccacataacacctatttataccagagagtagcaatggtattaaatatttacatagcacttataataggccaggcatttttctaaggaatcaacatgtactaattttttctaataatcttatgacatagaactaaagcacagagagattagatgacttccgtaaaattgtggagctaggatgttgctgaaccaggattcaaggctgggcagtcacttacctgtgtggtagctagtgttctatgaatctgtctctatcgtctatctaacttctgtatttccaatctatttacatcaataatttaactgttaaaggttgtgcataagcaccataaaatggcacttgagttcatgggaacagattatatttttcagagaaatcattgttagaacacccaggactgagctctaagtgactctaacagtagagactgggtagaatgatgaaactgtcaaaagaaattaaaattagtaacccagtaataagaggaaactcaggaggaagaggtggcgaggaagaggtggctgacataggggagagtcctaagacaaaatcagaggtcaatgctgcggagagttgaaccaaatgacacgagaatatttgctagattacattgtgggatgtgtccatgaccctgagaagggttttcatgaagtaggaagttgacagacaggatcaagggtggatgagagagaatgctgacttagaacagggaggcagctcttttgaatttggtgttgtgataaaagagaaaaacagctggagaagaatattgggtcgagggagaacagggagccactggggatgccgaagagaaaatgataatgaaaatgttggctatgtagaccttcttgaagggacaaagcaagagagaattcaaagaataaatggaaggttcagcctttgatggaagagggacattctttgatcatcatacaagagaaaaaaagttgcttgcagggttgataaaggatggaaaagggcgaatcatgagtaagatctaataccgtttgtaaggaaccacactctatgctaaatgttttacatatgttatttcaagtaattctttcaaaattttaaatcattattattttttaaatttttaattaacaggcagtggatcttaggctcagaagaattaagtgatttgcccccaactgcaaatccactaattaccagagctgaaaaattaaggcaatcagcctcactccaaagcgtgatcagagagctaaaaatttacttagttattgaccagtcaatttgaagcccggagaactaaggctgacttacagagtatatgcaactcactgctgacagagtttcgtttagaatgcagttctcttcactcctactctagtattcttttcactgtacttatctatttttttcaattgctttagaggcagtatacattttaaagtaaaaatatatgagtattaattataaactttattcactgaaaatgtagtggtaattaagggaggaaactgtaatgattaaaattataagaatcaaatataattggttttcaagagagaaaaaaataagttaaaggactccgtatgactactataaattctcctagtgagaacaccaagtatatacaattagtttaaaaaaagaattttccaagttctttattaacttttaatcagaatgcaaagataattagacacagcctgtttatgtatggaacaatacaatgaaggacagtgttctgctttttggaagacacatacactacaggaacctttgaacatgcaattcagaggaagtttaatccttctgttaacaaatctgattaaaaatagcagtggcaatatttcaaaagttacatgtgtgtgtttgttaaatatttcttcccaatgtaatcgttttttaatcttcaatttttttcttataaatggttgtcaaatttacaagcccttactataaaatcccaggagaacttttaaattccataagaaaactgtatggtttttattcagtcttattatttattgtatactttcactctaattatgtaaatgtggtatcttgcagaatttttgtttgttttctttcttttatccaactgcctccaatgcaccacttcatatgcatgtcttttactctagccattgtgtgttatcataatcatgtctacccagagttcaaatggcttaatacaggtgtcacctcacagcacctctgctcagatcctgcagactttgcctctctctaaggaccctcagcagggcccacaggattgagcccctgttcctcaaaatggtggccaaattaataataaaacttgttttggtttccctttttccttttcattccctcattcttcacacatgctctccaggatggcaaactccaatgaactaagcactaaaacacttatagtaattaaatttctacctggagaagcataaaggacagatacatgtgtctttacttttcatatctaagtgacaaaatgaatcttaccttatcaaaacattcacagacacacacacagacttttatgtcagtgttttacaactacttgtctaggtttgtgattttataaaacaaatgttttagattagttaaaatattagaatttaactcattatgcacaaatgaaaaatgtgaactataatatggcaatgagtcagttgtgttttctttaaattaatcacgtggtcaaatgaaattcacaaaagagcctggggcaaatattttttgatatctgccattagatatgaaaacatgtctattaacttaataagccagaaataaaggggctgcttccactggaagtgaaaatgagagtaagtgtgcaaagtaactgaagttaaaccagtggtactattcctaattgcagtcacactaaatggaagaattcttatggtctacatcaatgctatacattaaaacgtgtattggcaataatagtgtctataataatgggagtatccttatttttacttcaattttcctctcatcatataatttgctgtgtcagactcaggtgaaataaagagggatgtatatatggatatagatagatatgtatagatatatatacacatagatatttgcatactgatggtgatttttgtgcatgaaaaagtgataatgtgttttctactagatttaatcattttctcaaaattctgtgacatagtgagaatttagacctgagagttttttcttaaaataattttttttatccgttagtctagaattttttaaatgccagaattataaattcattttgagtttttgggatgtatttctgataataacatttttctaatcaagtataagttattagagtattaaatactttaataagtatacgttattaaaaaccatttatccggacaaggcacgtcaattgctttgaatctgcagggaagaaaccgtgtgtcacattactcttcagacaacaatcataagaaataaacctacaaacaccaaacttcaaaaaaaaaatcctgcacaaaaagtatttttgaaatcagatgatgggcccaagaagaccaaagggatttaggatatgtggtcaaagttgttctttgatgtgtgtttgtgtattcagcttgtccatccatcaagggctccacctgtcttggagatattgtccatcatttatttatgtgcagagagactaaagtccgaactgatcttcatttcagtcatgcactgaatataagaattgtggaaaacattttggagctaagatacaccctttttttctgaaaagagaagttgtacttcacaggcattttggagtcttccagctcagatttacttttggaaaatgacataaatttcatagataatcccctgatccatctttagacagacctcaacattttgtcaggtcaaattatgaaacagaatcttacataagttttctcaatcatatctttccttgaaagaccatagttaatttcaaaatagacagtatatgaaaatagctgccttgagaaatatcagttaaactccagcattgtatgagaaccaatgaacaaacaacattctcatctctgccaaagttttcaaggagagtgcatgatttcatcctttagccatggtgattcattgttgatgactaatatcatggatgctcacatttatggaaagtactgtattgacacacattgtactacctgctttatacacatcgcctaatttaatcctcataaaaataccatggggtaattattatcaaatatattttaggttaagtaacctactcacttatcttgtaagcggcagagcaaatgcagttatacatttcattctatgcctgcatgattcagaaaaataaaacaaaaacatgtaagcctttggtgtacttatatatcaaaaaccaatttctttaatataagagtttaaaaagctgtacataatactactgtagatgaaacaaagtgtaatggaagacagattgaaaggaaatttgttactattaggatgcttgcaatcaaataatggggataaaacaagcacatacattcctcatctctgtatagacttaacattttacagagtcctttgagagactttaattttattgtatcaaatttttcatgtctaagttatctattcctttcagtctattctgtatgtaactcaattgcctttttgcctttgctaacacagaaatccattaaaatttttaaattaatggacattttaattacatcttcttccttagtactaataaaaatttatatactatgtatatgaatatgcatctagatgactatttcaatatcaatatatgaggagataaaatgaattttccacaaactatgattctgtgtcatctaaacattagcttgcacaggccttttaaagaaagcagagtgaggactccctggccagtgttctctaccatctcttctgcctaccttcttttctctcatggaagtaagaaaagaatccatttcatcaaaggttgaacattccacttcatccctgaattctctcttgctttgagttcttaggtacatctatattagatatcactttctcctctgcatccccaatgcccttttccctcctcagcatacctgatcctctgtccttgctgacctttgtatgtgtgtgttttctcccttgatgacatatccctcttcagctattgctctatttatattcagaatcccaggcaagcaacataaatagatgtctccaaggagtaagtgatttaattagcttgaagtattatatatattttcacacacacagacataaacatatatatgtatgtatgcatataaaacaaataagataaataactggaaaatatatgcaatgaagtcagtgaattagcagatgagataaacatcccagattggtatggtattgtacggtacggtgtggtatggtatggtttggtaccacaaggtctagtgtttagagctggctctgccagtcactatccctttgatactgatcaaatcatacaaaatcagtttcttcatccataataaagccttcccttgttactcagagttgctgttccagtcaaaaataaaatgttaatttatgatacagaccttgataagctgtatgaaccttacatgatactaatgtagtaagatgcaccacggttcattcagataagtgtcccagtgagtcctcagttttcacaaagtcatttcctatccccagttttgtttatttgtgcacctctgcatttacctagaacaagaattgttatattctaagtaattgccaagaagtatggtaacaaattcactactacttgattcttcagtggagaaaattatatacatatatatatatatatagatgcttgcctaaatgatatgccattcttccatacttttaaatactgtaacttgtgttattgaattaagccagccagtcaaaagcttgaaattaaacatagtattttcctatgaaatatattttttaacattataaaataaaatttggaataaaagcattatgtatatatatatatatatatatacatatatatatatactcataactcttcattcatttttgtgaatcagtctcattcgtagttttattgtacttccaaatcttcatttttctttggatcattttcctttgccagcattacgtgtgtgtatgtgtgtgtatgtgtgttttaaaagggccataagaggaaaacagcaagaagtctgtctcctaactttgaaacctaaattttagttttctttcacacaggaagtcatcttgtggatctaataatattatgaagttattctctttttgatggacatttaggaatgttttgatgtttcgtacaataattcaagttgcaagaaataagcacacacattttgcaagtacatctatgggatatgttctaaaaaattaaagtgcattctttgtcccttaacctatgatacgggcattctttattttgatagatgctgcagaattgtcttctaataagtcataggaatttacgttttcagttaaaatgtataacagttcttgttatataaaatgtataacagaaaggacttttgatttctatccatctgaatgatgaaaaatagtaagttatttattaaattattatttaccttcacatatgtatagtggaacactgagcatatgtttaaaagctacttgagtttttaaaatctgtaatctgtgctttactcattttctttattggctgttggttattttttactgatttttgatgcccctatcttgttaagaaaataatatttttataatatatcacatttatcacaagttactgtttatctttgagttttcttattgaattttgacatacacaaatggctcatatttactctttttatcagcagtgtctttgttagttcctggatttgggatatgcttagaaaagtttatcctaaacaaagacttgtgtacttttaatttattgtcatgtttaaatcgttgctaaatctggaatttattctggagtaagaagtgaagtagagttctaactttactttgattttgttttgttcttattgttgtttttcttccagatttgttatctagttgtataaaaaccaatgattaaaaaaaaaaagttttttcttgctgggcaaggtggcttacgactgtaatcccagcactttttgggaggccggggcaggtggatcacttgaggtcaggagttcaagacaagcctggccaataggtgaaaccccatctctactttaaaaaaaaaaaaaaaaaaaaaaaaaaaaattagccggcgtgacagcatgtgcctgtaatcccagctacttgggaggctgatgcaagagattcgtttgtacccagcatgcggaggttgcagtgagccgaaattatgccgctgcactccagcctgggggacagagcgagactccttttcaaaaaagagaaaaaggaaaaaaaaaacatttttccttaatgattttcactgtcaaaattattatttattaattaaatatgtgtgcattttacaagatgtcgagactttgtatcatttgtttgtctattcagacaccagcaccaaactgtgaattaatatagccttaacatatgctgaagcatttggtagaactagtcgccactcattaatctttttttcttttgaatactaaatttttatgtaaattttaatatcagcgtgccttgttccaaaggaaaccacaaaataataaagacaaagacaaatgaaagaactccccattatttgtatggcaaatgtgtgtacttatagaataatttggtgatttatatttgttatgtttataatatggatccttatccaaaacgtgcaaaagcccatttttatatgtaccttaataaagttttaagatttctttgtgatctatcaaatttattgttaatttaaaagcttgatagagctatactataaattgtatttccttaattatgttgcaatagtaaatgttgtttgtatatgatagctaagaatttttaaaattttaattttatattaagcatctaagatgaattattctagaagatgtaataatgatttttttctcctcttcaattttctatatagctaatcataccataattatcattataattttataattctgctccatccattttctggtgtgcatctgctatttcatcttttttgcctatggactacccttgcaaaatgttaaataatggtgataggagcctcaataatgaggcttttgctactttaacaacatacagtgttaaaatataactctcttgttccatgtgtatatttacatatctatccttttaaacttatgtaagttattttgcaatataatatatgccagtattagtttttttttttttttttttttgagatggagtctcgctctgttgcccaggctggagtgcagtggcatgatctccgctcactgcaagctccgcctcccgggttcatgccattctcctgcctcagcctcccgagtagctgggactacaggtacccgccaccgcgccagctaatttttttattttttttgtatttttagtagaaacggggtttcaccatggtctcgatctcctgaccttgtgatccgcccacctcggcctcccaaaggccagtattagttcttttgtgtcatttaaaaatattttgccagctgggcgtggtggctcatggctgtaatcgcagcactgtggtaggccgaggtgggcggattaccctctgaggtcaggagtttgagaccagcctggccaacatggtgaaaccccgtctctactttaaaaaaatgcaaaaattagctgtgcatagtggcacatgcctgtaatccaagctactcgtgaggctgaggcgggagaattgcttgaacctgggatggggaggttgcagtaagccaagatcgcgccactgcactccagcctgggcgacagagtgaaactccatctcaaaaaaaaaaaaagaaaaaattgcatatataaatttttaaaaatatgttatcgttttaattagaggagtcagagagaaataaaggtaattgtaaagaagaccctatatttacaaaataggacaatgaagaggatattagttggggacagaatgagtggaaagaacagatgttaaaatctatcttaattaagaagcacacttaaaggtccatttataacgctctcagtactcatttttaccctggccatatctttatcttgagtaactaatgaagtagaatacgacctatgcagttatgctaaagaagtttcgcgaattcctaatttcttttcagccaatgccatagaatggcttatatgtattataaatggttttcagagtagcagattttctaacacttaaatggacacaaaaagataacaaaccaaaaagagatagacagataaaacacttgaaccatttcatacaaaatttctctgagatttgtctactttttaatttatttgattacctatattaccattcctccatttacatgaacaaataaaagtttattgaaaagttcaccacatgttttaaaagcaactgaaaccaattttaatttctaagaagtaatgttattttcatgttcccaaatgatcacttcaaagaggcgagtaagaggcgagtaagaaggaatataagctctattgttaataaacctagacgtaccctaaatgaagaccaggagtgagtgaaggttggtaatttacttagtagagttgaggaacatctactctaggattctccacaggagttcagctcaaatgatcatttgaaaaatgctaaggatgcgaagagagagaaggcaccaaaaagaaggcaattggaaagcaatggaggtacagaaaaactcttttccctcatgtttgtataagagacaatagaactttgggttctcaccacaaaccttgttcattcagatgactacccatcttccagctgtctatgagacagatcacatattacctgaaaaaatcgtgtgaggagctctggagaaaggcatgtgataataagaagggtgaaactagtagagaaaattaaaacattaagggaaagtcagcatgctgaatggtaagattatccacttcgctgtacttcagaaacatggcagacattgaaaaatccttctcagggcaaatagatccaccttggagaaaagacatttaactgcagacatttggggatcttccacaaacatctaagtaactaactaacgtttacaaccatgaaaccgtgaagtggacacgattctcttcagtatcacagagtctctatttagctatttggtgcctcgccttaagccagaaacaagacttctaagtatctccaggcatttgaggaaaccttcagacatataaggagagacagtaactatacacagaaaaataaaaggaacttaacacatacacacacacacacacacacacacacacttaggcatgaggtcaaagcatcaaaggaagcaaagtgagagaagatttgatgtctttatgaaagcagaattttcttttttaacaaatattagaaatatgttgaaaaaaatggaggcaatctcccataaaatacaccagaaagataaaaggatggagtatatgaagcagtataaactcaaagcgtccaaaatcctagaattaagattcctggaagaataaaggaaaaaataaaatgatggtaaaaaattgccataaatataacagagaaaatattcccaagactgacagacatcagtctccagacataaaacataattgagaaattttatagaattggggtacatacggaagatccacaatggcttccagaaataaaaggtcatatacacgttatctggaattgtatcagaaacaccattctgaaaattcgaagtaactggatgaaatctttcaaaaagttgaagaaaaatagtttttaatcacattcctaaacaggtttgagaatgttttaaaactttcaatcatgtagtttttcaaaatgtgtgtgtatgtactttttctggtccaaggatatatttcatttaaacaggggtgtcaaccaagaaagaggaaggtatatgaaatagttgaagttgttgcctttgggaagcaaaatagacaaaaaagataatggttacagaactagggttggctttgtttttttgtttacgtttttaatcaaatttggcttttaaagttgtatatgtgattatgaaaaaaaaagtggctttaaatgttctaattcaaaagtaagttaattaaaaatatctaaaatcacaaatgataaagagcttccaaatttaaagcatttatgaagtgcacagattttaccagaaattcactcacaaatcttagcaatctcgatagtcatagaaatatttaatgtcttctcactaaatgtgttgtatatccttgctgttaaaagatcagttatccttatacttacataaatatgctacaaaagctaagaaaaacgggatgactagaaagatattcacaagaggccacattatcattaaaaattcactttagctgtgaggaaggatttaaggaaagagcctgttcttagtaggaggcctttgatgtagctgaataagtgtgtaactgatgtgagtggaacctttttaattgacactgacaatgaaagcaaatcttctgggctgctcatcagagtcagaggggatatgggaaattaaatattgtgttctagctttttctaaagcctataaagataatcaaacaagaggcatcttttaaaatctatttgtgagttgatgccattcatacggattaaaataaatagtacttgaatatatgtggttttggtttattttaagcgtcttttcaacaattttatgattttgtaaatggaatttacaactaagtaagtgaatgtgcaactacagaatttgtttaaaatctgatgaagtattatcagatatttacgctgatatgctagtttaaaaattctcatatgctagtttatatatttccctgaagaaaatatattaaagtgtgattcagatattatttcaactgctgatagaaccacaaagaaacacattacatattgcctttgaaagatacactggaaaatttatttttaaaacttcacttgtgttcacaaaaacaaaacttcttaaagcaatgtcatttccctcatttcactgtttcaataaacaatacatttactaactagttcattgcttctctgttaccagactatctctcaacaattatttcaaccattgcttttactttcctggttgaaaagaaatgcttttgctctttctctgcactactgtcaccagtcatattgcaggagtatggactccagccagaataaacctctgtgacatctgcagagacatgcggagaccagagcagactcacccaaacaatcacagataatcttcttccagctaaaaccacacactgagcttcagcaccagtcctgtcagagaagggattagtgggtgccttttgctgtttgcggtgtgaattacattcatctaatatgaggctggattgaatcctagccttatggtcctatgatgaaagaataataaaagattggtggcataaagaatctaacagttcctattctccgaattataattagttattactacagtttatagtttcttatggcaaattttgtgagatttgaggcatgtttaatgaataactctgattgcttttaaaaaggcaaccaaacaatgaaataaatatttttcccatttaagtcagttatttaaacatacttgattttgtagatgtagattcgatttcatcgtgtgacccagtgtacaacactgaatgatattaagcaaggtctcctgatgagaaattcttataatctcctataacttactcttatgtaaattcccttaaactatcccttcatcactgtatgccagatacgtgggaaaatctcccataggttaaaccttcaccttctctttgccttcaccctaacagaaaaaaagtttgctgaagaaagtcacacaaccaggttgactggttttactttaaaatcatgagcgtataactgccaccaaattgacactcagcattgtagggtatcttgctacctctccccagtaagatagggttcccactcttttagttggctgcttgccttatgtttcagtaaaaacaaaactataagagcgagccaccataatctctccacaacctaatttagaagtttgctagtacacatatctatagtctttgctttttacctctggatacaatggggaaaaaaattgtagcttctttttttaagtttaattgcacttcttgtgctccgaattccttactctcttagagtcttacagatttaatctattcgttacctttgttctttttcttcactgctcatctctcttctaaataatcattctcttcagaatatacagaatacaacatgctataatatttctcatcgaaagcaaacacataaataaaaaaagaaatgttaaaaaaaactttacaccataagggttttcagtttccctcattttttggctttctacctatcaaaacttcttgtaagagttttctatattggctatttttattttctgttatttcatctgcatgtattgttattgttttttccagtttatattttaatcaagaaataattcccagactttggtatatttctcatgccccatgacttatctgaacacattgttacggtataaatgcatgtgtctcatccaaatctctattgttgtaaccaaagacccaatttgataatattaagaggtagggactttagggagtgattatgtcatgaaggctccatctgccctcatgaatagtattaaaatcctaattttagggctcaagagaactagctaagcccttttgcccttctgccttttccaccatgtcaggatatagcattagtcccctctggaggccactgcattcaaagcatcatcttagaaccagagactgggttctccccagacattaaacctgcaggttccttgatcttggccttctcagcctccagaaatgtgagaaaataaatttccattcttatataaaatatacagcctccggtattttgttttagcagcacaaatggtctcatacacacattggcaatgtaatgaaactcagaaaaactctaggctctccactgagtctaagttccatttcattttggcttcctcacttcagctgcttttattgatgtcaccagttgccaaattcaacacagagcaatgtgctctcttttgtactttgaattatacaatactgtggaggattttcgcctataaaagtttttccatcttagcccaagtgttccacatgcttctcgttttctcccattcttgcttacttgttctcctcaaggtccttttctgttttctgccgtctacctgctgagtgtctaggtttaggctcctttcaatttctatttgctctcttactttaagtaccacctatatactgatgactattaagaatatatctctgaccctgatggctcccttaatcttttgggtcatatatccaactgcatgcttggcagttctactggattgtctaatgagaatctgaaacatactatgtccaaggagtaactctagacccctcccagtcactaccggccactctctacagccacttgatcaactttttatcttgccaacttctctgtctcagtaaacattatctctgtctacccagttgctcaaattaaaagcctggaataagagtctttatctttaatgatatatactaatatatttagagtaaacttatatgatgtctaagatttgccttgtaataattagggcaggggctataaaagaaacattcatcatgagttattaattgttgaagttggattatgagtaatataacatgcaaattctgattcaataggcccaacgtggggcctgagatgctgcacttcaaacaagctttgtgctttcagtacctcctacctcatccacaattcttatgttactatgctacttattttcttaatgggaatttcataatacttatctgcacttacttatctgttatccttgttaattttctgcctttctccctataagggcatgcattgtatatgtcttacttatcgccacatcagaccagctcagtgcttggagagtaggtgctttataaatatttataacaatgttatggagggcaatacaggaaataataacaggtgaacaataggtgtagatgttagtgcagtgccatgaaactgaattttgtaatcttggttgtgagattacaaatgatatttgagtttcactctcaaaattctggattaattggcttgaaatgttgccttttgcagagcttcccaggttaattctaatgtgccagcaaagttaagaaccactgccttagatcatgacgatgatgatgatgatggtgatgatgatgatgatgatgacaatgacgacaacaaacctaccatccactttgctctttgcttggagctatttcaagtactttatgtgcattaccttatattattcttataagaatcctatgaagtagatactgctatggttatgttagaactgaggaaattgagatgtagaaatggtatataatttccttaagatcaaccaatttatacatcatgaagccagcatttaaccactatttaaaccaaggcaatccgagtccatacccttagccattgacttaagatgatggcatacatgttacaagcactgggaaacaaaattgtgtgtatttttatttctaacatatcactcatctaaacaatgtgaaacacaatactcaaatatggcaaatgaaggagtaaactttcttgttttccctaaaatgacgactttgggactacttatacatttgctgaagcaaagtaatcattttaggtcccaaagctatcattttagagaaatcaagaaagcagagagacagagataaaaatacaaggaccatcatgaattatcaataactcaagaattactgtgcttggtttgaacaactagagcaacagacatgagccctgctcttcgcagagattgttctggtcttctctggctctcctttgcctgcatcccacaaggcacagtgtgtgtggggcctaggagacttgcctatcttgagcctgtgcctctacacacctcttttaaaccaatgctcttagtacccagaaccttgggattttctgcagaatgggtgcctctttcctgggtatgttttctcagtgaagagtaaaggtaattgtttgagaggagggtgaaattgtaatttggaccaattaactggggactaatttgtgtgtgtgtttcagaggcttatttggcatatgtatttgagggatgttatcagggaggaaattggggtacagactttggacatctacttgcattctcaccctaaaggtgcatctgcggtcaaattccaattccagagataaggtcaaggagttaatcttaagaaagtaaagggtaaatcttgaactgaagatgagactctagaaatactctgttatcttaggtatttgaccaatggcaacttcttccctattccattctcagactccttgaggaatttggcaataggtaacgctactcatgttaagttgctataagatagaaatggggcttccattgttcactcttcctgtgttaggagaaccaatattgcagtttgtcatcttgtggacattacattctcaccaaagaagcctcctttgcctcctccaactctgtttgacctagagattgacaaaggaatctgcttaggatcacttgggattcttctttctataggcatgtgggacgataatttgggtcacgtcctgagattttaaataaatttcaaaagtgcaatgaggagtcagctttgtaaaagaaaaaaaaagacacttccataacagaatttttttgtagctttcaaatttagctaagcatttgtttcctactgaataatcaacacttacagagcctgaagttataaatgtaagctgttttaaaattatgtacagactttctgcaattattttttctagaacaagaaagtgtattctctttccttttcaggtaacttaaaaagagctgaatatgttgaacttaatgtgctttatgagaatgctgacttcttaaatgaaaataaaaaatattaattttctgcttaggaaatgttgagaacaatcagtctcataatgattttgcattttaactgagcatatccctgtatactgcaaaaaatacactcaaattgcccatagctaccatgaaaggtaatgatgcagtacacttaattactgtttagcagtgcttttttatttgagtattttgaaatattagtaaaagcgttatatctcatatttttatgaaggacttcaataaaaatgtggtaatggagatcggttaaataagaatttcaaaactagaagtgattttttttctctaaaagtaactgatgtcgtctttttagaaaagagaagaacaaaattaccatggaaagcatttctggttttgtctcttcattattcttggcacaattaccaaagatgttttgaagatcttggccatcatagtaactgatcttatctttaaccatcataaaaaatttctggtgtattaaatgtaccaaaatattttaaaatattttttcagttatttgttttgcatttcccattactctacctatgtataccatgttgagaaacagggacaaattattctttgtttgtatcatttcttactgtatttacacataagtacatatgttactaacttcaaagaaaaaaaatatttcttgcttcttatgcacgttctttttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctgcacgttcttatatactcacctcccacaatgactctgggcttgaccatgtttctttggcccatgagatatcagcgaacatgtcacaagcagagactcaatgcactttggcacattgggacatgcttttttaatcattgacctgagattgctacataggaaatatcaaatctattaggcttttgttcacaaatttgagaacaaatctataaggatcttattgaagaattgccatagtagagttacaatattaatcaaaaatatattaacttcttttttaaattggatgagaccatgtatcctagagaaagactactaactttagaattctgtctcctctttccagatatgagaccttggggaggtcatttaaactctttgtgcctgcttcttcatttgtaaaatggtgataataacagtacctaccttgtaaggtttttatggggaactaaatgagttaatattttacagtgcttaaaatattatagggggtacataaatataatagttgtcaaataaacagagaaggattagacatcggggttttatgaggacaagctctttgtaaaagttcaaagacctatatcagttacatagagagtaaagtaccagaaagaagagctaaagataagggcttataagattcattttattttgggaagaaatctcagggacagaagtaaaggactagagagacaaagaaggagggaaacacaaatacaatcgtatttttttactgctggtccgctgggcttgatcttgcctagggctctgtagactgcgacttagaaccatttgtcccagggaaaatcagaaggcagcgtttatccatgagctctcatccttccctgattaaggtttgcccccatatgataataacttctttggaacttgaatgttgttaataaaggagttgtggttgagtttcttcaggttgctgttttggtagcattaaagaaagcctattgaaaatatcaagatatttttctggaaagcttgagcaaggtattgtcaggttaaacctgttggaaacttatgacaaagtaatgcatgaaataaagggtagactgaaagaatatgaggcaagaactaagaagatgcaatgggggaacaagtagatgtcacctagacttccagacgtttgcatcttaacattgcagaagcaggtgcaatcgaacagaaaaacaagaaagaatagtgcatagaaaaaggaagatggtaacctacttgaagagatgaaaggaataaaataattttcatgataggcaggaagaagagtaattggggaaagcattgatttgctgaatgttttcctgtgctatttcatttttatctaatttttgatagagaagtttgcttgaaaacaaggtaatttctgaggttttctgaaaactatgtcaatgttcattaggctacaccaaacttactattaataaaattgcataattactttataaagtacatataattacttttcaggtagctccatctagcaatttaacaaataaaatagataagtaacatttaaaaattttgacaccaacctgaccatggagatgcatagaattctgtaaataggataattcacttaataagccagaggtgataatccaatctccatatcaggatctgcttaaacaaataaagttagcagtcctcattagtgctgtgaactgtacttagatgcttttagaacggtgctgccatgagttatgactaaccgagaaaaatgtattctatagccaaatgaaatcagaaaaattatttttaaaaaatatcaaaccatagatgaagaatttgaaacgactacataaaacctttgaaaattaactcccaatgtaacctatgagattatttttagttaaaaaatatgattttccccttcactgataattttctccaaaaatctctttcaaccttttgaaataccattatagctgtaaagccttctggcatagctggcattttcattgaactcattgattaatttagtatcatggaaacaatgtgaatctgtgtgaaatagctacagattgtgagagaagttggtgtactttattctgaaatgtaaaaataatatgctgcacaagcatgctgattttaaggaagccatcagtatcatagactgattaattctgtgttgctttgactgctaaaatgtgctcttccaatcaatttcaatccaattaataaaaattataaactggatttgaatatctatttaacattaggtcttccatgcagtttcacatactgtatatcacttcacaagcagtatggcatactggaaaggtcctcaaaatgggagtcaggtagctggtttttaacggcatttctgatgaaaatgatctggtggaaaatttgggatacctttctgcatttacgtattatttatttcataaaaaattcagctacatgattttaaataccccatacattctaaattgtaggatataatttaatatagattcactttttggtgtgacctaggtgaatctgatctttcaaattactagtttcaaactttacacttacacatttcccactgctaattggtaggaaattaacttggtatatttcttatttcttctgttttattagttttgtttttataattttgatttcctttgataaattctgaccatagacattttgagtaaaggcacaatatatcatttggacaatagtcttgttttcatttggatgttaactatcactatgaaagtggagatgccttttttggaagagttatcatatctagagtcagtatctctggcttttttatgtgttagcctcagcaaggtttttgatagcataataagtatcaatgaattaggttaattttttcatagagaatggaaaaatcttaccctcaacctgtttgttagctgtaatgtaaaagagtgtcactgattcgatattgagctttggctcatgctcagatggcttagacagatgggccatacaagactctgggcatccaaagtctcctgcggagaaaggaacaaaaaagaaatttctgaaattcactgagcatcttagaaaatacccaaagaaatatatcagaaagtaaaagtaaaataatgcaaaatgtggtacataaagtgaattgtgtgctcctcttcccagaaaaattagcaaagttaatgccattctaaacccaatcatattgttagaactttcgttgtacagaaattatttctgcttattgacatatgaagatcagtggagcacaagactcctagcttgaaacatttgatcaagcagtgaagatatccagcatatcataaaatgagaatcataaaaccatgctgaaggagtttgtgagtttagccttttctgagtcatcaaagacaaatacttattaatagaattgtatgttataatttattatatgaaatttcagattttattttgagctaccatatcctctgtaagtattaaatttattagtagttaaatatttgaaaataaaccaaaaggtatttgttctccatgtctttttgaatcaagtatcattgtgtaatcttatgtagagaaagagtactttgtaattgatcagtttattaataagcacaatgtttcttacaagagacagccaagactaatggttaaaaaaaaatgtacatacacacatactcctcagtgaagaaacagaattgggtttaaagttgggactatgccttttgtcttctgaaaggccttttgactccttgactgtgttagtcttttttcgatgtaattattacttcccctaccataatgtcatcacacttcagtagtttatttgcctgattgagcataataataattgagggcggtaaatgggatgatctggttcactattttatcatcagtgtttggagcaagccagaaacatagttggtcttcagtatatttggtgaatgaataagtccttatttgtatagtcactagactatacattgtcaatcaaagtggcgcagcatatacatgttaagctgaactcaacttttcactgatccaatttgtgctgcacccttccattgtatgaaatcaccatattccatttttttttctaccactaggtttccttccagctctaacatttcttaattctactgatataaattattcataactcctattgcttgtaatcttgttgctcttccagggctagaaaagtcctaaagggcttgcctagggattaaagttaattccctacagtattcccacctgtacagagccatggcatgggtagtgctgccccaggggaataatcttgggtttatcttggttttaaaactggtaactgaaaaaacaaaacaaaacaaaatgcaaagaatacccacacatcccaatcaagtgacatatatgaatgtttgtttataattcagctaagaatagttaattcacgtcatgcctcatgattaagtgcaaaccatttcaaaatatgaaacaaaacaaaagataatttaaagtccagccaagtaatctctcttgtacttgaatttggatgagatttatttgatcttctcacctaaattccatttataattagggatactcttgcttttctgctgtctcctcactggagaaccaaatggctggagattgactgattactgatcccttggggtttcagagaagctgctttctcataatatcagagttgaaatagttttcattccgttgcaaagatatatgttttaaaatgcttacagtaatgggttgttaactctatccttccctggatgaggtttctatagtaagctgtcattgtattacaactgttttaaaggatagataaagtaaaccaccttctaggtagtaaatggcaaacaatgtgtttccattattgaatttttattttcataagcatatcacatacaagtagtttaaaatcagatagtactaaaacaggcttataatgaaaaatagcagattactggcctcattccctgctggccttatccccaacaggacaacttgctgtcctgctccctgggtcaatagctttcactttcttagctgtttcttctggtgtttactcttatattcataaataaaatatatttactagtatttctgaataagtatattttatacatgtatttattttctatcctccaacacccaaactcccatgctcatccctcctcccctccatttgtcccattatagaatatatcaaaagtttgaattaaagcaatgttcaatgctcacattattttgggtacatagctactgtttaaaattaaatcacttggaatactgtaacttcacattatgttttatgttttatttgtatttgtattaatttatttttttgaaacagagtctagctctgtcgcccaggctggaggacagtggcatgatcttggctcactgaaacctctgcctcctgggctcaagtgattctcctacctcagcctcccgagtagctgggattacaggcgcctgccaccatgcctggctaattttggtgtttcagtagagacggggtttcaccatgttggagactggtcttgaactcctgatctcacgttatccacccaccttggcctcccaaagtgttgggattacaggcgtgagccaccgtgcctggtccacattctgtttcatataacttgttattgtctttattgtaaataattgcctcattttcatattggctatattttctctgtatcattagttcttttccaaaaattttagcagtatcatataatgcttcagagaatgatataattcatgaaatctgtaatctagcatgttatttcctctttgaaatagtgtgcccctcaaataccttgacattttcctttaaggttgtggtttgagatagagggaagactggactcaagttcttgtttgctttcaagaactcaccaagtgaagggagaatgcccctaaaatagagaagccaaagacactctcacccaaaacaaaccccaaatcacagtccccacccctaccctataaaaagcactcccaagtcaagcctcgtttaggaaaacagaatttgaggaaaacatctttgaagctgtaatttaccagcccttgatctttgaggaagatgagaagtgaataatgcccatgtgtttttcttactttccaagtgaggtctggggcttttgggctttaacttttctggatttaacttccagagcacctgcactggaggtcatagttagagcagaaactattcaacccaaaaccaccagagagaacaagagcagacattcaagatccttgtcagctgcctcctgccccaggtgactcacagaaacaagcttagaacagcctactccccttcagccctagaggtgtctcagtttatgtattcattattccctttcatttgtttcttctctacttcttccggatgggtagaccttggaagaggatgccagtcttcctagtactttctcattttggtaggacaaatggtcagtttcatgaagtaatatgtttactcttgctttcttatttcataaagagatgattccttgagacttagctcatgtgttcaaaaatagactggttgtgcccaaaccctactgcatagtagatgggacttaatatttccatcaggctgtgcaccttcttttccaccttgttctttggcatctatgtttctggctgttttattcctcattttggtggagaaatgaggcctcaacctcctgggctgaggcaggagcctccaccagcttcctaagaaagggtgcacccaggagacaaaattctgagacttgtatgtcaaagaattcctttagtttacctttcctctcgataaatctagacatttagggaaaaataatttttcttcaggatgctaaaggtatttattttacagttttctgtcatcttatttttaagatgacctattctgagttctgatttttttatatcatgtgtgtgcatgagtgtgtgtgtgtgtgtgtgtattctttatttgaattttctaaaagcttttggtatcttctcttgatatgttttagtttctttttattttttttttaatttttaacatttattttatattttttcttctcgggaatgcttttggccgggcatgaggtctcacgttggtaatcctcgcactttgagacgctgaggcaggaggatcccttgagcccaggagtttgagaccagcctgggcaacatggcaaaaccctgtttctacaaaaagaaatgcaaaaaattagctaggcatggtggtgcatgcctgtagttccagctacaagggagtatgaggtgggaggatcacctgagcccgggaggttgaggctgcagcgagccatgactgtgccactgtactccagcctgggtgacagagtgagattctatctttaaaaaaataatatttgtgggtatatagtaggtgtatatatttatggggtacatgagatattttgatgcaggggtacatgagatattttgatgcaggcatgcaatgtggataagcacatcatggggaatgggggatccatcccctcaggcatttatcctttgagttacaaacaacccaatcacactctgtaagttatttaaaaatgtacatttaggctattattgagtatagtcaccctattgtgctatcaaatagtaggtcttattcattcttcctattatttttttgtacctgttaaccatctctaactcctcaccagccccccactacccttttcagcatctggtaaccttccttctactctctatgtccatgggttcaattgttttgatttttagatctcacaaataagcaagaatgtgtgatgtttgtctttctgtgcctggcttgattgtagatcttgctgtggctcctttcaatctgttgtcagaagaagatgcagagacaagcatctagagaggaaagaaaagtcacatagcatacaggggatcctgacttcagaagaactggctttccaaacaaattaatagcacaagtgttgaaaggccaaaacaaaacaaaaaaactataaaatttctaagtttactcatcctatctgtggtgaaataacagtgtctttgtcacgtgattattatattcgcaaaaggcttgacttattttcagacatcaatatagcaaaaatcaggcacaacattatttttattatggagcaaattgtaggaaatagtcacacacacacacacacacacacacacacacaattttattccctatataaacctaaagaggactgtcctaaagaggacatctgtgttttagttttgcttcaaaactgaaaactgatgttcttaagttctggaaaattttattaatttttcttcttcttatctctaccattgtcttaattctttttgtaattcctagaattactttttcctactatcttttctatccttttttctgtctttgtctttttgttattctttctggaaattttcctcaaattttgtccaattcatatcaacttttatttttaattttaaattgtatagcttttattttaaaataagagctttttcttgtttgttttctttccctcctttttctatagcagctgttctatttttatacatgtaacatttttatcatccctgcattgtcttttctctgagccatatttctttttttcttttttcttttcttttttctttttttttttttttgagacagagtcttactctgtcactcaggctggagtgcagtggcaagatctcagctcactgcaagctctgccttccgggttctagcagttcttcctgcctcagtttgccgagtagctgggattacaggtccccactaccacgcccagctaaatttgtatttttagtagagacaggattccaccatgttggccaggctgatctcaaactcctgacctcaggtgatcctcccaccttggcctcccaaagtgctacgattacagatgtgagccatagagcccagccccgtatttctttagttttggtctctgcctttcatattgtattctggtctcaccctaaacttgcctaataatttttagtaattaaaaagtaatattttacttttagtaaatattccaaaagtaattgtgcaatattactttgttaatatttttaaatttacttctagtaattaaaaaagtaaatattttgctcttcgtaaatatgtaaatacaaaagtaaatattactttgtaaatatttgtaaatttacttttagtaattaaaaaagtaaatattttacttttagtaaatacacaaatagtacaaggcattagaaactaggtgccacattaactgggtgatcaaacttagtatcaccactaatggaacatatggacatgatggactgtaggatgagacccattgacgactgcaaagtgtcacaacataaaccgaatctaatcaggaggaaaaaatcagacaagttcagattgtggccaattctacaaagcaacctgcttaaactcttcaagtatgtcactcatgaaattaaaatatatgtatatatatacacactatatatatatattctttcatgtaataaaatacatatattttcatgaaataaaaatatatatttttttcatgaaataaaaatatatatattttttcatgaaataaatatatatataagtctagattgtggcaaattctacaaagcgactcacttaaactcttcaagtgtgctattcatgaaataaactaatatatattattatattattatacatattataatacgtattttagctgggtgtggtggctcgcgcctgtaatcccagcactttgggaggccgaggtgggcggatcaaggggtcaagagattgagaccatcctggccaacatggtgaaaccccatctctactaaaaatacaaaaattagccggacacggtggcacgtgcctgtagtcccagctactcaggaggctgaggcaggagaattgcttgaacctggcaggcagagattacagtgagccgagatcgcgccactgcactccagcctggcaacatagtgagactctgtctaaaaaatatatatattattatatatcgtaaatatatattatattatatatttagtatatatatttattatatattttatatatataaaataggctggggatgttttatagttaaaaggacatgacaagtaaatgtgatgcctgcttcttgattgatcctgggacgaagtggctgagaagcatgatctggggtgagtaaccaataaacaaagcagcctactgtgattctgttggaagaaagccttgctttttgtgctggagcatcgtcagcacttagatgatgtgagcttttctacaacccaaccatctgctttttatctttcaaaacatctctcctcatatcttacatactatagcctcccctgtgtgttttttgtgggtttatattattcttattatagttttatgagattgccagagggagaaataatttatgttcagtatgtcttattaaatggaagtcaaatatatttttaaggatgtaacttcttttctacagccccaactttgatcttatacattaagcataaatctaagctaattctaatttctagtcaaaggttcaaatgactatcaattcacttcaacaaaatacatacctgtggtatttggttttctgttcccgcattagtttgctacagatcatggcttccagctccatctatttccctgcaaagaacacggtttttgttgttgttgttgttgttgttgttggctaaatgattagaacccatggacacatacaggagaacaacacacactgggactttttggaggatagagggtagaaggaagagaggatcagaaaaaataatgaacgtgtactaggcttaatacctgggtaatgaaacaagctgtacaacaaaaccccatgaaacaagtttacataacaaacctgcacttgtacccccgaacttaaaataaaagttaaagaaaaaagaaattcataccaatttaattgcttttaataaattttggtgagtagtattaagaaatcatatgtatttacatgataatggttaaatgcttgtgtgcaggtatgttagaataacctagaatttagtactttggttaaggtccaccttggagattggtgtatgccttaagcttcaatttcccaacttttaaatgtcattaataataattataaatatttcatggtatttttgagaaataatacatgccaatgacttatgacattaataaattttatgatttctgtaatattatcttcataatgatcaatgatgtaatatcattgagaagtatcagaaagtagagatgtttcacaaacaaataaaaaatcaaacaaaacccaaaattggaatgtgcattataatgatgtaaaggataaagaaggatgaatcaaaattaattacaaataatcctctaaacgtttgaccaaatcagaattcatatttctccttcagataaaatttctctttttcggttgaaagcacagagaaagaaagtggaaatttcagatgttggagaaaatattcggaatttatgtgacactggataatactaaatgctcattctggtaactgcaaccttctttcaatattcctctttcctagtaaaaccctaagcatcacacaagaatatattttttcttctgcttttctccctgattttggaacagtttcttaacattcccacaaaaacatggtttgaggtaacgacactatcgactgaagaaggaatgagtttgggaagcgttgagatgtgggaaagactaattgtgccttcatataaagactcttagaaaatgacctcaggctagtatttccaatcatcttcaaatcttccgttgaaagaaagtgactgctgagtaatcatttgcactcagagttttgcaaaatatttgagatttagttaaagaaaaggggaaagaagaatccagtgctactgacaactgtggtacccagaccaatgacagcaaatgagtctgtgggatcatcttcacagcctccgaatgacagagcatcaatgaaatgaagaaaatagtgctttttgcgcttctattatcttctaactgataacgtgcatacattgttagtatttttccacagaatggtttatgtcaaatacttaggctaacagcatctgtactgagaagactctactcaggtgcttagaaatttttctactgaagtgtttttccagtgacaaagttctttcatattcttcccacctggaaacataatggcatattcacagttttcaccctgaaagtgtattaggtatgacataatagatgcctcattccagctaagagttgctaaataaataaatccacctggcagtgacatttatactagtttcgggaaatttttctttggcagtagagaccttgataatgcaacttaatgtggccatgatggtgtcttgcattgtgaggttaataggaccaatcagtggggatgaattatggttcacctttacaccattttatccctgctttgctgatatagacctgaaacagcctatctaattcctttgggaattctctaatggagcctccctaactcaagttactataggatgggtagatcctccactggagctgaaagcctcctgttgggtcctcatttgtttagtttgttatctctcgatacttgcttaattctctggaatgtcttcatagatgtggctggcaggcaatgccatttaatcattttttttttcctggttagccttatagaaaatgtttctttttttctggatggtgaatacataaaaatttattaaatataatcatttaaagatagggtaatttaaaagaggcataagcttaagcatatctgcatgtagcctccatattttgttcaaagatgtgtgtacattcagtgtaacataaatttaatatttgttgactaagaagcaaaaatatattgttaacaggtattctatgacacagttggccagtcagcaactagttttcttcagatcttttcaaaggctgcttgttgtcgctttatccaaaggagttgatagatgtgtatgaagcattctggctgacccatggcaatttgtgtttggaagaatgagatttagagccagggttagtacaccatgtggattgccatgggcattatttaggtgtagataagcttatctgaaattgcatctggattacctgactaatccaaaaaaggaaagaaaagtagagacctgctatggaaatagtcatgaaacaaaggagcgctaggggagaggtgggtaactaaatgctagtttttaaataatgttatatcagacttaaaagatacatggaagataagacaggcctaagagtttgctagcagctggatcagattgcaaggaagaatctcagtctatcctttattactcaagccagagcacaagactagtttccacattttataaatatagagtcttttttggagactgtgaaatttggatagaatgttttatttctcattactgtttacagattcgttatgaccttggcctgtatacactttcatgacaggttaagtgaacagaggttaaaggaggcaaactgagagtatttaaataaagtttacttgctatatttgtcttatctccccatgaataataaaaatatcatttattatatgtattacaaaatgttctaagtgctttatacacctaatattagtatggttatttcacacaaattttatgatgtctgatttctttttctttttatagatttggaggtacaagtacagttttgtttcatgcatatattgcataatggtgaagtgtgggcttttagtataaccattcccagaacagcgtacattgtacccactgggtaatttctcatctctcaccccctcccacctgtttgcatctccagtgtctatttttccactctcgatgatcatgtgtacacattattttgctaccactcataagtgagagcatgtggtatttgactttatatttttgagctagttcacctcaataatgatctccagttccatctgtgttgccacaaaagacattatttctttctttcttatggccgagtaatatttcatgatctatatacatatataccacattttctttatcgcatcatccactgatggacacataggtggattccatatctttgccattgtgaatagtgctgcggtaaacatatgagtgcaggtatcttttatagaaacttttatcacctctatttaacagctaaggaatctgaggctcagagctagtaagtggtgggtgtgggattcaaacccagggagtccaatgccagagtcttaactacttcaccagaagcagagggaaggggagccattttattattcttgatttcaaataagcggtagtttacagttagtactgcgtacacattacatgctcaacacataatagtgctaaatagttttttttgttgcatccctattcaggatgggggtaggtgagccctcctctcccagtattcctcatccttagaaataggcactaaatagttccagatcacagtttaaaactattgctatgggaaatgaattgaacaaatcatgtgcttaccttcagcactaatattctaaatcaccttagattaatgccagtaaataccaagacagttaaaaagtgcattcgatgtaaataactacaatgacaagttcacaaatagcaacacaactaggaattccacgtaggagcagaatataaagtaaaatgaaatgatgatctagatagacagatgatagatagatagatagatagatagatagatagatagatagatagaggagagagagagagagagagagagagagagattagatggacaggtatgtagtttcacctataagcaaaggcaaaaatgagtatctcagaaaggcagatttagggaccactaagattttaagttgcatcattctgtaaattggagattatcacttactgtactgtcacaaatttcagataagttaacattcccgaatgttcttggcacagcataaatgctcaatatcttcaattatcatactttttccccttcatccctgccctgacacatgatagatcatttcttaaaatatactacagcatgtattaaataatatttctactgctcagttttctggggaaaatagtgtttagttaatttctaggttttgttaagaatttacaaaatatatttcataaatgtgttcttttcctttcagaaataaatgtataattttactcacaacatttcaacaactttcctaacttgcatacttcatttttctagtgtttcataaaagttctaaatttaatcatatgatattttaaaataagatattaagcaagaaaacacagcatctattgtatttttaaacgaatcttatggtttttattttattatttcaattactgttactaaattattaattctaggttagaattataaagcattatcaaagatacagtagattgcaattagagtttacttgatttggcaattattaaaaaatgaacatttttttctgtgtcaacaatgaagtcagttaaaatgttttgtggaactaatatgctgatagcaatgctgcagaattaaaagtcgcattattattacacaaacattttgctaaagtttggaaattattcctttattggggttctgttagttttggagaatatttatatacatatatatatgtgtatatatatgtatataaatatcctgcaaaatgtagacctttcctcttagatcagtactagcatgctaaatattttattttttaaatatatattaggtaactgaaacaaagaaaaaaggtttttatttgcttagagagataacaataatacttaacttgtaaaatattcctttgatacattcataaataagaagataaattttctaattcttatctgagaagcatagcaatttactttttagaagcttatacattatggcatcctttgattaatgcagtacattttttctcacaatttataatggacttccaataatcttgcctttaaactgtatttgacctcccttattttactttccaactagaatgaagagatgggctactagttgtagttcactgtagaggctttatgctatctgaaaattttagacccagtggctttaataacattgtaaactgattctgggtccattttctcttgattgacatgtctacttccacatataatggtaaatgccttgacttttctgctccttgtgagtagattggtttgcagatttacataaatacatttcccggagaccacatttaccacatttgctcatgacagcaatgatccttggtcatttcacatgctgtagttacatgccattcaggaggctattgttgattgcctgtcatttctcctgcctagatgtcattcaaagggttatttgttattttaatttataggaatttgtacattaagttcaattaacctaacagggccacacaatgagtcaggttcaaatgaaagctgcagatattacttgtgaaagttaccatggaagatgatgaggaaggagtttttatgactgacctgtggagttagacttatttgtttttccaatgatctctactccttatgtttccaatagtttaagtgattttgaaatgaagtttttcataatatctggaaatacccacccctccaaatttatacccataccagtttacaatactttagacatgacagtatataagtaggaataatccattgttatacaagccccaaaagagaaagaacaaaatttgagggcagattggaatagttaagatattttatgtagaactatgtcaatattaattttgtataccaaaatttgacaggcttttatttatttatttatttttgacatggtcttgctctgttgtacaggctggagtgcagtggtgtgatcttgcttcactgcagcctcaaattcttgggctcaagcgattctcccacctcagcctccccggtagctgggacttcaggcacacgccaccacacctgactaatttttgcattttttgtggagagcgtttcaccatgttgcccaggatggtcttgaactcctgggctcaagtgatccgcctgccttagccttccaaagtgcagagtgcagggactataggtgtgagcacctatacccggccccaaacttttttttttttttttttttttagcatatcagtgtattagttcgttctcccactgctaatttgtaaaggaaagaagtttaattgactcacacttccacagggctaggaaggaatcagggaacttataatcatggtggaaagggaaacaagcatgtccttcttcacgtggtggcaagaagaagaatgagagcagagcgaagggggaagccccttataaaaccatcagatctcatgagaacttactatcatgcgaatagcgtggaggaaatccctgattacctcccactgggtccctcccacaacatgtggagattatgggtactacaattcaatatgagattcgggtggggacatagccaaacaacatcaaccggaatcttgtattgcaagtttttattgaattttaaatcatgaagctaaacacttctttgataaacatctagaaggtgagaagtagctcaactctggagtaaggctaaactgggtctgaatatgttttatattctctggactttgaaatatgtctcttgataataaactagttaggtctctctgtgaaaagtcaaccctgcttactctaaaaatatatatatatttatttggcctgtaaaagtttaaggcccaccagggcagggagaggctggaaatcaatatttttcttatgaatttaaaattttagaaaacctatttcttttttaaaatacttaatatttaataaaaaatatatggatttttattttcaatcctgtcataataacctatgtaggtagaattgccttgaactttctctttcctctgttaaatataaatgtttttactcatttgtttgctgagttattttttataacagaatacattttctttttcctttctttaagaacgttttgacaaataaacatatatatttgtggtatacaacattgtgttttaatatgtttacattgtagaatggataaataaagctaattgtcatatgcattacctcacataatttttggggggtaatgagaacactttcttagcaattttcaaatacacattttattaactataattaccatgatatacaatcaatctcttgaacttattcccattgtctaactgaaattttgtatctgttgagtaacatctcccccaaaccttgtcccttccctccagtctctggtatgcagcattctactttctaattctgttagtttgacacttttatgactccatttatacatgagatcatgctgtatttgtctttctgtgccggacttatttcacctaacatgatgatctccagcttcatcgatgtatttgcagatgacataatttacttctttttaagtctgaagattattccactgtgtatatataccacattttctccatctgtttatttgttgatggacacttaggttaattctaaaagttgcctgttttaaatatgctgatgaacatgggggtgcagatatagcttcaacatactgatgtcagtttctttgactatatacccagaagtgtgattgctgtaccatatggtagttctatttttaattttttatgactccatattgtttactgtaaaggctgtagtaatttatattcctattaacagtgtacagggctccccaccgcccttgccacattcttgcaactcttgttttcctcttaattttattatttctacttcagtttccttaactaagaagagaaataaatttgcttgttgcttattttgggatgatcccacaattattatactaattctgttagtataataattataacacttatggtgtctttctgggaaaactgaactaggtggttaactgcagttctgggaaagtctagaagaaaaagtccagttttggtaagagaaccctcttgcctttttaccttccctgggctaggtatggttcctgaggcaaacctccctccctccctccatccctgcctcctaccatagcgaaccaacaatttcctcagtctgaactgttccatcatgctatgagtgactcttaactattcatggaaacttctagaagtaaaatcccgaatttgtgcaatgagttaactggagaaagctattctagtaaaaaaaaaaaatatgaaaaaaaggaggctgggagacagcaaaacttctttgaattaccattttcttccctggtaggtattgttctcgactttgtttctgctatagtaaaatatatccaggtggagtaactagacaggcatgaggacttgatggaaaagaaagcatggatagtcatcacattcaagttgttttagttatctcttataagcaaaataattgagaagtaaggctgtcacataactagacagtgaaagttagtgagagaaggaacaggctgtgatctttggaaaggagatttctatttttgcagaactgctgagaatagtgagtaaaagtctgcataagacatactgagtgaaagtttggggttgttttctttaggcccatgacataactagctttgaatgataagttaacaatgtgaacatcatgtgtgcatagaatcagctttttaactattagttgttgattgtgctctgggaaaccttagtgggacactgaaaaatgagttaatgttaaataaggagttgcagaggctgacagccttggaacctttgggcacaggcatctgaataactttgcaggaatgacctgataattcttggattaataaggaaattctccctttacagaagatgacgtgcagattattaaaaactgagaatcttttttggaacctgtggcaaacccaaactcacccaatctatgtcataattttagtgacttggtattgtttgattgtaatgactaacaagcaaaccagaaagtcttccagaacacatttaagaagttacgaaaagggctatagatgaagaacaaaacagcactatttaaatttcattgcacacctaggactacaaaaaatactactttgtagttttcttgagtctatataactttcctaatgttttctatacattctccctgccgctcagctaacagctagaaatcactttgtagaataaaagggctgaggattgtatttatttccaagacagtagggcctacagaggctaaaaatcagcatctcatttttcagtcgatatggccagagactaggcaagtaacggagctggtggcagagaaaaaaataaaaaataaaaaataagtagattagggagaaatggaaaagaacaaaggcagctagggcaggtcaatgaacttgacagagaggaggcttctatgttccctcattttttccccggcataatattttgtgatttgacatttatttgataccccatcaatctgttccttggaacacttgtactgtagttgattttgtagagtagcacatgcttatttttcacatatataaattgtgtgttcaaagagtatctttatggtttactttctgattaataggctctgaggatattttgcttatcctggtgaataatttacatctgcctcgtgtgttttgcattttcctttggcttcattttcattccatgaaattttgcaagatgcgttctctcctttaagtggatgtgaatttctactcagtgaaaagcaatctagacaaaacagtgtaatttattagctatttttcttacaaatctcctacaacaaaactttattttatcactgccaagtaacatctccagtctgttttatgcaaaagaaatttcatatcctgattggtcacagtgtaaagttggtatttaagaaatatatttctcatatttatagctataatgtaaaaagcataaaatgtaaaatttgaaaatgtgttttattttcaactaagggcatgaaataaatataacttttataagtattatatgtagagatgaattttcctcagaagttgaaggtcttccataagtatgttcatatataatgatcttttatacaatttacattgcgcaactgtaccacttatattcttaatagatgagtgtgcgttcatttcatgctgttaatatctgcaataaaccttcaaattaccaactattttattgatactgtgttttgtagagcaccatcaacgtgtgaattcttaacctgtgcttcagctgttttctatgtatttgagctaaagtactatctacactttgcatgtcaatttttaagtctatatttttctcaatacaaaagagatcagagacaatctctcctgcttggttcagggaccagaaacacagtaggttctatccagagtcatcaatagccattgttctttttattgttctaaaataaaatgtaaaaccataaggatagcttaatcatgctacagacgaacttatgttacaaaagaaattatttacagtaacactctaattatatctacctgccaaaaaggaagtaagcaaataattataacacaaagtgataagtctttaagtacagtatactgtgagatattggaattgtttttgcagaatttgaaaaagttccttagatataactaggtttctatttattagcctatataaacacaaaaataagagaaataaatgtaagtggtaaaataattagacttggtgactacatcaaaaagttttacttaaaactttggcagatttaataataaatttcagtgaagtttttatagatatgaatcttccggttgaatttttgactttgaataacttaatcaaatgcggctctggattgcataattatagtttacacttgcataattgcatttttatacttttgccttatttgaagtattaaagtaattatttattatttgttacactatacattgaaattaatgacctagtcacacactcacttatatatatttgtatgtcttatggaagttattcatacaaaatgttgagattttaatgaattctaattgatactcaaacttgtcatattcactctatatgcatttcataatttttggtaagggtgtggctatagaggttagccaattcacatcaatttttaattatatactttttcaaaaactataatcttctcagtgttactaattatgaaattcataaaataatatccatgaaatgacttgggtgataatccagtaattatcaatagtcacttgctatcatattcggatgacataattataacttagactaacaaagtttgggtcatttgatgaatgggtggcttccttttattttattacaattatgagacttgttaataatgtatagaatttgtataatattaggtttaaatttcttttctgctgcgattttgttcgtttgtaataaaactatgaaacacactatttgagataatgtgaattcgccatttttatttttgatcagtttctaattaatacatttacttttggggggaaaagttgatcaataatgagctgaaatattgcctttagccctaataaagtatattttggaaaacaaatgttaccttaaaatgacaataacaacaacagcaacacaaaccttcacataataagagcccaaatgagatagtttaaatctagcttaagctctacttaataaacaacaataatgtataacactattggacaaaacaaaatattaaaaacctctccaaacataggtctagaacagagactagcactgtcttcactgggatagtcatgaatttccagtttcggtgtactgagattcagtcagaacttggacttaaaaaacaaagacactttgggaggccgaggcgggcggatcacgaggtcaggagatcgagaccatcccggctaaaacggcgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaacaaagaacttggcctcttggttttagtgacttggaaataagaagatgaaaagatgaatattcactgaagaactctttctttctcactcttttctgcatcagtgttttacaagtagttgtggagtgagttatgctgaagcagatggggacgcagagaagccagtagcagatgggcacatccaggttaccctgcatggttgggccgcaaaccatggcctggggtggaatggagaaatctgtacacatccttttcacttgtgcgttttagcaggtgcagcatccgcagcaacatccttaatgctttctccccagttcaagcttagtttctcccttagactactgtaataacttcctaactgatttctccatctcatttttttcctcctccaatccaatttcaaattatcagtcagggtgatcattttgaagtgcaaatcaacttgccacaataagttatccattggtctgagaataaaaaccattctggagtaactacaaaggcctgcaggatctggaacctgaacgcctgtggagcctcatctttactgctcagccatcccttccttgcccctcccttctcctttgcatcactccagcccacttgccatgcttcttccctcctcgtccttctgctggagttggccttgggcttcaaagcctcccaaacttctctacttagctaatttttattcatccttcacatgtcaactcaaacttcatttcctttgagcagtcttcccctccgttccacattagttccggtcttctactgtagcgttcaggatgccctgtacattatcatatttgtaatgacatatttatcaatgattaggtgatatgtctttctaagtacagagttactggcctctgagcacagggcttggcacatgatcaaattttagccagcagagacttccctcaagatatttggaattggaagtaaaaaggaaatatatttcccatctggtgcacgaagctgacaaggataaatgcaaagttggagataagagaagtggagatgctctaatgagccttgttgttgtccctgaagctacctgcagccctgtcctgatggtaatttgggttgtaagtcaataagcatcctactttcatttttaagtttgttgacttgggtctctctcactggcaaggataacaaccctgactgaaagaatccttacattatgaaactgtaagttccataagggctagaatcttgcctgctttgctcagcaacgttgatacctaacaaaagtttgttaaatgaatgcatgttatgcaataataaattcattttaagttttctggtagatatagcctgtcatcacactttcatttgatgtgatctgaaaataaatttttctgagatatataagggccattgaatttaaagataactaatattacacgtaggtattatttctctctgaatttctagaattatacgtacagagagaacatgattaagaaaacaaatacgtaacaggtaagacaaattaaactggctagtgaattttttgatactcggaaaaatcagatttttagtttgtgtttgaagcaaatattcagaattatcaggacaggtttctacaaggattttaatctgattccttcaccaaaatcattttaacatttagctataagatatacaaatcatatttacacctactgtgttaaaaaaaagtttaacctttttaggacagaatggggccagtacaatcagacttatgtaagaaatcctcaaataaccttcttttgtcacgatgacaactgggagcaaataatatttaaagcatgagtgagtagttggaggagtatttgacagtttctgtgaggaaccattgactgaaaacagtgatcaacccactagatattttaaagtaaatttaaatgagcaaatcacaattcctgtcactgagaatgacagcactaattgtcaaagtgaggaccagaggttcagagctaagtggatgtttagttatatgctaatagaaaaatgcttcctaattaagatatgcttgaaagttctctctctgtctttcatctctatagcctatatttaaatctcctgactcttcataaatatgcagtggtgaccttaggacagggcactgtttagcaaatatcttttaaaatcagaatccacaaattctattttttaacaaaatgttgtattgcatcgtcctccttaggttttaaaaacatacatgcacatttaatgataaaccaatgattttaaaaggcatgtgaactgcttctcttcagacatggttgaggatttttgaacatgatgcaatatatttctttctaggacagttacagaactggacttttctttcttcctggtgtggtttattaaaacaataaatcaaagcacgtagaataaggagctgagatcttgagaggctgacatgcagaaaagctgagatattggcaaggcttaatcgttgaagcacccagtcaaagactcagtcagaagaggaggtggaggagaacagccaggaggacaaaggggtttcaggcttgggctgaacctggcatcacacagaggggactacacctcctcctctggggactaccttgagtcaacctcgcagaaccttttgtatcagagtaaggtatctgaaaaaccagagcagctgctctaatggttcagggctatcatccttagatctgaagggtcatggctacacatgcatagaatatggaaagcagccaggtgaaggcatcttccacaggctctcatcattctagtgtgtgtttttcaatgcatcatttatgtcagaagtgtttgaaaaaagctgttacaaagttagtccttattttcatagatcactttctaagtaaacatggtctaaattataggatgagagttttgatcaatagcatgcctgtattgggtgctaaaatagtgccttgggtacttgacggcagaggacatcagtaatgtgaagaaggctatagaaagaagcaacagtagacacagaataaaactgtgcttttctaattttgtctaaggttttcgttacaaagagtcaggacaacatgaataactttattatttccaggaataccaaaataattggtatttatacttaatttctagttgttttgtgtcttgtggaaaaagcatgatcagttaaatatggtgaagtaattaaaaatatggagataagtatagtgagaatcatcattacataatttggtaggtggtgtcatgctgttactactgtggttccatattgagcaaacattcaagtctcatgaaatgtacgattttaccaactcaaaatataaatatcttaagactggacacattaaattcactgttatagtgtattactgtttataatgtgagttacaatcttgtgcaatcattttggtgtgccacggctacgcaagctttgattgaggagagaactgtagagaaaaccaacatagacaacctcttccaggaaacttctgggatagtcatcaacgcagaaacttcatttgcctcctaatcatctactgccatttccccagaagctcagaaatgtgtgacttcacatggtcaatgaacattgaatatacagttgactcttgaacaacctggctatgaactgcacggttcactgtaatgtggatcttcttctacgtctgccaccactgagacagcaagaccaagccctcctctttccactcctgcccagtctacttaatgtgaagatgacaaggatgaagacctttatgatgatccactttcacttaatgaatataaaatatttttttcttattttcttaataatattttctttgttttagcttatgttattgtaataatgcagtacctcatacttataaaataaaaaaatgttaacagactattatcaacaaggcttctgaccaacagtaggctattagtagttaagttttgggagagtcaaaagttacattcagattttcaactgtatggggagtcagaaccacaatccccattttgttcaaaggtcaaccgtatctggaaaaaagtcacacaaatcttctaaaatagatgaataaaaagttgaaccatattaattgcttcaagcaaaattaaccattaaaaataagcaattcattgcactttatagagactattaacagaatactttaataaaaataggactttttttccttgagttaaggatgatttagtaaaataaactggttgcaaaaaatgtacacaacaagcagcacttatacattctttagcacagaagggactgcctcagagacctctttaaattcttaaggcaaatttaaaatcttggcaatttcctcgaaggtgaacaactaatagtcctttgtagggacatggatgaagctggaaaccatcattctcagcaaactgtcgccaaggacaaaaaaccaaacactgcatgttctcactcataggtggcaattgaacaatgagaacacttggatacaggaaggggaacatcacacaccagggcctgtcatggggtggggggaggggggagggatagcattaggagatatacctaatgtaaatgacgagttaatgggtgcagcacaccaacatggcacatgaatacatatgtaacaaacctgcacgttgtgcacatgtaccctagaacttcaagtataataaaaaataaatattaggtaaaaactacttaataagcatggaagcatctatgtagatatttgaaataatacacagatattaaaaaaaaaagaatcaagaaaagagagggtccttgcactcatgtgggcctggaatcaaatccacaccgaattcacatgccttcattggtcactttagcttcagaacccagccttctcatctggagaatagacacaatgatgactatatatataataatctcatctaatccttgcaacgatcctacaacttagaatatggtaggtgtttaatttatttttgtattttactctatattttcttacccatgataaataaattatgttgtgcatcacaactctacttggggaatgtaaataaattccatgaagtcattcaagacgtcattttaattttgagtcagtgtttcttctccagaaaaatcaatacagtattaaatatctaaaggtataagtcattttgcgaggctaataagatgacaccttttataatttatgatttaaaaaccattgcttaaaacaaatcacttgaaatcacctaaaaactagccaatcgcttaaaaagaaaacaaattttaaatagagttttagtagcaattaagtaattttttagttttaaagatacattagaaatgtttattagttggaaatgtttatccatatagcacaggatgaataagtgattacataattcaagaagtaaagcagaaaacattcaaccaattagaatttttgaacatcttgtcctttaaatatcagatatgtcaatatgataaataaatgatatctaaaacatctatcacaaaaactgggtcatgatgagaatatttatatgttaaatttgttagcttttctaattttctcaccttcccaagggtaaaatcatgcttatattcaagattaatcactgcatcctcctccccaaaggctttctacccttccactaagattttttattcctaatacaaagccaaaaacctttacaaaaaccactcttcgaaaaccacctgggtcagggtgatagagaagaaatagtaatgcaccagaaattacagttccaaattctttacatccttgacatttaccacttcaaggtctcagtagtatgaaagcagggcagtggggtggatgcaatgactttcaaggtccttctgacttggtctttctgtgtgtcgcctgtgctctgtaatgattacttagaacaccccttaagtgagaaagttggggctggacagaacctaacaatcaaggacctggtatatttgcagtaaagtatctattccaactcctctcactgttctctcttgtctctactctggactttcccgtatttattttgatgctaatattcggagtgatgttgatgtctcatcacgaatgccattccctagagcaagcttgggcaaatgactgcctgtgagctaaattctttcaaccttttatttttgtaaataaagttttattggaacccagccatacccaattgtgtacccttgtctctggctgctttcatgctacatgggaaaaactgagtagttatgacagaacctctatggccacaaagtttaaaatatttactatcttgctatttacagaaaatatttgctgacttctgccctacagaaacataagcaaacagcagtaatcactaatatcaattaaatggatattattggaactcttaaggggcactttatctatagatatcatttttttgacttttattttaaattcagggggagacgtgcaggcttgttatataggtaaacttgtgtcatgggagtttgttgtacagactatttcatcacctaggtattaagcctggtaacagttatttttcctgatcctgtctttccttctaccctctaccctctgatagacttgagtgtgtgttggacccttctatgtgcccatgtattctcataagatactaatttttatctttgtgaaattttgtttccttgaccaacatctccccaatccctccactccccagctccaaaaaaccaccattctagcctctgcttctctgagttcaactttttccgattccatagataagtgagatagtgtggtgtttgtctttctgtgcctggcttacttcacacaacataatgtccttcaggtttatccacgtgtttgcaaatgacaggatttccttcttttaaggctgaagactattccatggtataaataccaaattctctttctccattcatctgctgaaagacacttagggtgattctatatctaggctattgtgaaaaatgcaatgaacctggaaataagttcaagacatttattatacatcacagtgactatagttaataacaatatactatatacttgaaaactgtgaatagagtagatttttttttttttttttgagatggagtcttgctccgttgcccaggctgcagtgcagaggcacgatcttggctcactacaacttctgcctcccgggttcaagcgattctcctgcttcagcctcctgagtagctgggattacaggcatgcagccaccactcctgactaatttttgtgtttttagtagagacggggtttcaccatgttggtcaggttggtctcgaactcctgaccttgtgatctgccagcctcggcctcccaaagagctgggattacaggtgagagcccctgtgcccggctaatagagtagattttaaatgttctcaccacaagaaaatatggtaagaaggtgaggtaatgttaattaacatttgttaattaacttgatgtagccattccacagtctacacatatatcaaaacatcatattgtacgccataaatatgtataattttatcaggcatttaaaaattattaatttttattaaaacggttataatagttccaaccgtgttgtgtgtagattcacaaccattagaagttacaaattgccacatataaagggtggtataatataaagtcagttttaaagagattggcatggcattttgtactgtatttgaaacatgatcaacattgttatttttattttattttattttatttatttacttatttatttatttatttattttatttgagatagagtctctctctgttgcccaggatggagtgcaatggcatgatctcagctcactacaacatccgcctccctggttcaagtgattctcctgcctcaacctcccgagtagctgggattagaggcatgcattaccacaccctgctactctattttgagtagggatgaggtttcaccatgttgatcaggctggtcttgatctcttgacctccagtgatccactcaccttggcctcccaaagtgctgggattacaggagtgagccaccgcgcccggccaacattgttattttgaaatgtttgtatgagaatagaacaaagcagccaccttccccctggagccctgcaggtcggctcctgttaaccaggagccagggacgtggccaaacaagtaacaaagtcactacacgcttcacagccgcaatgctcttatctgtaaatcagacaaaatgcttgtgtataaatgtctgcaaagatgtttccaataaaagaaagatttggtttgtggatgtgctttgttattcttcttattaatttggggctagagacaagagaagagtctcagggaaagaaattccttgtttgaattaatttagtcaaatcaggtcagagaatccagaacaagacttagctgatgtttcttcagggcacatatgtgactgcctttccactgtgaataatatctactcaggccatgtattcattctaccacttgtgagatttatgtagcattcttgcctccatagtgctaaagatgcctggtagggaagtttaaagttactgcagcaatttcttttcggtgcatattaaagttgtggtgccttatctatgaggcggagctgtaagtcgctgtgatatcttgcttcgaattaattcactagttacattcaacggacatagaagtagagtttggcagtttagaaagctggcaaattttctgtggctcctcaaacattactgtaaaatttgaaagctttaatatgaagggtttcagtttagtcacagagtaaacctaaaatcctgggatgactgcttcccttttatctgtgcctcatgaaaatggatacatttttttatacctcatcagatagacttttaaattccaatcgtatgaaaatgaagacccccctcagttagagtagaccacaaaatgtggctgattgtcggtgaatcaggctattacagttacacaaactgcgttgcagagcaaaaaacaaaacaattgttactgtaagtaatgaaaaagcagcaaaatgcagccacataatggtaaagacatgagacttctctagtattttaaatgaaaaagcacttgactagctgagcttggtgcttaacacatgagaaagatgcaggaaagaaaatgatcaaaaggcatggtccagcctcatgagagaagagggtctgcatgtcgtgagggccactttctcaatcctgtttggatcttatttcacggcttcaggttggaccttccacttgcaacttgctgtggaggtgctcttctgcaagtcccaagatcccaaaaaggaaatacaggagtttcggtgtttttgagcaaaacaaagtaaaaagctgagtaaggaaacactatacatagctggaaataggttattttctatttgcagacaaagaacaatataaacaaagctcgagatcatctgggcaggttgaaaatagcttcagtctcaaaacagttacacatctgatctgatttcatcacattttaatttttcttcctctgcctcatcttcctcgttctccttttcttccttttacttgttcttcttcttccttatctctctcttcctgtttctctctttctcctgctcctccttctcatacttttctgcatttgtactgcatgtgagatttcaactactcaaatgaattacactcataattttcccgagtggggcagagagaagggggactttcaaaataagcctttaaaaggaaagcactttttacctatatttttcttttcttttttttcttttttaaaagttgagcttataagatcatgcctggtgaagctgtgttcatccactcctctcagcattagtggaagaattagagtattaacgaccttatagaccaggtattttgtagcctcctttacagtttgtcaagttgttaaaaattgatacaagaaaacttaattatttcttcagagaaaagctggacatgtgaactatgttaaccataaaacttgcctgtcttatgtttctataaacagccaggtttgaagcacaagggcaaacctatgcatctatgtgtatatacacacgtttctattttatatgcatatatttacatgcatgtatagtttttgtaaatttattcgtgattcttagtggttatcaactaaatatgaagcagtgttctagctgcttaaagagttggaagaaaagggtggtgtcaactctgcgattttgctgatcaaatcgagattacagatacatgttttgcttagcccacataggattgttttaaattacattttgctgtgtttctgcttttagaagttgagaagtgccccatgagtatccagagcttgtagcttctcttgagaaatctgaaggtcttgcaagactagacctgctgccttccccagcagcagccgtcatctggaaggtgatagttgctaataccctgagtcaggggagactatttctccatagtcctggcagctgcctactgtgttatccctgagcttcactcatttgttttctggcctgatcctattgttatttcgagttcctactcctatagatctataaggggtgactgaaggggtttggaaaaagactaggttgggggtcagttgtggggtattgtggcaaaaatgctgggtttggaagtaggtggtctctctgatgagcttgcttatgcctggtatgcacccatgatgttttccacaacaaaaactagaaaacacttgccaagtatctgggagtggaataacaggcttgagagaaaggtccccttttggcatagaggcgtgcatttaaaagcctttattctgctgctaaatactatttgaaagagaataaaataagtacagtctcttttggggggaatagggtggaaaaaaaggagtgttatttgcaaatatttcaaagtattctataatgactaatacttgtaaaaagtaacttaggaagccttggcagcgaagggcagaatgccatcggttaatattccaagttttgtgtgcctagtgaagcaagttagcttgtaacagtgcttcaactggaaaaatcacaattgacagcttcaattcataaggagcaaagcaccacagtccatgaagaaagtaactgccatggtgagcactctgcatcagggagaaacacacacacacataccacaccacacacacatacacacacacatacacacaatgatcaccttcctggaggaagaagagtagtgaattttaaaatgaatactttttatttgtgtttttctgttattgccaactttaaaatgtactcgttttgattaagctaggttgtgttacaatattaggaattaatttcaaacacattgtgtttttacttcaaaataatttacttcaaaaaaatctttatgtgtatttacaaaaatagtacagctagtaaaatgacactgtattggcttttattgccaaaagaaaaattaagtgtaatgcttaatgaactctttgaaaattttaactgttagcataatgcaactcattctgatttccattagatgtatctattatatttgacccacatagtttaagaaacctgtaattaagacactccacttttgaatcataggaaaatctctacatcttatcttccttataagtttaaaaaaatttaaaaaaaatttgcaaccaatcaaagtcatgctattccttattttaatgccagttttcctggtattttcgataaatttaaaaaattacaagtgatatttatatatgtaaaatgagggaaaattctacaactataaaatcaaattgttttcatttcttaggaagtcaatataaatggtctttcagttgataacaatgtctgttcattcacatcaataaataatttcataattccaaggctctctttatccaattgtattttaaagagtacacattttgtgatagtttataaattaaaggatatatattcaaagtcacataaaaaatatttgagttaattacaaagtaatcatggaagaatattccttacatttctatttattattgcatgaaaatggataatttcataactttttatatataagattccaactggcctttatttcattacatataaaatgaaaaaagatgagttgatctgacagcacagcccaagttttcaaaatttgttaatgttattgtattgtcaacactaaatgttaaatatatatacacacatatatatacatatatacctatatatatacctatatatataatataaaatgctaagaatataaatgttaaggacgtacatccacattttgacctgctccatttccgacctgggtcagtttgcctctcgtttgcaaccacattacacacagctcctgagaggtcaccacattgatgccaaatagtgcagacatgtgatcagcatggcacattataaccaggagctcccaggcccaagcaatccttctctcagcctcctgagtagctgcaactagaggggcttgccaccacacctggcacatgcacattttatttctaatttaattttttaaaaatatgcagcttattatctaaagaaagacctttctaacccttccatttaaagccataaaatcatacagaggcaaaaggacttcttggagctctgtggttttcctctggtggctaattgtggttaactctgcttatcagagttcttttatctggaaatgactatctttctagtgcatttcaagtatcatctactttaagttctgatcacatttcatttaccacttatatttggtgtgaatgcaaagatgaatcaattacccaatttcgccatctttttaaaatgcatagcatctatgcactaaaaatacaatacaataatgtgcaactcaaaaaattccccaagcaagaagactgatgatttcttaaatattatgtgaccttctatcgcctgattttagaaattctaagtgaggacaacttggattgtatcctaaaatattatgctgtggactcactctccatgtatacaataggtttgacatttgatagaaattaggggacagcagaagagaaagaattcttaactatgtctgtacatagttaactaccctaaggcactttaattcttgtccatcctttattctagtaaaactgtcactgaaccaaaagatatatctgtataaagagctctgtactgtcaaaagtaaagctacttggcaaagcttatgagactttatgtcagttttctacttgaattatagttatttcactaactagttatctttttcacatctattgtgactagagaatgagatgtagcagcaatctttgttgcatgccatttgtaaactaaatttatgtcatagatttgcatgctaagtacctctctggtaagaagagctctcaaaggcagcatgtttatgccactatttgtgattaaattggaattctaaagcagacccaagttaaacatgaagacaactttagatcttggtctgaagtcaaatatagactgtttacttaccattggagttatcttcttcttcttctttttttgtggctattagcaagataatctgtgatagtttttaatcatctctcttttactaacttcatagttttaaaattttctgtgtttttggtgttggcataaaaggtatgtgttcaaaattcatgattggctaaaataataagatctggagtttgaaagtagtttcaacaggtgatttagtatataaaattatatatacttacatatactatgtagttattaattaggtaccaggctattgtcatcacataaatcataaacatcttcaccagaaagttttcacttattcattcatttaacatatatatgttgagtgtgtatgaggcaccaaatgccacactaggctgtcaggtgccatggtttaccagatacactgttcttgaagtgcttaccttccagttgggggatataaaaaaggcacaaacaagagaatgagttagagaaacagaccatgtgaaatcacacaaacacatggacagctggattgaccatttggtcccatttttcactgtcatttaacttcttagtcttcctcatctgtgaaagagaagaagaagatgtgacttacctgttttaaatggtgatgaaactcatcacagttttcagctaggggccaaagccctgagttctgtgtgcgtgaatggtctcagcctggagttctctctagttgctctgacttgcataactctgtttcactcggccacaaattaagtgtcagggcacatcccagcacctacttgacctcccttaaataaccccagtgaggatctctaagataatttttaaattatgaaattaaatgattaatatttttaaatagaaaaggtagaaaaatgaataaaagatgaaatctctctgtacttcttttgcaaagtttccccagagggaattactatcaactgttggctttacctttttctatatattttctaaatagtttttaaaagagaaaatacaaagttctgcaactttttggctggttaattttcttaaattggtacataatgcgtatttattttctcattattaactactcaaatactctaaaatatatacagggaaatccttctttggtacattctttctctcacctgtaaccccaggaaaccaatgttatataaaatactatcatatcctctgcaaaatattgttatgatttgaattgtgtcctcctgaaagaagttgaagtacaaagtctttacaaatgatcaatttgagatgaggtcattagggttaatcctaatgacacagaggctgacatgcacagaaggaagacgaagtgaagacagggacaagatggccatctacaagccaagcaaggcctataactaccagacattagaagagaggcatagaaatattctccttcactgtagtcaaaggaaccagccttgttgacgccttaattttgcacttctagccttttgtatttgtccattttcacactgctgataaagtcatacctgagattggggtatgcctttatttttctataaagaaaatgatttttttataaagaaaaagaggttcggtggactcagggttccacatggctaggaaggcctcacaatcatggtagaaggtgaaagtcacatcttacatgccagcaaacaagagctaatgaaagctaaacaaaaggagaaacctcttataaatccatcagatcttctaagacttattaactaccatgagaacagtatgggggaaactgccctcatcattcaattatctcccaccaggtccctcccacaacacttgggaattatgggagctacaatttcaagatgagatttgggtggggacacagccaaaccatatcacctttggaatgtaggacaataaatttttcttgtgtaagccacccagtttgtggtacttctttatggaagcctgagggaactaacaaagatttcatacctatgtggattggccattttaattccaattattatcagagaacaataaaagtgaccagaaatatcttctttttatattctttaattaaaaaaattcaatagtaaatgggcaagagttgaatagacatttttcaaaagaagacctacaaatggcaaagatatgaaaaggtgcttaacaacattcttcatcagaaaaatgcaaatcaaaattaaaaacaggtatcatctcacccctgttaatacggcttctatccaaaagacacaaatattgcagtgtttacattcctgccaccaggttgcccacagttattttgaacactgaacttctttgaaagatgactgaagtctacatattttatgcccctaactactatggtatctctggaaatctgaatgtaaacattgtcatggtattgtcaaaacattagatggatttaagaaaataatatagagaactttttataccctgtatacagataaggcctgcaaaagtctttccatataaaaaaaggaaatactttattgacagaactgttttccctttgggccaccctctaggaagagaagaaacggagctctgttgaataactttttcagagattcctgtagcccagaggcatctgagaaatatttgtagacatggagaaaaggaaaatgaagcagttgtcagtactttactccatgtgctgattttaacttacacaggtaactttgaattggttaaaaaacccaggcaatttgactagagctcatctattggaatctcaccttcaagcttgagagtcttgaataaacttattctttgacttaaaatgacctgatttctttttgcaagggtttctgttaatgaacaaagtctctgtctcccccgtcactgcctgatctaaaatatcttattccttgagtcttgcccatatttaccagatcattggagacaggtgcaatagtgaattcgcatttttaacatttttcaatctaagttttaagattctattattgagatgaaaatatttctaataagttttctggcaatattaatgtgtgggcaataaactaggtatggcagtacacctgcaagaagacagttagatatggtctttgttgtccactgtctcaccccaaactaaagtcttctctacaacagtccttgtaggtgggtgtctatttttccattaaatgtttgtattgatagagagatgctaaagctgtctgattcattttactgaggcttgaaaagtatgtaatgtattcatgatattacaataattccattgagttatataagacacatcattaatgtaggaattgtaacattttcattgtttcattattgatcaagtgatgttagtagcaatttgtaggcactcagatctatctttggggattaatgaatgaagaaagaaacaaaagttatgcaagctttcacattggactgttcagaatgccctgatagtcacattttagctgtttatgataacatatccactttactatgcaaagattttcggcatttatatgagggatttattaggaaaaatgaactttgaagtgaaaggacaatcacaggtatagagtgaaaaaaggtatgatgtcaagaagagtacaactgagctaaaaatttgtgagtttatagaaatactgtaagatttgtcatctgttacatctcctcttaaaatgatgaaaccatataatggaatttattttgaaattgaccatatttctctcttaacaagtatgtataccatggtattgacatagaattagattgaactattactatagcatcaagttggctatcaattgttttatttaaatgcatacagaaataatgaagcataatgctagttgtgaaaaacataaacaaatgtccctggctcttgcttaactaacttctaatctattactagttataatgattagttagaataatattaatgtgtatatacacagaaggttttatggaaaatgtgattgatttcaaattaaaattgagttttacaacaggtagaaaatgcaggtgcaaatgtaattcagaaaataatcttttaaatgtttaaatagtcattgaactattagacatctacatattttttcatttaaagttaatgatctaaatatttataattatcaattaataagcagttttcagaatattgccaatatctagatgtattaaaagtcaaatccacatttattacaatatagatgaaagtgaatatgctagaaccatagaagatatcatagacatatataagataacatatactgagtcttctttctactccagggacttaggctctttcacagaagtaactaaatcattaattacctttgtatcttacaaatttcccaattatatactcatatacatgaatttatatataaacaaatatagacagattttttttacacattggacttttctatatattatagatgcttgtttcactgaagagtacaactttaagatctttttatattagcacacagaagtctactgcattctattcaacaaaagtgataccagtgcatcatttccatatgggtaatttttttttagtattttcacatcaactgtattatttattattttttaaaattaattcttatctcaatagcttttgggatacaaatgtttttttttacatgcatgaattatatggttgtgaattctgagattttagtgcacctgtcacctgagtagtgtacattgtacctatggaggttactttatatgatgtttattacagaaaacattgcaataaatattcttatacatgtatcttcttattcttatgtaagaatacatatataagaatatatacataagaatatatatacatatatgtatgtgtatatatatgtatatatatatatgttagccatttaagtcataattctgtgtgtggtctttattttctaccttcaaataagttacttatgctattttgtcatttccatagctgaaaaaaattccatgtgttatctggaagaccactttttttttcccacttgacatttttcatctctatttgaaaaactctctatcaaatgctcaaagcatgacaatttgtaagagtaaattgccttatagcacacaacacaaaatatccactaataccaatgctgttttatttttatatttttaaattaactaatttattgattttggtagagacaaggtctttctacattgcccaggctggttttgaactcctggggctcaagcaatctgcctgccttggaatcctaaagtgctggaattgctgacctgaaccatcacaaggctcacaaatgcttaatttttaaagtagtgatagtctgcccattcaaaagagaagctagtttacttatactttagcaaaaaattaattaaaatatgccttattggagatatatgtagtgcatcataagataaaagggatgaaatataaatcaaagtcaagattaagacattttctgtcttcagctctctgtattttctgtgaagaaaatactgttacagcactactaaaattattttctggcctcttgcaaaatgtacctaatgctagttatttaattattgtagttagccaccttttcatatggattctctattctcattttattttacattcctttctttccagtctttttacctcttgtgcaacttttcttattatggttccaattttcatttctttatttgttctctcttgggaaggaagaatagtcatatgtaaaataacatattgaactttctgtcttttaagtatttagtgtgtattataattacagtagcgatcaattctatgagtagatttttttgtttccttagctgttttgttcatatttatttttctgaaaatgaatattacagttcttcccctcaagaattttatgattgatggatataacattatcattaattggagaaaaaagtgcagataaaagccatggaagaaaatgtcagaagttttagaagtgtgtatgcaaggaaaaaagggttagagagatgaatgattgattcctactcttccatcttgagtacctcatggataaagacaggatatttgtgctccaatttttagcagccacctgcttttctgctccccaaaggggaaaactagtgacagtaacatatgagaggaatgtccagaagccttgtccaaatgctctgcgtcatgcagattggcctctttgtgtctccaagtgagtcttctaggcatggtattcctttacacttagcatttattttgctcagcagcacttaaattcataaaaacagttatagcaaacatttctagaatatatcagaaggtagatcttttcttttttaattttcaggaaaaattatacaatataagaagataggctttagtcagataaatcttaaattcagataataaggctatgaaatgtatcacgttactcaatttctgtgatgtctctgagctttttgtcataggcgtgctggagagatgaagtgaccctcctcagttaattcttttgagtattaaatgagataatatgtctgaatcactcaaaatatttagtaactgttagtttttttcataatatcctcaaggagaacttgggggaaatttcataatgctcccaatttatggtggtaaaatgaagacattcaatgtgaaaattaatctaaaatgatggaacagctgtactcagtgggattcatctgcctcgaattctcaataaagttgaattgaactatgcttttgagatcttcaaactccccctggcccattttctgtaattcactaaaactcacaggattcggcacatagccaaactaacggctatgattgattacagcaaaaggatacaaagcaagatcagcaaagggaaaagccacatccagagaaaactcagtgcaaccttccaagaagcttcttctactggagtcagacgggacacacttaattcctccagcaatgagttgtgacaacgtgtacgaaatgtctactaggaaatcttgcccaagattagaagtttaggatttttatcatggttcagcaaacgccttctgtcaaatatatgccacatttctagtctttcagtaggaaagccaggtattcagtataaattatttagtttttacaaacagtttaagcacaatggactcctattatcatttagagaaagttttatatccgtgtagggaactatttacccttcaagttactgaatgccagtcaagcgctaactttgcaagccgtccattctaagaataacagtctcaagcttactatgttaatttgtttttgcatagatttcatctaaaaacagcagaaaagagattaagggaagggctcagagagagtagagccaacatgaacagcaaatctgttatttaagtactagttctaccctatgtagtcattaaaacactgtcaataaacaagtgttgcaaacctctctgacatattgaaaaaaaaatttacaaatgaagccttataattatcagtggtccacaatctaatacgttttcaatttacttacattttattattaatcactaggtataaaaacaaatccagcaggggaaatgtgatagatccaccatgacatccgtaaacacaacactagatttaaaaacaaactaacaaacaagaaacagaacaaataataattaaaaagctcttttctccaaaatgatgtttttaatttacctttgtattcatttgggttttgattattagaatatcctcacccttttctaaccctttcctgatacttgattttttggatagtttactattatgtcatttgtgttttttgatgagtataaaacccattttgttaggagaagaaaagtccccattacctgaactgttgccataaagctcctaggaaagtagaaaatgcccaaagttattttcctttttcttctcttaaaaacccctttccaataaaaacaaagaattggcaagcagccattttgagagcaatcagtattggtaaagctgataaaaagagaaacatctttgaggctgtggtcccttctctaccatccatgtattttagtacatcaataattattttttgcagagtgagaaattcaggaaactgggcactttgctttcctaagctaaggagatagggcgcagaatgtattttcttatatctgaagacccttgtggatgatgaaggaattgaaatgccacagtaacaaaaactacaagtataattattgattaacattcttgagggataagatgtgccagactgtgttctaagcgctttacctatgtaacctcatgtcattctctaagtgaaccctatgtggtaggtttttattattatgattattgtcttccaccttttgaggagaagaaactacaaacaaacaataaaaaactaaataaattttaattaaaattaaaagttaaaaaaacaaaaaaaggctgggcctggtggctcatgcctataatcccagcactttgggaggccgaggtgtgtggatcacctgaggtcaggaatttgagaccagcctgcccaacatggtaaaaccccatctctactaaaaatacaaaaattagctggccgtggcggcgcaagcctgtaatatgagctacgcgggaggctgaggaaggagaatcttttgaactcgggaggcggaggctgcagcgagccaagatcgcgccactgcactccagcctgggctacagagtgagacttcgcctcaaaaaaaaaaaaaaaaaaaaaaaaattaaaacttaaggaactgagacaaggtgtcattatacaagtacccactgcaggagcagagcagacattcaagcactagcaccatggtaccagagctcatgtgttgctgttttaggctcacgtttgcctcagtgtctttctggggtgtttctgtgtgcacgtatgaaaacaaaatgtatatatatatatatatatatatacacacacacacatatacacacacatttatacacacatatacataaatgtgtgtgtatatatataaacacacacacatatacacatatatatctacttgtacacgtgtgtatattataaaacattttaaaaaatttaaaaatatttaagagcattaatcagttaaatcagttttaagccaaaagtattacagtgactcatttcaataacacctttaaaaaaaaaaaaaaagcaaaacacagtgaaacttacaaaaagaaagagtaaaatgctagttgccagaggctggggaggtggagatattggagacgtgttgttcaaacgacacaaaatatcagttagacaagaggaataagttcaagagatcttttatacatcacggggactacagttaatatattgtgtacttgaaaattgataaaagagtagattgtaagtgttcttactgcacacacacacacaaaacaaacaataataagtatgtgaggtactatatatgttaaaaagtttgagttagccgttccacaatgtatacaaatatcaaaacgtcatgctgtacaccataaatatatacaattttacttgtcaatgaaaaaaactgcttattttccactattcatctaaagtaaaaagaaaacaaaaactattatagttaagtgcttccacatattaaatatctgaaaagataacgttatttttcagaaaaaaagcaaacctcccctccgtgatcattaaaaagattatttatatatgcatctttaaatagatcgcttttaagtttcacctccaaggtcatatttacttaatgacttggaaataagtgataagatagtctttactggaaatgatttaattctctgccatctagctaagggacaaatatttttgggaaagagccagatagcagatattttaagtttcaggggtcaatctctgtcgcaactcaataccgccattgtagacatacataatatgtaaatgaataactgtggctgtgtttcaataaagctttattatgaatgctaaaatttgaatttcacttaattctttcatgtgacaaaactttattcttcttttgatttttctttttaccattaagaaacataaaaagcattctgagcttaaggacactagaaatctagccattgaacaggattttgcccaagagccatactgtgttgatcctggatctggataacaagaaactgctaggattatctgtgattgctttgccttgctaaagtctttcttttgcctatagttacatacgttattttgtctatagctatatatgctcattattttatcatctaatgtatcttttttaaaaaactgttttcaacttttaagttcagggggacatgtacaggttattcagttttgttacataggtaaacatatgctatggtggtttcctgcacagatcattccatcaccaagtattaagcccagcatccatcagctattcttcctgatgctctccatccccctgtacctccaacaggcactagtgtgtgttgttccctgccatgtgtccatatgttgtcatcattcagctcccacgtatgcgtgagaacatgtggtatttggttttctgttgctgcatgagtttgctaaggataatggcccccagctccatccgtgtccctgcaaaggacatagtctcgttccttgttataactttatagtattccatggcatatatacaccacattttctttatctattctatctttgatgggcatttaggttgatttcatgtctttgttactattgtgaatagtgctgcaatgaacatacacatgtatgtgtctttataatagaatgatttatattcctttgcatatataccccatattgggactgctgggtcaaatggtatttctgcctctaggtatttgaagaaacaccacgttgtcttccacaacggttgaactaatttacattcccatcaacagtgtaaaagcattcctttttttatccaaaaccttgccagaatctgttgttttttgactttttaatagtaaccattctgactgctgtgagatggtgtctcattgtggttttgatttacgtttttttaatgatcagtgatgctaagctttttttcatatgtttgttggcatatgtatgtcttctctggagaagtatctgtttatgttcattgcccactttttaatggggttgtttgtttttttttcttttaattttttttaagttccttgtagcctctgtatattagacctttgtcagatggatagattgcaaaaatcttctcccattttgtagtttgtctgttcactctgatgatagtttcttttgctgtgcagaagctctttagcttaattagattccacttgtcaatttttgctttcattgcaattgtttttggcgttttcatcatgaaatccttgcctgttgactatgtcctgaatggtattgcctagattttcttctatgactgttatagtttggggtcttatattttagtatttaatctctcttgggttaatttttctatctggtataaggaaggggtcaattttcaattttctgcatatggctagcagggaatctttcctccattgcttgtttttgtcaggtttgttgaatatcagatggttgtaggtgtgcagtcacatttctgagttctctattatgttccattggtctatgtgtctgtgtctgttctcataccagtaccatgctgttttggttatggtagccttgtagtatagtttgaagccaggtattgtgatgcctccatcattgttctttttgcttgtgattgtcttggctatttgggctctttcttggcaccatatgaattttaaaatatttttttttctaattctgtgaagaatttccaatggtagtttaatgggaatagcattgaatctataaattactttgggcagtatggacattttcatattgattcttcctattcatgagcatgaagtgtttttccacttgtttgtgttctaatttttttgagcagtggtttatagttctccttgaagaggtcctttacttcccttgttagttgtattcctaggtattttactatttttgtggcagttgtgaacgggagttcattcataattctgctctctagtttcctgttgttggtgcatagcaatgctagaaacgttttcacattgattttgtatcctgagactttgctgaagttgtttatcagcttatggagcttttgggctgagatgatggggttttctagatacagtgtcatgtcatctgcaaacaaaaataatttgatttcttctcttcctatgtgaatatgctttatttctttaccttgcctgactgttctggacagaacttccaatgctatgttgaataggagtggtgagagagggcatccttgttctggcttacaagggaaatgcttccagcttttgcccattctatatgatataggatgtgggtttgttatagatggctcttattattgtgaagtatgttccttcaacatctagtttattgagagtttttaacatgaatgaagattgaattttatcaaaggccttttgtgcatctattgagataatcacatagtttttatatttagttatgtttatgtgatgaatgacatttattaattgcatatattgaaccaaccttgcatcctagggatgaagccaacttgattgtgttggataagatttgatgtgctgctagattcagtttgccagtattttattgagaatattcgcatcgatgttcatcaaggatatttgcctgaagtttttttttttttgttttatttttttaatctctgccaggatgtaacccatgtcttagtgcattaagaaacaccagtgcatggaggaagtctactaataatgcacatgtccaaataatcacagaaagtatatctatttatttatttaaaaatctgtaactttgttcaaaatatttttctggaactggagtatcttacagcagtaaaaatatttcctaaggtaaaaccaattttagagtatataccacttgtaatataatctacctttcacttgatagtctttatcgaatctttcacagaagtagacaggatatgaatgaatgaatagataagcaaatgcagacattctcttcattttatggaggcagtaactgctattaagtggtgttatataatgtactcaggatctcagaacaattaatcagcatggcctggctgcacctcaattcttctaactacaagatacttttacacctaaagcagctagcatttaattgactgttttaatagaaatacagggtgattaccaatctacttgatcctttttcaattctaattatttttctaccaaataattgcacgttttgagagtttctaaatactcaactgtgtgtataaatcaatgattaatttttccttgattttaataatgaaaatagagcttcatatgatcaagaacctgaaataatacagttcaattaacataattccattaaaaacaaaggaatggaacagttaatctattcgtcgtcactgtgagacatagcagatgttctgttaggctgtttgaaatattagaagtatttcataaggctcctatatctgtttttctagactacatattgagaactgctgtaattacagtatcatcctcagtgttagatgtaaaatgttaagaaaaatctgtccatctggcaagaggaggtaaaagtttgttagagtgggcagaagttaggtctgatagcacctaggtctagagaaacacaaactccaggtaatacatatattctagtaaggtttgctccatttaaaaaatacaaacttatagaaacagaaaggcatttattatgctcatttagtagcaataaatgccttctaatatctttgaaaatttatcatgcattctcttcttaaatgtcttcaatgtgtacagagcccatagttaataacaattctaattattaaagaatatttccattgatttcatttaagtctctggtcctgcaacctccatttgttgatttttggcttggccctttggaataactgctcagaacaatcttatcttgtacataaaattgctttagttattcttcataagatatgatttctatgtttatgactgcaatatttatagccaacctgtgaagagcgtactatttgccaggcatatttctatatgctttatgtgaatcaataatttaatttttataatagatcaatgagttaagttgtattaccatttccattttcataatgagaagactgcgttatcataaggatcaatagacaaaagtcacaccaaagtcacacagctggttagtaagtaagaaaaagttttgatggttggaacaaagtctcacagctagttaaacagggagccagaattcaaactcagacagcctggctctagactaacacgtttattttgtgctttattaaatacccagttattggattatccttctggctccaggttcttttttaaaaatagctttcgtatgatctgagaaatattcttacatcaaatacatttgtttgctctctctttgagatttcacacacagaaaaaacataaatgctcaatcattaaaggtggtgaagatagctctttctcatcttgtggtcctactgaaaagtcattaagaacaagaaatcctgtccaatgccctgttataaaaagtaatgacagtaaagaaattattctgagcaaaaccaactaatttcaacagtcacagcaaaaagtcaaactcagatgattcaatttactcattgatgtagaaacaggagaaaaaaacatatttgaatcagatgatcaatgatcaaggaatgatgtgtttcctgttaaataattcttaattaaagaggaatgtttttatagtttttcaatagaacatcttgctatgtattattatcttgagtcatgctcactgtttttacatactataaagtttaagacatgttttactttcttgtcttaggaaattcagtaaaataaataaattgaattatatattttttgatcattcagaggtctagcattttttattttcttctaaatataaattctcattatgaaactctgtaaatgtagaaactatggaacaaacaatatatagaatgctctttggagatcaaaagaaaattaatctttttcaagtgattttgaaaatgtccattctagtggaaggaatgctagccaggtagaaaatgagggttctaaaaaaactctgccactaattcacgtctttcctcatttgctaaaataaaggaatagggttaagtggccacaaattccatttagttctttagttgcattattagaaaagtgatgtttgttccttatttttaaagtgtgaagagcaaaaccaaaactgcaggtatttgaaattagctgtactctctttaatatagtttattgtgttgatgcattggtctcataagaatcaaagcctgcattctccgtgccggttgactttggagcactaatgagttgtaagtgcatttattaaaccagtatcactccacggcctaggcctttctctacagagaaaagagctaatgaaaggaactaatgaaagagactcgagctaatgaaaacaaaaatcaactcaacccccaaacaatggtgtctggagtagctgaattatccttcctcctaaactaagaagtgtctcgcatttccaaaccgtcagtactctattgtaattgcttttgtttggactacaaagtgtttgggggctccagaacgtagggtgattagtgatcccaatatccatgttctctctgctaaattgaatttagcatatttgttacaggtgatccctggggcctttgtacacacagaaagaaatcaaattaataattcaaaacgtaaaagctatctgttggtctctcttaacttaatttgtttggggtcaggtccacaccttctaattcagaacgcgatttcagtgactcttgagctgtgatgctcagtgaatggagagtagaaaagctcgaggagacaaatctccttaaacacaataaaaccgacagtgggagaatttccaaaatggggttgtgattgaaaatacacattgacaaaggcttctctttacttctgcttttcataatataaactcaaatatgtgtgtacatatatatatttaaagtttcagactgctgtaaaaattagtctgtctatggatccagagagttcatctatatcatagtggaggaatgtggaagatgagtgagaaagcaagcatgaagtcatgagttcagaaaagattgcaaaatgcttctctatacagatggtccctcatcacgctgtgttgtggagtgtcgtacagacaactgtgaaaacatggagagcagagtcttgtgtcttaagccatgcattgcctggtgcaaatgagaactccgtcatgatatgttgatttgaataaatgtatgtacacaaatgtaatcattttagaagaagcccagtcttacaggcataagcagcaaacctaaccacagcttccacctttcaaaagtccttcttacggtgctgaaggaatttattttgcattggtttgctggaaagaaaataatggtcttgactattacagttctttactttcttccagaaaagcgaccatggcctgggtatggttttcagactgcatttttacagagtatttaagggcaaaggggcatttatttttgccaaacagactgaatttcacaaatgatacatgaggattagtgaatggtgttcactgtagcattaaactgctttttttatggccagataccattccaatctaaatctgcagaagctattcatgagagaattacactgtgaggttacatttgggttggttctactcaataaagtgacataaaaagaagagccaatgtagtcaacagaatttctaagaggcaatcttattagttttcttatttataagcgtggctaaagcattaatggtgctttcacagattttacgccattgtgaatgcatgttgtcaggggactctctggatccacaggctaattttcacagcagtctgaaactttcaagcatggattaaaattatgcttaccctttacttactattagttcataaccctcaacatttatgtgaataatctaagtttctttataaaacatagaacagagtttgcaggcatgatacgcttcagaagaggtgggagcacaattttaggcaggtggtgaagaaattttgaaacaaattctgaatcaaaatttgtttagattacaaaaatagaagatgatattgttaataataacggcacaattatgtagtttctgcttaactgtttcagcaatggattaaaacaatattagagaaggttaaaacaatagaaattataatagcatatttctttgtagtaaattagaaatttaatatatattgttttatacttaattcctggggaaaaaaaagaaacttgtggcagttcagagtggattgcaataggatttattgaatcccctatgtgtgccaggcactcattcagggccgctctgcagggctttgtgatacacaaatcaaaagtgtgcaattcacagaaacttcaatgcaaacttttctctctctctctttgttgtgcaactcaggagccatggaagtttcttatttgatatagaaaatcaaaaggtatagaagatgaagtttctgcttttgagaaatttctactatgaggggaataggtgttacttttcaggatagtctcatggtcagagggttaattaacttgcttttggccaacatagctagtgggatgagtatataaaatctgaaattcagatggtctaatttaaaatttagtgttattaacattatattgcattaatttcttttaacctaaaactttgcaccaataataaacttttttaacttataattcttgtaaatttaactcctctctccaccactgcaaaaagtgcttggcaatgtgagtaccagctgcttttagaccctgctaaaaaactgtgcccaatattttgagtttccatttcagttctgcgtcttgtgacttctagttaaaagaattgtgtgcctttgtaagcgtagagtttgtacgaacaaatgatatgaaatcagttagacttgacatctaattttacatccgttagttatttatcagctgtaaacatctctagtagaattttaaaatctcagttccttgtacataaagggtcattgaagagaccagtgtttcggagatgtttgggagtataaatcaggcagtatattatataggcacttagtacatctgagagaattgataaaaacgtgtgtatgtcatgtatgctaatcacttcttagtaaacatatatttcaaccccctttatttaatgcttttatttggacatatgttgtaggagtcgttcctctcctcacaacaagatatgatcatgctatcatatattttaaagagttaagttaggaaatggagtcaattctcaacaggagcttatctgcagtagattgctttggtcaaatccaagatatacatacagctagtaaataacatacttggtaaatgatatgccaagatttggctgaatccaaagcctaaacttgtatatttaccagtatatactttctttttgcaaacaatccagttattgatcacatttccctataatgccgatgagttattcagcaaaaatatgacagtttagggaatgtctacattattcttaatttataatatagaaaatactgttaattacctataactagcaccatgtatctctcctagcaatactcttagaataaaccatagggctaagtccgcataatactttggagattttatgttttttgtgatgggtaagtgggtaaaaaaatcttcattccccatacaaatagatgatttttgacttagattaataatcagtgtctacaaaagaggtatgctcttatgttcttgctattagcaggcatgttgatgtggctatatatgttgcagtggtgataataaaaatgtggattcataatttttcacatgtatattagaaaacaacatgtgacaatgtctgtgttgacatattttccaaatttaatataaaacaaaactatttcagttttaaaaataagcacctaagtaatcacaataaggggagataataggaaaatttaaaataattcacatacttataaaatacaataggtaacataaagcaaaatgataaatacagaaaagctaaaaacaataaaacacagtttagaagaaacaaaaacacagagattatttgtatcctggaaacagaaacctctaaaacttgataaatatttttaagaacctaactttaattttgaaggatgcagtatgaaaacaatttatgaaatttcttaaacaggacaatagcaagtgcttggtgtataaactctatggaacattaactataaacatgttattccgttatattaaagaatggagaatataaaactgagaagaggctaagtagactgccctgttgacaagcaatatctaaagctgtattgttaacatttgttgacattgtagaaatattagaaagacaagaatctctataaattataattctaaaccatgggtccccaactgccgggccacagactgatgctggtgtatggcctgttaggaaccgggccgcacggcaggaggtgagcggtggcaagtgagcattactgtctgagctcacctccctttagatagcgttggcgttaggttctcataggagcgtgaaccttactgtgaacgtgcatgagagggatttaggttgcgcgctccttatgagaatcaagctaatgcctgatgatcttgggtggaacactttcatcctgaaaccatctaccccaacctcaccctcctgtccgtggaaaaattgtcttccatgaaatcagtccctggtgccaaaaatgttggggacgactgttctaaacgacaaaactactatttcaaagatataagcatagctcatgtatgtatgtgtgggttatacactattataacacagaataaaataataaatgccatattgaatcaaaactatatttcatattatctagtgaaatgcgtaccatgtttaaggtgactagagataattttggcatctatttaccattctccctcgcattcatacaaaaatattatggttgaattgtaagtgcattgctcaaaaatccttctcatgaaacgtaagcttatttaaaccagtatttctcaatttgtgcttcattgacacttaatcctataaaatggcaaactaaaaaaataattgtacatcaaaataagtttggtaaataatgaactttaaaatttctccttagatgctgggataaatatattaatgcctgctaaacattccatttgtttccttatattttctagcctgtttgggcactcaaatttgtgaggagttatggccaaaaaatgtgatcaaaagtgaagtggattttggactaagacactggaaaactcatgtgcaattccccaatctcgtttttttttttgtttgtttttgtcccctttcttaccggagtaagggaggaagccccatgttgcagatggtacaaccacaaaataacagtacctgtattagccaggggttgttatggaacagaacatcattgctatcccatgatggggacatagggttaacaatatacacatctttattgttaagcccctaggagttcagggtttgctatcgagacgtaatctagcttacattggtcatatgctatacattatacatatgtatatcttactagcaagcccggaatgcctagtatacatatgtgcaattcgtatcatataataaaaaactcttagtcttcatgcagtaaagggaattctcaaactgtttctgtcacatatcctacagttatttatccatagaagctttttttttttttaaagagtctattcatatccccttgatccagggttccatggaacacagcttgtgaaacactgattttagatggtttttcatcttatttatttcattatcctttttagcaacaagggatcaaacactgtgaaggtttactctctactggataagagagtaagtctatctttgcccaaatattaccttcagaagtttgggctacatatttataatgagctgaaaacttgtgttcatatttatatttcttttattagtttgcattttaattatatctaatttttcacattttcagacatggtaggttattttcatgaaaatagcaataatactactaagagtttctttttaaatagttttccaagtctttaatttagttgttctttcctggattttctagaattcttttactcataattgaacaccaaaaactatttttacaatggttgtacaatataatttctaaaagattaagataggttttttattgagctttggttgatatctcaaaacatttagagtggacaccagggaatactggaaaaatagggattcattttgctatctagttctttctctcgggcacacacttgttgaacatggtctgtcatcctgagcatagattttaatgcctctaaaatcatttctattcttcaggctattttcataccttaagaagttttcttttctaatttattcatgttagctttacattgcattttcaaaaacagaaaacagtgtaggatttcattatatcactttttggattatttattactaaaaaaaagtaccgccacaggtggatggagtatcttaacattaatacatctgttctcttttttaaaactggagagcacatttctccccagagaaggggactatgtatcccttccttatatttccagtgtttaagatattcattttttaaaaaacactctcttcaatttcaaagacatacaccaaagttatgttttctctcatatagtatgcttgtcaaagtgtttagcagcttatctattgatgtagatgccactaacttctttgacatgaaaacatttcttattctttatttctcatactgcttttagagccagtagctggccttcttttttcccttaagtatgaatattcatcaaggaacttgttggacatttttttgtttgtcttctcttctttcctcctggtattatatatgtttatttagccttaatcattacttcaaagtagatgatttgaaaattgtatgttctgtccaaatctcatctaaaaactcaccccatatttccagaagcccccaaacaaaatgccatctgcatctacttcttcatatttgaagtttaatttctacaactttccacaaaacagaattttttccttattttcatatatatatgggagcagaatgactcttgtcgtagtcacaaaggttccaacttgattaagcactttagagaggtacttaaaaaaacacctttccttacattgtatgcaaaattagcatatttttctggatttatgaaacaatcccactttcaaataatctctctcggataggcgtggtggctcacacctgtaatctcagcactttgggaggcctacgccagtggatcacctgaggtcaggagttcgagaccagcctggccaacattgtgaaaccctgtctctactaaaaatacaaaaattaatcgagtgtggtggtggaaacctgtagtctcagcaactctggaagctgtggcaggagaatcgcttgaacccgggaggcagaggttgcagtgagctgaggttgtgccactgcactgccctgtgggcaacagagagcgactccatctcaaaacaaaacaaaacaaaacaaaaaatctgtcctatattaacataagtatattaaaatttgacagaccagttgctgtactttttggattggtttttgaaaacatagactttagtagtaagaaacttagtggagtaaaagtaaatgaagatgagtacttttaaaatttaaagtgtggtcagttaaaacttatttaacctaacactcaattaagtgtatgaaaagtgctgagatttatccattaatttttctcataagaaactagatcacgtatttcttttaccaaaattctatttgacattcaacttaaaatccaaagagtgtaatgaaagcccttaagataatgactgtgaaatagcaatatagcctgacgtttaatgaagtggatgggtatgtctcttacctaaagagaagatgtgaaaatttaaagtcacactggttatgctgtctgtgtgtatatcttcatttttaaaaaaatcagactcttgagaatttcattacctagccctccaccaaaacaatgcatctgcgtaaatatttcacaattttccattgttttaaagttggctgatgagaggttacttagtactgtttggtatttttcccaaatcttttataccacaacccggaagtacccatgcctcacttgtggtaacataaatacatagattcatatttctgattaagttataattattattttacataaatatcttgtctagttatctgaaaaacctaatattagaatttaagatagggagatgttagttcagtgaagcagtatcttcattaccaaatacgtaatgtgattgttgattgtacatttggaatgtcacacagttcattcttgttcccactggacataaatcaagatgttacattgacaacttgtcctacaagtctaaaataagagtcagttttgtcagaattgtaggcgtatttcacttactcataagttgaagattttggagagatgaacgaggtgatcagaggatacattcaataatgtttttgacctttatttaaaccctgtcagtatgaaaacttcagaataaaactataaacatatgtaatgagtgtgactgtcaggtcaaaaattcaaccgtgaaaaaaattttctctggaagacaacttaatatctttcttaagccctattcttctgggttggcaaaataaaattttttggggggtttgtgactaagtttcagaggactttcatattgcaagacaattcatatgcaagttgtcctcaagtcatctctctatgcggtatctcctgaaagaactgtctccctatttggtcttcgattacagatacacatcaactctcttccctgcccacctgttcctttcatttaaagtggccctctctgctgctgattacatgcatggccatggagatcattctctggtttccatccatggatgtcagtgtctacaagatgagttcattggcctaaacctggcatgcatttcctcttgctgatgctctggagtctactgaggaaggtcctctttgctcttgaatctcgcattcctctctgggtttttgccagttcccaaaatctctacctgagaagaaggcatggagctcctctcagcatcgcctctcatctcttctgctgtgtctctcttttcttcgctcctgggtctccagctggagacaaggacacagagatgatcagatatttactagtttctgcattattgtctctttcccaagaagtctcatggaagaaacaaacaaacaaaagagggtaaaattggaaaagataaaacatgtaaagatattaattttttgtatcttccttgtaagcttgacatcattctctttcaaaacacaaaggtactgtcatgtatttgcacatccctcatgtcttctgtcattatttactcttctgaaattatttcttctcttggaggagtactttctctgtgtaattttcaaatgttgtttgtgtatatttctgtgtgtggcaaaacttttgaagtcttctattccaaagagtatatatatttcaacctcactttcaagtgatgaaatatctatatataaaactgtaagccacaagttatttttcttttacactttagaagggttcatccttatcttcttgcatcgagggtttcttatgcccatctaatttttgttccttgtttcgggaagtcttttgaatgtttgcactttctttacttaaaatatactatgatacatctaagtgtaggtttttaattctaaatgttatgtgtgttagtggtgagataggtacaaatgcaatagaggaaactaggaaaaattctcaatccatttggggtgtgtgtgtgtgtgcgtgcgcatgtgtgtgtgtatgtgtgagtgtgtgtgaaacaccttcctccaaatcttaatcttacaggtctttttacctcatcaaaaaaactcagtaggtcaaaaactctgtgttgaattggtacctcttgaaagagcctgatgccccactaacatctgtggtccatcttgaatggggacagcttatcacaatagaaggagctattgatcgtgacttatccttgagtcccctcctgctcacttgacatttttgtggtatcgtactagccctgcacagcacacctagccctgttccgtggatttagccttcaggattccaacattagtacttgaggcttgaggactgaggaggtgagtgtaagcactaagcattcttcttgtcttgggtgcagatttcacagtatttccaaagattcgttcatactccatggcttgtgcttttgaagtttcgttttcattaaaaataaaaacatgggccgggcgcggtggctgacgcctgcaatcccagcactttgggaggccgaggcgggcagatcaccaggtcaggaaatcgagacaatcctggctagcacagtgaaaccccgtttctactaaaaaaaaaatacaaaaaaaaattagctgggcgtggtggcgggcgactgtagtcccagctactagggaggctgaggcagggaaatggcgtgaactcgggaggcggaggttgcagtgagtcgagatcacgccactgcactccagccttggtgacagagcgagactccgtctctaaataaataaataaataataaataaataaataaataaataaatagataaataaaagcatggtcaggttttgagaatgctgacatgactaaaaataattatactttacgaccatcttttccctgtaaagttaaatggtaattgcataatcgtatttagaataaaagagagtttcagagtgtgcctctgctctttccacccctttcattcataccactatgctcaggcctccctgtttagaaatttggggactactcctgagatacagagtgagaagaaggaaaaattaggacaaagccgtaataactcttactgctcccagtatttgcattaattttttgtgttaaataatttaatccatctaacaaccagtttataacattagtgaccacagtgtcgtcattttgtaacaaaggctatttggaaaattaccaaaacccaaaactgagtaagtagcagagctatattttatattcaggttttgtctgcctgtcaaccactttttttataaagaagacatctagattaagaggcaaaagacagagctgctatcctagcgctgtcaatagtgtgatcttccataagccatataatttctttgtgccccaattttatcttttgttaattaatagcataaagccctattctagctggtttgagcattaagcagaattacataagtatagcctgtgaatatggctagtattatcacagtgttctgtatacattagctgaatttcagtttgtgaaaaattaatccatatcccattttctcagtagaataaactgtctaattagttggtatttatcatgttatttatttatttattaaatttttttgacagaatcttgctctgttgcccaggttgtagtgcagtggcacaacctcggctccctgcaacctccgcctcctgggttcaagcaattcttctgtctcagcctcctggaactacaggcactcgccaccatgcctgacaaattttcatatttttagtataaacggggtttcaccacgttggccaggctggtctcaaacgcctgacctcaagtgatccacccacctcagcctcccaaagtgctggaactacaggcatgaaccaccgcacccagcctatcacattttttaacacagtaaaaatgaactgacttacatgaatcagaaatttgtatagtgtaaagatttactaataatttaaaggatacaggtaatacatagatacaggtggaacatggcctgaaggacccaggattcttcctaggtggatagatacatcctggactggatacatctgctggaccaaagtaatggatgagccattgcaatgaaggtcgctgttcacctcatgtagccagaagtatcatgaactgttgccactttactgatcattcagggattacatgacattttccaagagcacatgcttcataaatccatagatcctctctctcttttttttttttttgagacagcattttactctgttgcctaggctagggtgcagtggcatgatctcggctcactgcaacttctgccccccaggttcaagcgattctcctccctcagcctcccgtgtagctgggattacaggtgcctgccaccatgcctggctaatttttgtgtttttagtggagacagctttcaccatgttggccaggctggtctcgaactcctggcctcaagtaatccacccgcctcggcctcccaaaatgctgggattacaggcatgagccacccaccgagacacataagccaccacgcccagcccatggattctaagtgtgttcacctaagtggttccacaccagggacattctgctcaaatcatttcataaacaaaaaaacttccttctaataagtattagtacagtttccaggaagggtcagattttataccagagtcaccaaaatttttatccagggagagaaataaaaccaggctatgttcaacccaatcctctccatgtggccaaagtataatgagattgttgtaataaatactgcagtaaatattatgattttattttttatgcctgacgttgttgtaactgtaaatggggcaaaatcaaatcaagtatcatagattgagtagctgttgtgtacatggtagctttgaaaaaagagaaatttacttgtgatcaaaattcctttcaatgtctagaaatgcttgcctcttcttatgacatgataccattcttatctttgaaacagaataccttatataatagaaacctagagcaagcaatttcacatgaggtaacaaaagagttcccagagtttttccagatcagtggaagacttaagtacaggatggagggaaattttaaaattgttcaaaacaagaaagcatttccccattagagaatcaaataactgaagagagggtgtgtgtgtatctctttacagtttcttttctttttgctgtttatgtgcttgcattatcaagacattttcccaatatcctacttttattttagtagcattttcaaaatctgtatcaaataaagatagcaagtagtagagcaagatgaatgagggagggagaaagaatggattggtagtggaaacaacatttcccacaagcctatttattgtagcattgacagtaggaattcttataaatgctaggttaacttgaaattctaccaaatgtctgttactgtttgttttaaatagaattctagtatctcgggtaggaaatttattacaggcaaccctaagaagatatattccctaaactctccttcaggtgatgggattaatcttggtaaagtgactaagttgcttcttgatggttggtacattttgaaaaagaagaatcacattaactccagagcagaaaagaaccgtagatcattcttactaagttcattggtcttacatgtaaattgagaaagattgctgaaggcaagattgccccaaggaatttaacttgaaatcaagaggctacataaatgtaaagtgctactgcttaaataaaaaatattatgttttaataataatcatgataatatgacacagtatgaagcaaatatagtgaaaactagaaaacagtcttggaaacagttgctacattgttattaaggactaaaccaatttagaggatcgtggctgtgaacattttaatatcccactcagctccaaattatctagagaaatcttctacacattctacaatatggaatgcccaaggctgagggtgttgcagaaaataagataaaaaaaagaaattatatttgcaaccagactagcactttcttcagaacactgtgatgtcagtttcacatcagtgaacatttattcttaaaaacaaatccctattattctttgcctcagtggtcactgagctaagaaaaagaccagttggttctaggggaaaaaacaaaacaaaacatgtgagacattgaaacagtaagtgagaagttggtgaaggtagctcccaggtggattctgtcacatgctgatttattttcaactctgaatatttagcattgcacagaacacttgagcaactcttgaagatccttatttagatggctggagagaaatctacttgaaatatacagtatactcacctatgagtcctgccctacctcaacaaaatattccatcgcttttattgttctatattctataaaggcccaaaagactgactatggaagtggactgcttacaacatttatcttagtccagctctgtatacagcatattaattttagactttttaggtattcaaaaagtagcaatttatactaactatggcttcaatacctagcaatatttttattttattgttaattttgctttaaagatatctattataaagagaaaaattcaaaacagtatcttaggaaggcactggtcagcttgcctaagaatacaggtcatattatgctattcaagttacatttcagattaatatacttctgctagatttatgctgcatctaacatttgggggaacaaatggatgtattaatatgattttaaatgctgctctgtgcttaacttttattgctcaatggagagtgtacgccacagcacagttatgccaagaatatggtttcagtaaaagaaaggagctaatttattgtctcaataactagctcttttcttatttgatgttaaagaaagaaatgtgcatgtctgaagttgaggttcagcaatgcattagtatttgccaaattatgagtgacccttctaaaggctataatattttagtttcacctattatgttatatttattttagaaccaatttacaattttcaaattgtttcctacatttttattagttttatgatgtaacatagaatatatactgacaaagacaatattattttctttgacattacataaaccaaaaaatatgcattgttataaaatatgagaatcttgcaactgcaaatcagaattgagaagctttcatgcttcattaacacctgtgctataaattcaggtttaacaatttgatgaaggaatatttcagattgcaataatcacagaagtatttattttaatagtttcaaaggccaagcagaaatctgttacagttaataaacatcctaaaatggttcgtgtatgataaaagaatatcaatggtgtttactcattactctggggattgaaattaaatcatataaaaaaactgtgtttaagttccatatgcatttgttccttaattgtcagtgttttgaatttacgtcatacgcacatttgaaaaaatggggataacaatttgtgaccttttattaataatattggcttccaaaattggatgataataagagagtctctaagagcttatcttttttcaacaggaagcttcctcttattcttaatttaattcacaagattcccatgaagtatgtaacttgaaatagcatttactgagtaaagaaaaatggttaatgctaccaacaccaatacatatttaatgattgagaaatggctgttaactatgacaaaactatcaaatcacaaattaagaggtgcctcagaaatcgattgtcatccttttatccacatttagggaaaccaaaacacagaaaagtaatgacaattttctaagacaaaacagcttgtcattccataaagtggctactacaattgggtctcctgccttccagctcaaaatatttcccctatactctgtaatttcagaagggggataaagaatataggattttttttttaactttttaaagttatttttatttccgtctcttttattaaattctttgtttatagaagattgcacttaccgttgctctgttctcatattttataagcactttgtttttgttttttttttattatactttaagttttagggtacatgtgaatataggatttttacagtaatcgtttgttaaaacattttatttaaaactaattaagatgcatggaaatttgcaaagttagtgcagagattccatgcattttaaactactttcctctaatggttgtatcttaccaaactagcataataaatggatattggtatgatgtttgtgtaatgtcgatcacacataatcactgcaattggaatatagaactattctgttaacacaaaacttttcttcacactacacctttatagttaaaaacgtcacccatcagccctatacataacaacttatatccgtctgctggatgtagaaaccttgactccctgtaagtccttttcagctttgattatcccagctccatcctctttcatctctttttctgttactctgatgacatgaatgctaaatctgttattacagtgccacagctccctaaggctctgttcattcttattttcagtctttcttttctgtgttgccgaggcaaggccattgataccattctttcttctaatttactgattctttcctctgccctatacattctactgttgagtagatcctattgagttttttattttgcttattatattttcagttctaagattttcatttggttcttctttatatcttctatttctttgttgagactttctttcattggtttcaggaatgtttattatttcttgttaaaacatttttatgatggctgctttaaaatccttgtcagataatcccatcttctgtgtcatcatagtgttggtatttttctattatattatgtaatttgtggcccttttttcctcttgtgcatgttggtatttctgggttattggcttctctctataagaaaatatatgaagcaaaaagaaaatccaaggaattcactgccatgtatcctcaggtccctatgtccccaatgaacctatcttttctctgcttttcagaatcttcttaatggatgtttcatctacagtatcaatgacttggggctgcagttcacagaaagaatagagaaattatgtgtactccatcttggagttgaactggtagccctagctagccctttgatatcacaaacacatatgtgataatgggtattattgaaagaaaggaaatatacttaaaacgacatttaagatggcaccttagacagaattttgcatatttcatgaatgcccctaatattaaactggttgatatgccttttagtatgatgacaagctttagttgacagtcgtacaaaacctgtgattttacagatttcaatcagtgatgattgagagacggcactatcctgtcagcacagaaccatgttccttgtattcaggtgaatgaagattatttttattagtgatgtacaatccagttgatttctgtggagcactgacatccaatctgcctagttatcagtccactatttctatacagaacacaattttaatgtcattcccgtgttcctcagtatatccttacattattaaatacggacattatgcaagttatttaccaacactgtttctacgttgtaccttttctaaaaagcttttcttttccaaggagataaaacaacaacaacaacaaaggtaatagtcataatacattttaataattaataacatgaactttgagctatcttaaagccaatattgcattttaaagaaaatatgacatttagctgtattaatactttgtgttttatatcttatagcagtttcagttatctattgctgcatagcataccaccccaaatctgacagattttaaatgacagtaatttatttcttataaatttgtaagtatggaattctgtcagggccaagctggttagttctattccacaagggtgggcaggatttactcattttctgcattaagctggtagctgggatgaaatttccaagaaaacttgattaacttatatgggacctaacttcctcgtgtggcttctctactgcgttagttttgttttccttaagattcgaaacagacttctaagagcatacaaaaatggaaacctacaaatcctcttaaacgaagccacatgttgtctattctgtcatattttactggtgaaaacaaatcaccaagccagcctaggtttaagagaaaagggatagactccacctcttgatgaaaggaaagacccaattttattgtaaaaggcatgtggaataaaagatattgttttatgatcttatcttcaatttttttcctcttggaaaattaacatttttgaacctcagggatttttacaaataatttgtaaattaagtaagcaattttcggtcttttaaaataacacatcacgtagattgaatgggatttcttatttcataatttgtaaatagagatgctgttattttcatagtaaaaatatttatttatttatttatttatttatttgagacggagtcttgccctgtcgtccaggctggagtgcagtggcgtggtcttggctcactgcaagctctgacccccgggttcacgccattctcctgcctcagcctcccgagtagctgggactacaggcaccgaccacatcacccagctaattttttgtatttttagtacagacggggtttcaccgtgttagccatgacggtctggatcccctgacctcgtgatctgcccaccttggcctcccaaagtgctgggattacaggcgtgagccaccgtgcccagccataaaactgtttatttctaaataattgtaattggtcagtgcagttgagcctttataatgtttagagaatctatgcccaataacagagattttaagagtattcagtcgatttcccttttctctggcattaactcaatcaaaccatctcactccttcatgtgttgtatagattttccaggcttatctctgacctttccaccactccacagcctacactcttgacataaacaaggccagctccatggggatgcgacctatgcattccacagggtgctgaactcaaataggctgcacattaggtatagtgctctgctgtcactgtcttgaaattcttaatcattttttaacaacgggccctacgtttttattttgcactgcgttgcacagattataagccagtcttgtttttatgtctagaatgagctttctatacctcacaatattctactggacaagttttcaaacagtcttcaagactcagcttaaatatcattttgattttcaaaattattctaattccctaaccctagctatagaaggaataagaagaaataaggtctcttctatatatatatatacgtatatatatacatatatatatacacgtattctatatatatatatacgtatatatacacatatacatatatttatttatttattatttatttatttattttttgagatggagtctcactctgtcacccaggctggagtgcagtggcgcgatctcgactcactgcaacctctgcctctcaggttcaagtgattctcctgcctcagcttctcaagtggctgggactacaggcacgtgccaccatactcagataatttttatatttttagtagagacggggtttcaccatattagccaggatggtcttgatatcttgacctcatgatccacccacctcggcctcccaaagtgctaggattacaggagtgagccactgcgcccggcctcttctatatattttgtcttcataccacttaccataaacttctattataataattgttttattattatttgtgtattcattttcatcctccattagttgggtttaaaaagcatgatactcattattacccacttagtaatttcccagtacataatctatgacatgtatagtaaatattcaataaatatttgattgaatcaaagaacaagtgaatagattaatgcaatgtagttatgtatccttctttaaaacactgtacattgaggtacggtataaatttgttcgataacagtgtttgccttatatctctagtgaaacttctcagttatatttttgtctaattctctttgatcctcactggaaatataagacatcttttgttatcagatattcaatcgcctttatacagttattacttgaacttaaattctttctttaaacttaacttctcagagataataaaagccatgcatgtggtttaacatttacttttacttaacatttgccattctgtatgttttattaatttatatttggaaactcatctaccactagattctaagtccttgtagaagcttttacttccagccaaggtggagtagcagggaccaaatttgctctcccctctgaagaaaacatcaacttagagaaaagagaatatgaaatagtgattttgcaagactctgaacatgagtccataaagctgtaaatgaataaagtagcatgatctttgacaggttggaaacaaatttgaagagacctacaacagccccagctactgtgtggaaagaatgattccaggatgtcatgcaggtccaggaggttgtctgttgtctctctgggttgaggcagagcagtcttgaaaggccaagctggccatagtccttagagaagactggtggagaggagagcactgcacagaaacgatgttccagagatctaagaagaaaccctccggaatgttcagtggagaactgattcgggagtgtttgaggaaactatctgaggcaggtaaataactactgaaatgattaaaaggaacaattcctgaagctcgcatagagctcaaactatctgctgcttattcccacaatccagagagaaaagtctcataattcatggggcatgggatagagtttgcatcagtagtaaagcaaaattaaccctacactaaatgctgctctgatctcaactaacaactttcaagcaagacccaaaatgtttccaagtaacttaacttgtcataaatgaagcttggaatatttctaggaaacacaaatgtccagatccaatgaggtaaaattcacaaggtctgtcatccaatcaaatgttgccaagtatgaactaagcaggaaaatataacctagaatgaggagaaaaaaatccaaaacaatcaatcaatactgaccaagaaataatactgatgatcaaagtagtaaacaagaacatttttgttttactattgtatcccatatattcaagaagtgagaatgatgagcgagcatgaaaattagaggtacagaagatataaaagagactctgatttaacttctagagattataaaatgcataggctgtgactgttggcagcttagagattgtaaagatgagtgaagttgaagacagcaacagaaaccattcaaaaggaaacacaaagagaaaaaaatgactgacaaaaaattaacagagcatcagtgagctatggggcaacttggggtcctaaaagggtggagaagcaggagaaatgtttgaagaaatgaggagtgaaaaatttccaaattcgatgaaaactatcaattaaaagatagaaaattttcaaaaaaaatagaagttcaaaaaaatggaaaaagctaaagtacatcattatcaaattggttaaaactaaagataaagataaaattttaaagttatgctataaacttcttgagtaggattgaatgtagttcaacatagtgacatacacaaaatggctgcttattctatactagtagattcattttatcaaataaaatcatttcttgttatagatattttttaaaccttagatctgtcggccatttcttagtattccttagtatgaagtatttcttaccccctttacgtatttctaagaaggtaggtgacatataacaaataactttgaaataaaagttttagtttgagtttgtttacgcagaagcaagagattttgcaaaaggaacacttgttttcaataatgtaatggtctagctgatggtcaactgactcaccttttaaaatttttactgtgtagtaagaaagttgggaaggtagtgtgaatccatttacttaatcctgggacacgttaaaaagaggactttatgaaagtcctctttagtgtataaataaataatactttatgaagtattgtataaattagtatatacataatagtatatataaaaataggtatacatgaatactgtatgaagtattattttcataaggcagctatattgattgcattgctgaactgtaaaaatgattgcaaaccaaaataagagagatagatagatagattagatagatagataagatagattagatcatagatagataatagataaaaattaattgttttggaaaaatttggaaataaagtgaatataataaatacatatatatgttagcttagaactggcatctgttaatggaaaaattgtattatacttttccctcaaagttccttactttctctgaaaccagcctgtatataacaatagccagtccgtatatggctacgcagtttatcctgatgtagttgcacaccttcctttgtgccctgaatgtgggctctttgagatccactgctgttaccaccatctggagactgctcgggctcctctctcagtctgtggttttatgtcaaatccttttatcctttaatttccacatctgtacatcctccttagcactaaggcatcttttgataatgattataggcatgcaacattgccctagatgtaaatcaatcatggcaaatacccttgcagagaacagtatctctctataaggacatacaaaagaaaactgtattatgcttgaaaagaaatatttctgagatcactttattcttgatctctgaaagtcattttaatcctgcatttttattcactgatgtatccttgtatctgccatctctttctacactacatccttttatttttcccagggctaagtacccgtatgcttttcctttcaatttcaaaatgtggaccagatgttgggacataagtactagtttggaacaaacatctgtgcccttttcaggcaagaagaaatgagaatgaggtcaggcatctggttaaggacacaggaggcatccctgtctcgtttcttaattagttcttctaagaccttctctcattctatacataatgtttataatttaaaattcatagggtcttatgttgaaagggagaaaccactgtgtggaatataaaataaaaactcattttacagtggaaaaataatttaatctatccagcttattatttttcctgggcataaagaaaatacaataattaggtagctgcatattttaatagcttttaacgctgattgtaaactcaatactgaagaaattagtggtcagttggtctttctatttttattaacgaaaactgccaatgagaggaaagctaatttaaaaatcgtacaagagtaaccttaaaagtgacttaaaacatgaaatatataaaacacatgagccacttatgctgttataatttctaaagttataccatattggctataaaccatgaattgatatgaaatctgagcacatgcatacatatcactcatccttatacaagtggagagttttttcttaaaaaaaagggggaaatgtttatgtttcaatatacttgttccattcctaataaatgaaattcattgctgatctccataatgggaattcttggctggtgtcagattaaatgtgaatttttggaagtttgtgaatgccagaaaataaaaggtggttgatttccaaaatcaaaagtaagatactttaggtatgtatgtatatatgtattttaatgttttcagcaaagccaactaggaacacaaaaagcaacagcagactagcaaatcacaacaagatttccgggtcagtctgctggtcaaatgaaagttcttatctacctatgatttaggtgtaactaggaaagcaagttgcttgacagaactgaaaatagaacaaaaagttccagattcatccaaatctgaaagtttagatatggaaaacttcctctgcttgggctttatataaattttctgaagtctcacagatcctttcaaagggtttgctgttactgagaatagaaataaaatctccagattcctcaaaatctgagattctaggcctggtttacttgttcttttggagttttaatttttaattaatcttctcccaaacttcccaagttctccttaaggcctcacatcagtttttccagctgtgatgctgtgaagcaatgccttgtcagcatcaggcctaaaagaggtcagtatccctttaaaataaatcttagggtttcactaaaaaaataaatatgtctataagcattcagctgaatgtggatgatttatgcttctatacatgcaacagcccatttgcaattttgctttaatgggatagagaacagatctaattagtataaagaaattggtaggaaagacagtcttagaaatcatctaatccacaaagtataaatgacaactttctattctttgtccatataaaaatttttatgtaatttaattaatatttaaatgtatttttttcaaactgcattgcataacaccttgatctttattctactggcctcattcagattaaagttttgcagattttgatgtggaaagcactatggaatcaagcctgagaggatcagaatcatcatttgtcatttgctaaatgcaatgtcaagtggtaattcaagataaatgccttaaagataattctgcagtcacagacgtatttttagaagtgttgaattagatttcatattctcaacacttctgtgatctttatagaaagtgatggacatatgaggtacataaactatagatagttatgattgttttagaagctgaggtaaagtgtaatgtcatcaagggactgcatgtgatgaataaaactaatgactagaaagttaatcagtgtgaatattcaaaaaatgattatatattcatttttgaagctataaatgaatcaaattataatttgattcatttatagcttcaaaaatgaatatatatatatatatatatatatatatatatatatatatatatatatatatatagtcacccaggctggagtggtgcagtggcacgatcttggctcactgcaacctctgcctcccaggttgaagagattctcctgcctcagcctcctgaggagctgggactacaggtacgtgccaccatgcccggttaattttttttatttttagtagagactgggtttcaccgtgttagcaaggatggtctcgatctcctgacctcatgatccacccacctgggtctcccaaagtgctgggattacaggtgtgaacaactgcgcctggcccaaataatgtatttttatgtttaatttgcaaaaattattatttttatttatttctcaaggcacatgagaaaatatcaaaaattatttttaaaaagcattaatatataatatgatcatcactcaacaatgagttactgtcatacacttgtttgaaggctacttaaactatccataaaaggaaccaaatcatatcctttgcagggacgtgaatggagctgggggtcattatcctcagcaaactgatgcaggaacagaaagccaaacacctcatgttctcatttacaagtgggagttaacgctgagaacacatggaggggaacaacacacactggggcctgtcaggggtatgtggggagggagagcatcaggaagaatagctaatggatgctgggcttaatacctaggtgataggttgatctgtgcagcaaactaccatctcacatgtttacttctataacaaacctgcacatcctacacatgtaccctggaacttaaaataaaagttgatgacaaagaaaaaaagactgtgagatgcatgttagattattgatatctaattaatttcatttaataaatgtctattaagaaaaaaatcccatctaatacgaaaaccacgcaggaatgtacaataacaaaatcaaagattcagtcaccctcacatgcatctcttttctggaattttggtttgtagcacatgctacaacattagacagtagggtttatgtggtacaatttttgtggaacattagattttacatatgtcctatacacatacatatacatacatacaaatatctatgtaaaacctgattcattttgtgtgccaacttgactgggctatggggtacccagatatttggttaggtattattctgggtgtttctgtgagtggtatttgggaggagactgatacttaaattggtgggctttgagtaaagtagattgccctccataatgtctgtgggtctcctcccatcagttgaaagcctgaatcaagcaaaaagattggcttctcatgagcaagaaagaattctccttcacaatgctcactgcagatttaggacttgccaccctcgatgattggctgagctaattccttataatatgtgtatttctctctatatatacacatcctattggttttgcttctctggagaactctaatacaatacccacataaaatatgtcacttcttgttggttatgaaaatactcttgcatatcaaaaactctcagcactacttaacaatcagaaggcaacaagattatatttctttcaaatgtaactcacagattcccctcttaattcctaccatgtaatggagaaatcaggcctgcttcatttacaccatctttgcatgacttctactcaccgatgaaattgattttctcaaaatagcatcaacattaaaatttgtcccatggatgctgactccttccatggttttccaagaaggagaaaatatatagatggttatgtgtaggtccatgcgtgtgcattttaagaatacgaatttccacatgctgttagcaccagtcatgtgatattagctcagcaggtattaccacctcactccctcaggtagctccaattgcaagagtgatatagccaaaacttacaattggaacctggttataatatcaacatcacagcacaaattgcatgtagctcaggtcactctctttacttgcctccttgcttcaaaggaactaccttctccttgcaaatttacccaagcctataaagtgcatggagtgtcagagaataaaatacttcctgaacatgacatttgggtaaagtttgattgtctaattattatggaaagaggaaagggaaggacgcacaaaaagccacaaggaggttttaaaacacaaggaggggccactggacaagcgcggtgcctcacgcctgtaatcccagcactttgggaggcggaggcagatgaattgcttgaggtcaggagttcaagaccagcctggctaacatggtgaaaccccatctctacaaaaatacaaaaattagcctggcatgggggtacatgcctgtagtcccagctacttgggaggctgaggcatgagaattgcttgaacttgggaggtagaggttgcagtgagccaagttcaggccattgcactccaggctgggtgacagagcgagactccatctcaaacaaaaaacaaaacaaaacaaaacagaaaacaggggctactggatgcttgtgagaggcagaacagaggaagtttaacaacaaaatggcggccaagcttgggatttagaactattggaacaagagcagattcctaaactggccaaatctcaggagaatgttgacaacacctgtgataggttatatataaattaatatacaaattttgaaattgtcaggagaatgaagtctagcttcacagcaaaagcagttcaatacattacttgttttaataaaaaattataacaaggattattaattcttattaagtgttaacaagcatgtggagaaaagggaattcttgtatactgctggtgggaatgtaaatcagtacagccattataaaaaagacagtatgaaggtttcacaaaaaattaaaaatagaactactctatgatctagcaatcttacttctgggtatatagccaaaggaaatgaaattagtatgtcaaggagatatctgtactccatgtttattgaagcactgttcgcaatagccaagatatggaatcaacccaaatgtctattgactgataaatggataaataaattgtatgatatatatgtatatatactacaacatacacatatataatgaatatactacaatatgcaatgaaatactatgcaacctttaaaaagaaggaaatcctgtcctttgtgacaacatgaatgaactgggaggatattatgctaagtgaaataagccaggcacagaaagacaaacactgcatctcacttacatgcagaatcttaaaaagtgaacttacagaagtaaaatgtagaattgtggatgtcagtgtctggggtatagggcagggaatggggagatactggttaaagggtacaaaatttcagttacataagataagtcagttctacagatctattgtactgcatggtaactatactttaaaataatatgtaatcatgtattatgcttttgaaaatcgcatagatcccaaatgttctcagcacaaaaacaagtatgggaggtgatggatatgttacttgggtggacttaatcatttcacaatgtacacatagatcaaaacatcaccactgtacaccataaaaatatgtaatatttatttgttaataataccttaataaggctgggcgcggtggctcacacctgtaatcccagcattatgggaggccgaggtgggtggatcatgaggtcaggagatggaaaccatcctggtaacacggtgaaaccccgtctctactaaaaatacaaaaaaaaattagctgggcgtggtggcaggcacctgtagtcccagttactcaggaggctgaggcaggacaatggcgtgaacccgggaggtggagcttgcagtgagccaagagagcaccactgcagtctggcctgggcaaaagagcaagactccgtctcaaaaaaaaaaaatataataataataataataataccttaataaagctggaaaacagaaaaagaaatttagtaagaagatacagtaataacttttagtagcatttgtttattgctttgcaaaaatctttaaatttttaaaataaatgtgattctcacagaaaaattatctaagggagttagaaaactgtagtggaacgtgtctagacaagaataggtgaattgtctgaattcaaatctagtgaggagtagaatcagacgttggtcccttaccttttgactccgtacactgtatgtggtaaagaatatgtgaaaaataggattcagtacctgtctaaatttaagtgtatttgggatagacaacttaaatacccacactagacagcattaaaagtcacataatgctttcacataatcatttgtaggtcagtgttctggaaaaaaggaaaatcaacgtagactaggctatttttatgtcaatgtaaactgtcactgctaaaaatgaaccagaaatgtgaaagataaaatattttcttgtttcctaataagcttctctcatgctccatggttatttttattttttgaatacagtgcaaatattactttaaatattctaaattttttcttagagtttttcattgaagaaacttctatttggcgtagtgaaaagacatattctctgaggcttgaatgagttagaagacctccgaaaaataggtgatatgatccagagaatagtttggagccaaaaagaataataccacatgtcactacctggagtaattaatacttcttggtgtgtagcacactgttttatctctacttaaaccaaagcatagccttgttttgttgtataatttatcagttctcttttcttctttgtttctcctttacaatttttcttctctttcttcaagaagagatctgaatgagaattagtatgtttactagctctgactcatatgcagaaccctgataaagaaaacagatgatcctctatttccctacacagccacattctcccccttctaacttcacacataaagggaagttgattattatccagacactgtcttcccttctgaccttggtgttttcctttccgagcatctcaggatactaatcactagttgatctctttattaaagtaacactgctcttgatattggtgtgagatgcactccattagtacgttttgttttcagaatatctcttatcaaagccagatataatatagcacacaaaatagtatgtgttctgcaatatcaagaaaggagattttttagtcaaaatatatcattattactggataaatacacatgaggcccacgcagagttcttgacattggaaaaacttatttactccttgtagcggggaatagtatgttgacttagtagcattgtggatcacatgattgatcccttgcaacagtttgggcgtctctctcatcatctctttctgaatagtccagaaattagtagtagttctaaaaattacttaaattacccaacatcaggctatttcctcaagtcttctttagagggaaataaccagattgatggaggaggaaacaatgcatcagacattaaccttcccccttgcaggtgaggtaggcctacactccagttcgtcatgggagcaagggaagggcagaaagaggaagttgaatagactagaaagtattagaggataaatgggaagaaatagagggaggaaaataaaactggaaataaaaacttaagacagaaataaaaacaaaaaggagagtgatgaatacaagaagagaactgttatcttgctcaattcttcctgtctctgataatctattctatgtttcctcaagggctttgttatattaaatgagttttgccagaattatgtgtactgttgccatgatttccatgtattcacctttctttttgaattcttctgtctcttcctccttcccttctttttgtctcctgctacccccattagttccaaattctaagcaaaggtaatctactcttcagtataaatgaatgtttctgtccagtggaatcaatatgttaaattatcttgccaacctgttaaccacgtgtcaggaacattgttcttaaatgtgattgtgacaaagcaactagatatcacagtatacaagtaatatatatgatacacacacacatatacgtacatatatacatacgtgcacatgcatatatacacatgtatatacatatatgcacatgtatgaatacgagtaatatatacacatacatatgtgcatgtatgcatgtatattatatacatgtatacagatatatacatatgtgtatatgtgtgtatatatatagagtaacttaaaatattttgacaaaaataagttttcatcaatactagattctaatatagtgttaacaagtgctaaaatttaaaaaaatgatggcaggtttgtaaaaaacaataaaatacaatctattcacttatctgtttcccataaaaacagagaaaggttgacatcctttgtttggtgtggatcactattttaggtgagcctgggaggaatgatttgagaagcagtgctttagaatatctgaatttgagaccagatcaggaaacatggatatacaatgtgtttgatcctgctattattttaaattttctcctacttattttcttatattcaatttggtcacaatgcattttcaaaacaaagcgttcattttttgaccacaaaaaacagttcgttaatgaaccatctcaacagaatacttttattttgctcaatgtctttcctttgaaactgtttttttttttttttttttggctctctttcttttctctccaaacaacaaacaaatgaaaccgcaaaaaccctgtcaatagaagtaaagtttttaaggcagatttattgtctttcctcctccctatcagaatatttaataagggtgtggctttggaaggaaattgtctcagtgatggcagaagaaatctacgtaacagatcatattgaatatattgtcctaaaatgaattatttcagagaatagaagaaaacctcttatttgttaactcatctgccttgtggaaattggaaacataagctaattaacagtaatccataaaacccattagaggtgtagatgggaaagatactttttgaagtagtaagtctgtaaatacatagttgcaccttcttccctctttttctcttcctcctccttctcctcctccaattccacagctaatattttcactatttgcgaacttatcatcatttttaatactgaacacgttattctgaagtgatccatcttgcattctaatatcgagtgcttcataaatgagcagcctagcaccacgcttagcacactatgttggaaagtcttataaatgactttgatcacaaaatgttaagaaaaagttgtttccagattggctgggcaagcgggaatgaatttgagagttgtttcactgcatcattctggttgcaaatactctcttgaattttaatgatattgtagcctgcctcagtgcttggaccccatcaactttacttccattttctagctgccttttctgcagtctatgatcattccatttctgaacctagtctggtgtctgctttaattggcctgcttttgtgatttgttcagttagattggagcttttcagaaagatagtcagaagccctgcccatcaccgtatccccagctgaagcctctttgactagtctaaacatacacacacacaccacacacacacacacacagccctttatttgtgtttgtgttttctagtgcaagatgttgcagtcttgagtccaaatactcagaggctataaaggcaacagtagctagctaaatttttccccactaaaaagcaaagattatgaagtttgtttttttaaagggattaaaatgtggcagggtagcaaaaaggactcagattgtggaatggccttgagcaaagcattaaggtgcaagtctgcagcacagaacagtcagaaacctacccagctgtgggtcttgttcttcctccatctaagttccagagctattagcagttccagctctaactcttcaatgtgacttttagtgaggtgtgtagggtaaattgaagtcctaggtctcatttgtagaaaagtattaggtgggctgttccctagtctgtttgaatcatcaaatcatagaatttctgtgcattccatgtatgtgtggcagaatcacttccctttacacaagatggctaaatgtttaaccagcttctggagaggcatttaaaaatgggatcttctgagactttgcatgctgtcttcagacctatcttgtttcagagtactagagattgatacggcaggataggttattataggaaacatattttcgtagtccagaaaatgagaatttatttggtttatgttgttgtttttttatatgattctttggctaagacactaagaatgaaatctagttattgaaatcaattttatcaggaattatcacatatacggtgtatgaaaattattatctggaagttggaaattattttctttgctcttttgttgagtcgcttattgacttaagtggtgtttgctacttacctgagtagtgggcatttgaattccaggactttgattggacctctggtctggttttgactgtttacgctgggctacaccataaaagctcgttgggttctaaagactgagggaaatgatgatgtaaactagaatcaaaaagttgtttttacttccaactaaccagcaaagaagcgattcttgaataccaagtgaggggattaggttcccttcacttccctttctttttggtaaaagctgatacaaagtgaaggatgcaccgggtcagaggatctgagaggtgagaattctgactttcatgtgagtggctgggagtgggatcacatcagctttcaaataagtttttgcagcatcgctattaggaattctgtgctgtttcgtagaacttcatctttcctatacacaatttcgttacagcagggctgcatttgaactacaacaatgcttaccaaatgtgtttcaacaggctgttgttttcaacactggttaactgttaaattttacctaatacaaactgatagaaaggatcattactacagattagtgagtacatttaatctatcttttcacccttttcccaaattccctttcctttattcatttggacagctttccccaacaatatttattctagattccagtagaaaatgctgattttgaagtaatcaggaatttatagcataataaaagaataatagttttaagcgtaataaatgactgaaattgctcataattgtttgatgattttagtcattgaaaagcctgattaggcttcatcttctgatcagaccaattgttgaataattgacaagcaactaattaatcctaaaatgaaacagtctgatctaaaatatccctacttaatactttattgtgcttggcatactgctgttcctgtgaagacagctatagtgttttgatgattatgtgcatagctgtaaaaattaatatggtttacacatacctcttcagtaatatattttttatacattcaaatttatttcaatgtacttttatcttgtccctctttaaactcttctaagtacaaagtggtatcattgggggattaatggctatttaataatttaatgttaacaaatgacaatatatgaaagacttccatcattcaagtagcctaaactatttgcaaagaatttatgaactctatcatatttgaaaattagcgtgttaattttaatcagttttcaagtatattaccacttcttaactatattactaccatctggtcttctattccttaaaatgtagaatgttctggtaattattttgcctttaagaaaaactaatacaaaaaccaagtatttgtgatggagtcgttgacatgactgatttcagtatctctaagtaattagttaaaatatgcttgttgctttcattaaaagcaattttacacagactaatgcaaaagatgatggtagtaaataggttttcaggtcatttctgataaagttaaatgtggttgtcatttcaattgatcattctgcatcttttccagactgtccatccatctcttggaacagcctgttcaataaattctacaggaaataatttgggtgattttagagaaagtgcatccttagattaaatgcttttgggtacttttatttatttctatgatggataagaatatatttcagagtgttagtttcctgatttataattattgaatttccttgaaaaataactatttgaataaatcccaaatgaaatacaaattctgtgcatctcaaggaaaacaatgaattcaggtaaagttgatctagtactcacataactatatttacatatgctagataaaattattgattacttagcacaaagttataatgtcttcctgttattgaaatattgaataataccttggaatagtgtgagagcaatattgttcaatgtaatagtagttgattaaaaatacatgcatacatggcagacttgacaagcatcttatttattttgggaaaaacttgttcaagagttaaacagtttcataaagaaggtgcatttgtgttctctaatacaatcaggtaaaagaaaaaaggtaactagagataaaacagaaatcttgatagacagtatagaaagattttgggtgcaaaagaaagcataatattagacatctaaaattttttaaaaagtacatcaaaattatctcaatctggagaaagtcaacgaagaaaactaagaataataacacagtatgataaagaccgtgatcccccacttgtaggtaagaacatgcatcatggacataaagatggagacaataaagtgacgactactagagcagggaggagtagaggggcaagatttgaaaacctgttaagtactatgcttagtacctgggtgactggataattcataccccaaacctcagaatcatgcaatacacccaggtaacaaatctgcacatgtgccacctgaatctaaaatcaaagtcaggaagaaaaaaaaaaaaagaagacaatgatctgggtaacacaggaagtgcaaggagagtgtacaacccagtctaatgagtttcaaggaaatgtcaaaagactgtgagattgaactgactctgataattatcagtaggaatttgtcttgctgttgtgctgaagttcatgcaaaaatgctcaacacatagttttttttgtttgtttgtttgtttttaaagaatttcgacaaagaaataagctctctgctttggaaggtcggtaaaagtctaagttgcaacttaaaaaaagatggcaaagctgattcacctgttgcttctaccttcctcagtaagaataaatagttgggaatctggaaggagtttaaaaaactctgcaaaatgaaaattatagactgagataggtgaagcaaaaataagagaatgcacaaccaaattaaatgttagtctctagaacctgataatatgtctaaatactgaagaattagaaaagtgtttaaaaaaaactgtggaagaaaaagaggcacaggatactgtatagaacacttgttttctctgatgtcaagtaaaagaaatgatcagattctaaaggcaataaattgataagttaggacaatttttaaaacatttcctgaaatactgtgttgttgcaaagtaatatgcagcatccagctcctccttccaggaagatctgctgtcccagttgcaggaagtgctggaggtgagctgcctttacctgtcgccccctttggggttccctgagagtctggctgagggtcaagcccacatcacagcaacccttctccttctgaccaatccagctgccttcccctccctttcaccagtgtttgccccaaagcaaactccagtagccatcctgcacatcatctcggtcccagagactgctccccaaagaagataccctgagaaaatgttggaagcattaaaaaaaaaaaatagtgccactgcccagttaaagaaacagaatatgtataaccatttcttttgaagctcatacatgctctttctcttctcaaattgtttccacaaacttcagaggtaaccactgtcttaataattgacttttttttttttttttttttttaagatggaatcttgctctgtcacccaggctagagtgcagtgacgcaatcttggctcactgcaacctctgcttttttggttcaaatgattatcatgtcttagcctccctagtagctggaattacaggcacctgctaccaggcttggctaatcatttatttttatttttagtggagacaggttttctccatgttggctaggctggtcttgaactcctgatcgcaagagatccacacgcctaggcctcccaaagtgtgctgggattacaggcgtgagccaccaaccccagccttaattgacattttttttttttttttttgagacacagtcttactctgtcacccaggctggagtgcagtggagcaatctcggctcactgcaaactccgcctcacgggttcacgcggttctcctgcctcagcctcccgagtagctgggactacaggtgcccaccaccacgcccggctaattttttgtatttttagtagagacagggtttcaccgtgttagccaggatggtctcgatctcctgacctcgtgatctgcccgtctcggcctcccaaagtgctgggattacaggcgtgagccactgcgcgcggccttaattgacttttaaactaatcactcctctgtttttctttataaatttaatcacacatttgtatttgtaaacatcatgttttattttgcatatttttgaaatttatatacatggaatgagtctgttgatagtattctttattttgttttctttaccaaggcagctgaagatgcaagggaatagaagatgagttcacaaagaaaaaataaagagataataaataaacatcattaatgaagggcatatagagaaacaactcttacttgcaaaatgcctagcacatatgactcccactacctgatacgtccctttctcctttctctgcctggtggagacttgcccagatattgcctcttctttcctgaatgaatctttctaatttttcttggttgtgtttcttgctatccctaactgccatattttattttattttattttgtttcatttgttgagacggaatctcgctctgtcaccaggctggagtacagtggcacagtctcggctcactgcaacctccgcctcctgggatcaagcaatgctcctgcctcagcctcccgagtagctgggattacaggtacgcaccaccacatccagctaatatttgtatttttagtagatacagggtttcaccatgtcggccaggatggtcttgagctcctgacttcatgatccgcctgcctgggcctcccaaagtgctgagattacaggcatgaaccaccgtgccaagcccatattttatttttttttatctgaatcccatgtatctattttactaagtagcccagccagataagagtaagccttactaacaagaattctgtaaaaagtcttcctacctttgctttcagaaccatggacccaattaccaattttctgtttgtaacgatacttacatgggttaataaaaaatacaatattcacagaatgattgggagtggaataagaatcacatattattccccaaaaagagttagacaaatttaagttatattgaaaacaagcaataaacaatacaggtggatctgataaaaatcttaatccaggttcactagaaaatttgatgaaaacatgatctgggtgagaacttgctcttgttctccattgtttactggccttcctctgtctggccacatcctgcaacatagaagtcacttccttgaatcagagtttcagacaagtcttaagtcgaacctttgatagcttcaagttctccttattagcttgtatgagctgtatacatttttaagtcttaaaatattcttggttctctgcttttatgctataaggcatctcagctgtgaatcaacaatggagaaatagctgctgggtttaattggacccaatagtcttttctgatggcaaaaatgtaatgagttccatgatgtttgctgtgatagagcactcctttctgttccatttccatgtggccttgtgccagcataatgaatgcctcacacatagtagtttctcaatttgtgtgtgcagattcaataacaaatgaatgctcaaatgaaatctcaataagataaatggcgtgtttgaacttctcatgtaacacatatatagttaacacaaaattattttaatgataactattcagatagtgtaggcacattttgaattatccagaaaattgactttttaattcctataagtgagtgttggctattgcctaaatttgagaatttcaggaattctgtggatagcaaatgattagaaattaagatccataaatcactttttttgtgggaaatggggaccagttctggtagctgaataaagaaaattccaacagattctgtcagtttcccagatttcttaagaatctgaaatgaacttgcaagtttgaatgaaaatgtccccaaagtagtgaaaataaaagctctcatgggcatcctggtttggaaaaatattataaacattttatgtagctcaatttaactttcctacattatcgtcattctgcaaatgcaccgttacataggccactgttctgtatggtgtttcaggtagttctgtttcacagtgggtggatatgactacacagttccacattaatatatttagacctaatgtagggaatatggaggtctgcgctatatatggctcgtaaatcaataacaaatgagtccacatttatgcactatttacagtgaagttttgtatattctgcatccaaataattgcacttattatgttccatattttaaagaaaaatcacatcttttctgctgtagaaaatggctaagtagataacggatttctgaactaaacataatatgtagcctcaaagttaaagcaatacgcttgcattgcactcggataaccactaggacctcagagcatgagagttctaatcaattttgtttcatatgatttgttcatcattaatctaaaaatgtattactacccaacacttacataaccataccataaatatgaaaaagtaaaatcactacatctaacaattgatggaaatatatatgtgtatccaagctttaaatcaatatagattctctacaagcaaattcaaatattttcttttgcatctttctagtattaaaatacgttttacacaagatttgaatatattttcctttcttagccacgtagttggtattttgcaaggtcagtcagcctagctgagagtcgaattagtttgagcagatcatacttggacgatccaatgcacttgtaattctgctccttgagcttagagcctcttttaatattatcatttttatatattataattgtacatcttttcattttaaatgtaatggcattagcagtgggatactagatacgtgaagccaaatgataagtgtgcttaacatcatttgcagaatttgtagatgtttagagaggctagggaagaattatatttatattcagagaagtagatctatatttggcctgaattttcaacatttgagatttaaagaaatgttgagcctacaccttaatcatgagagttgtccgtgatctagcatctctgaaggaacgtctacaggctctgtggggaaaaatttctctggcagggtcagggaaagaaaaggcttcaactcctttcagttaatgcccaaggtgcccatagacaattctagaagcacaagagtggaaagaggtcactgggtaatgagtaaaactgttctaaggggcatgtctcattaggtgatgtctaggcagaatgtataaaaagataaaaagtccttgaattatctcatgcttttctggcttttttcttgcctcttttcccttcttcttttcctttcttcttttcctattttttcctttctactataaaaacttcaaaacagcccacttctatctttcctgtccctcaggaaaccaaataactcattggatgtttgagttgaatttgatctaaaccatctcttgatttccagggtgacaatattcttctttctttcttggatattgtggtttactgaagaaaattaatctcaataaacgcccctggatttaaactatttttatcacagtctacttctattcagtttatgttctttccacctgcaactaaaattatgcaaaccttaggcatttgtttttgtgatacaatttatctccgaatacctattttgtatgtttttccccccatttttctattcaattcagtaatccacaatgggatacagtctcctgggtcccacaggtttgtctcaagtattgttttgttcttccaaaaataacatctttaaaaatcatatttacattttgattacttctgtcttgtagaataaaagatttcaggattgtgtccaccgtacaaaaatcagaaatttatttttagtaagagccatctgtcagtcagaatctgacctagctaactgggtggatggccgaggtcattttaatgtagttggctagtaaaaccctctctactctctaaagaggcctaggttggaatggactctccatgattgggataaagattaaaatggagtgtttggagattctgagtgctaaatcaatatttctgcacaatgtatttcaatatatttcaggacttctgtgtagatattatttcagtttcaaagtgcatttatttttttttattttattaacctacttttccaaataaactatttgtttctgaatatttatatatatatttcatttatataatataaatataaatatatatttcattttccccaaaacatatacttaccactcatcttggaacaattttgagaacatttgccagaattttccagaatcccttcttattttatttatttatttgtattttttttttttaccatggtctacctccctccatatattcctttatgtgtcttgccaaacagggaaggagaatgctgttgttcttcacatgatttgagctttagcattggagggagttggcattctatgctgttatatttcctgtgttatatacaatactctgttattgcccaaagaatcattattgattttaaatgaactgtaaatcatcaatcgatctgaaaatagcacagacttagttacaatcatgaaaataacacatctttaaaaaaaactaagatcagttttatgttaattgtattttatttaagaattatagtgtattattaaataagcaaaggaaaaataaaagtagacctgactgtatctagattttgaagaaagatgttggcatttatatccaggtagaagtgtattgctcaatctgatgctgcttctcatctctacttatcactgtaaccagagggccaggtttaagacttaactgccaccagcttaggtgtgggtaactcacttgtgttctctggagcttagatccctaacctgtaaatttggcttgaaacatatgcctgagcacgagcgcgcacgcgcgcgcgcgcgcacacacacacacacacacacacacacgtacttacatataaacaaatatgtatatgctatatatttgtgtgaagatacatatataatttatttttctgcagactggatgtcaaaaaaagcacatatttgaaatattttgaacttttggataacaaatttacatgatgatgtgattctaatatattgggtatgttttctagctgttcttagcttgctgggttcaggtttctaacaggtcacctggcaatgcagtgattagaagaaacttcatggaagagatggggctagtgtcttaaagggagaagatatgaattggtagaacagaggaaattcagttcaaacatagaaaaaggaagccctgcattaaaatttgttacagtacatcttgaggatgagaagagacctatttcaatgaatgaagtggttttcatttggaaataggcagaaaaaaatatagagtgcagaggcctttaggatcagtctgtgttaactattagttttcgggaggcagagccagccattgagtggtttggacaggatggtataatgatgaaattgaagtttgggaatgattattctggcagtgaatggtatacagtcaagatctgggagaccaagattgacagactgaaaatcagtgggaaacagttgtagtgatctaaataggaagtgacaagagcctatatcacaatagtgacaagaaaaatgaaaaagaatgagtatatctgagatagatggcaaatgagtaactgacagtatttgatcatacttccagtcctcccaataccccaaaatatcacatatatttttggccagggagttggagctaatgatgttgtcacagtttgacagcagacatgaaaagtagaagtcacagagaagctgaagaatttagttttcaactaaatttatgattttttatgttgggaaattaaaaatatcctaaaggcactctaaattgaaaggtgacccacgtgaaatatcaggtgagttgatattgattaggaagctgtctctacacaggtggttgttgaaaccgaaaacggaatcagctctcactgaaatgtgtttcccattaggctatctactcctcaggataaacctagtcatttgtactggtttcagatacagtaaaatatcaacttcacctttatttttctctcttttgcctttaagtacaaatgtaaattttttcttctttagttacaagaacaaatttagagtaggttgtcaatgtctattgccaagtaattgcaatattcacccaaagaatcttgtaatattttatgctcattagcaattccatttgatatccaaaatttcaacaaaaggaaaattatacacttgtttatccaagctgaaggcttttgaagatactgcagaattcatagctgctatggaaaataaagcagcataactaactcctggtatttattttctcaaaaaagagatttgattttttttatttcttttttgtgtgactgtaattattatcattattttttacttttggagaggcaagcattttgtgctatgaattgaacgtagagttgtacacagaaaaatatttgttttcatgtttcctttccctaaaatgtctgctagagtacagatgaagattctacctagaatgaagataatcttttttgaaacaattggttaagattaaattgatttggtttaaataagactatatatggagaatctaataaacattgagacaagtagatacaacaatagtttaaagaagaaaaactgaatacatcctattcagtacaaccttagataaaatctcatgaatgaaattacttggcgagtagggctacaaaaaatagggaaatcataggcgcacatgctctagcaactatggctacgcatacactgccgcttcccaaaattttctatcaattttaaacaaaggtagagaataaaattatggatactatcttagcaagttttcttattttttttaaagtaagattgctagtgctgcatgaactatttgttttccccaaacacttgagttgcaaagaattttatttcatggaataatagaatccattaactatgatcctagagaaagagaaagttttcaattagttaatataattatatttgttacaagtcaatcagcaacaactcagtatttgaaaatccatgttttagtttcaactgaaccactacctagtcatgaaattgaggaaacgaatttatcactaaggacctcagttggcactgtaatattcattcagatagattattttaaaaacaaaatcaggtcatacatataaaatgactgtgaagactctaactgctttgtgaatgtgttgctaagatcattctagttttattatttgtctcatggaggattccattatacatattttacttttaagtgagtgataaaatgttaagcttcctaatgatttctgtggtctctagcatagagatttgttacaaaaagggatgccatattatctatgtaatcattttacataatacatggagttgtactggattaatctcaaccatttttaatttaactattactttgtagttgaacttgagcttcctctattcaaagattccagtaatcattcttcttcagcaaacacacacacacacacacacacacacacacacacacacacacacacacacatcttctggattgtatactaaaaatttatatattttggattgaaattaatttgtaaccaacaaagtttattatttagagactgtgattctgcccagattaagatttgtggcgttatgtttaaaaggaagacaataatacctaaattagatggtcagtgttaggattaaatgagataagggtcagaaagtgagtaatataatgcccaacttatagcaggtgttaaattattgtatgcattctaccgtcctccacaagcacacacggcccctcataacacaaaataagcactgaatataaaagcctcagaaagattaagtggtaggaaaagttacttttactctttggtaaccccagacagagagttggtttggggtttagttaggaaagcatcacaggtgagaaacacaagtttgaggcagttttatggcagagtgtggaggtttagtctgagtttgcggcttttctttcctcattcatatctcgtcaattaattttcccctttaaggaccctttcaagcctgagagaagagtacagaataaatcaaaagaaagagtggagagacaaaaatgaatgcagaaagagggatgcaggaaacaaaaacccagcaagtagaagggaatagtgagaataaagaaaacgagaaaaagaaaacaaacaaacatgcacacaaacaaaaaaccaccaagagagggtgatccatacctcacagtgctaattaagttctaagctggtttgacatttttgcctcctggacaccaacaccctccaagcggggcctctttgatttggtctcacatcagtagcgggctttgttatgagatctaggtattaaccccacatgtggaaagataggttaatttgactaaatatattttttaaattctccgcaccattgagtcatctaagtgtcacatctagtatctgccacctaatgttatgcttagcttctcctccttcaagtagagaaatccagataaccaacccctcccctcttcccctctacacacatgtacacacacatgcacacacacaggaaggcatgcatgcacagcacatattaaacacacaaatgaataaatagtagagtccgtggatgatttagagacatgtgaaaagtgaaagttttgggggctcaagtaatttaggagagttttctattaacatgtagtttaatgttgtctttccagttaatgtagttatataatatgtaaattaaagatggtgtctactgcctaagtaattattacaacaaataggaccgattattgaaggtgaactccttccttttctgttctctactcaaaacaatacttttaaaattgcttatttagtattgaagtaggaaaaaaataacgttgatacaataaaagaacttatttctgactggtaggtgatgataggatctgacaagggggtgtacttcagagagattgtcaggattctacacccttgtctgtgcctaggaaaacagcccaacctacctacctttagttttgaatggaggctgcaggatgttactcatcattgcttttagaacaaacacttccctttgaacgatgtcacatcactattaccatggcaacagacgccctataaagatgagttatctatgaattgtgcttctgttcaataaacacatctcttaaattcatcaggaaaaaggtttagtggaggcagttctatatattgacatttcttattctaaacctctgtctgataataaatattcatttcattaaagtgtttaattcaggtgtctttcatattagctatatcacataaatttataacagttttatgaatttaaaacagttgctttattataaaaatgatgtatttacataataaatgagattattcttatgctaaaaagcataaaaagaaaaaagaactctattctcagtgtctaaacatacagtgaacaattaatttataaaaaattaagtttatcaactttataaacaaataattttataaactttataagtatagagtcaagaattagcttaatggaccaaaaaaaacccaaaaaacttgtttcaagttaatgacttttagaggaatgcaattaagtgggtagaaattatagctccatatattttatttattttattttttatttttttgagacagagtcttgctctgtcccccgggctggagtgcagtggtgcgatctcagctcactgcaacctctgcctcccgtgttcaaacgattcttctgcctcatcctccagagtagctgggattacaggcgcccgccaacacgcccggctaattttcgtatttttagtagatacggggtttcaccaggttggccagactagtctcaaactcctgaccttgggtgattcacccacatcgacctcccaaaatgctgggattacaggcgtgagccactgagcctggtttttccaccaaagtagcaccctctgggaatgaggtaatgataacacaccgacagcaaattatttcgtagaatcatctcctcctgtctaaactgcaatctacaaaaatactttacataatagataaacctaagaggaaaatataaagtccaaaagggtaaatttctaaaacgaaattgtaaataaaagaatggaaatgattggatgccagaagaaaggcaatgagaataatttgtcagcaaggagaatgatttgattataggtaccagtgtcatggctttataaagatggttatgatttcaataggtcgcaaaaattacaatgtatatgattatatatcttaaaataatatgtaattttatgtaattatacaaaaaacgttcagcttctattctggacccttgaagaacataatattaatattttatggtgatctattcataaagaagttgatgcacctttgtagttattcttcgtcccaggttgcagaatgcaagctcccactgtcaattacacaaatactattggtttcacagtttgtgagtgtgtgtaatttttaagcaatttcttagaacctataaaatatatatatatttttttttttccttttttttttttttttttttagacagagtcttgctctgtcacccaggctggagtgcagtggtgcgatctcggctcacctccgcctcccgggttcacgccattctcctgcctcagcctcccgagtagctgggactacaggcgcccatcaccgcgcccggctaattttttgtattttcagtagagacagggtttcactgtgttagccagaatggtctcgatcctgacctcgtgatccgcccgcctcggcctcccaaagtgctggtaccacaggcatgagccaccgcgcccggcccccagaacctggtatattaatgaaaattttttttttcaaatctcagaggtaaagactagataagaaattgagtgaccaaaatcatatacttctcctaacctgaaactgccagccagtagtaaatggtttatcaactcattccagcaagtaaaatacatcagttaatactcttgcaacgtaaattggtatattgtagctcatttggtatatctcccaatattcctaattttcattttttagttcttgttaatcagtcctcaccagtcctaatcaacattttatttacattttacttattcgtaacattagaagaaatgtttgggtaatatctgtgcatacaggatatattttccaaggcaatgtagcatactggctctagaaacagatctggagtttaatgccatgtcaatcactatgtgaccttttgcaagttactcactgtcttttatcttcagtttcctgaatacaatgaaaccatctactgcgcagtgtttttgtgacaattgaactcaataatactgtaaagcacttagaacaatttttaggacataataattgttcagtaaatgtattccacctcctcatcatcatcattggaattattgcagttattttcaaccattattcagatcctattgaaaggttgaaggcttgtagaaatatatacggaatgattttcactgtcgctcggagtagcagatttatgaaattaattatccttagctccttgtgctaatactgtattatccctttagtcattttagcctggaattacactcttaaatataaccaagatccagtgggctacatcataaggaaaaagtagaagtggtgttgaggggcgtctcctgtagacaagaacaagtaagctaatttacttgaatttgactttgaatagaggtgaaaacttcaccaagaatttattgtaagtgtcccagtttaatagtgccctcagaagcctgtctaaagcaaacacaaatcttctctggaggaaagcaccttcaatctaaacttcaaagcatgcctatatataaagctcaacttactaggagtaaaacaatcaataataaaaaataatgataacttaaaaacataaagaaaagcaaaaaattgagttagtcaaagcaacagtcacaagactccaaccaagattcctagtgggtgcttcataaaaattgacaagctgaatctaagacctaaatggaagagccagaggctaagaattagaaaaaaaaaaaaaaaaaaaactccagtgaaacaaaaatttaaaaagtagaaaaagaaggagagttttctggatagtaaagtgtttgtgaagaaaaggtaaattaagggcatgtattcattttggatatagatgattttatgttttgtatgtgaatgcatatagagggatatatatgtatgtgtgtgtgtgtattatatatatatatatatatatctgtgcatgtgtatacacaaacatacactcatactcacattaggttggtcacagtggctcatgcctgtaatcccagcactttgggaggccgaggctggcggatcataaggttaagagattgagaccatcctggccaacatggtgaaaccccatctctactaaaaatacagaaattagctgggcgtggtggcacacacctgtaatcccagctactcgggaggttgaggcaggagaatcgcttgaacctgggaggcagaagttgcagtgagctgagatcacgccactgcactccagcccggtgacagagcaagactgtctcaaaaaaaaaaaattgtcataatttaaacatgaaatattttctcaacagcagatacaggagaataatagaccttgattgaataaatagatatcatggaatattatacatactcatggtcgagaaataaaaaaccttccaacagtgacattacttaatgtccataaacatttaaattattaaaagtgtttctcatttactatctcttcaatacaatatattttatttgcactggaaattttaaaaaaatatttttaaggccgggtgcggtggctcacgcctgtaatcccagcactttgggaggccgaggcaggcggatcatgaggtcaggagatggagaccatcctggctaacacggtgaaaccccgtctctactaaaaatacaaaaaattagccgggcatggtggcgggcgcctgtagtctcagctactcggggggctgaggcaggagaatggcatgaacctgggaggcggaacttgcagtgagccaagatcgcgccactgcactccagcctgggcaacagagcaagactccgtctaaaaaaaaatatatatatatatatatatatatatatatatatatatatatatatacatatatatatatttaagcacagagttgtgaatagcatgcattattgcatattgatacacattcattgttacataattttacagttaaataagtgagggtcagatattgccaaaggaagagttcaagagctggtttctaacacaggtcttatttttaaagcttgtttgtgtgtgtgtgtgcgtgtgtgtgtgtgtaatttttttggtttcctagtaatcgggagttttggaaaattatgatctcagtatgttcttaaaaatagtttatagataattccaagaataaaaaaagtttttaaatataataaggaatcttaaccaggtaaatgtatgtcttattttttacaaaaacagttaaaagttaaaaaagaaaaatagaaaaaaattataaaatagggatataaagaaaatatttttgtacagctgtacaacgtgtttgtgttttgagttagatttattacaagagagtctgaaagttaaagaatttaaaagttcataaagttaccgtaagctaaggttagttggatattgaagaaaaatgttttctacacaacgagtataatctaattgtatagtgtttataaagtctatagtagtgcagggtaatgtcctcagccttcacattcacccaccacccactcactgactcacccagagcaacttctagtcatgtaagctccgttcatagtaagtgcactatacaagtgtaccatttcttataatctttaatgccatatttttactgtactatttttatgtttatatatctttagatacacaaataccattgtgttacaatgaactatagtaacatgctgtacaagtttgttacctgggagcaataggctgtaccatatagtctaggtgcgtagtggtgtgtaccatttaggtttggttaagtatgctatatgatgttcacataatgaaattcacctaacaccacatttctcagaatattttcccactgttaagtgacacatgaccgcagtcatgcccaccaaaattcaggacataaaattgttattgccagttagaaaatattatattggaaaagtctgaatgctgtctaaaactaagaattacaaaataaatagcattcaggatctacctcctttaggtgtgagattttgttttaaacttttttgtttatattcatcagatttgcaggataacataaatactcaattatcctgagtcgtttatattcacaaaagagttggtgaatctttttcataaggatgaaaataggaatagacaaaaaagacattatactaaaacaaaaatctctgaaaccgtatcagaaagaaagaaaagaaagaaagaaagaaaaagaagaaatacatgtctgctttgaaagcacacttgttttgacttttggaaggtagaagctttgttaagaactgagttgtcttattgctacaccccatgattagagattaattgtggcatatttcttcttgaccccttgctaaagattcttcagtctgcaagttggagcattacgtctttcctccaacccttacatattcttatttttaaggtatagtttttaaaatatagttattttctgttttctttactcttggttcaaaaagcataatttagaaattgatcgtgctgataagaatacaatggcaaaagataaaaaagcttttattatagcattataataatgtgtgttatgtacgaaaaagagcaagactaggtttttttgttctttctgattttgccaggttaccttacaaatggtagtaattatcctcttttcttaactttaggcttttatgatcttgcaaagatatgacaaaaatgggaaagtaactgctaattgctattttttttttgcaatgttggaaagtacactgtgacaatgtttaaaaaaataaaacagagagtggaaaaaaatcaccatcatcaagcagcctttattaaccacttatttataaggtgatgccacggcagacaggcaggctgggagggaggatgtaagatgcattagtcacctgtgctatgtcctgtgtacttattctatcccaatgaatgtccacagcaattctaagaaatttgaataatgataccaattgagagatgaggaaagtcagctcagaggtatagcaaaatttcttatgtgatacacctaccagtggtaagtggtagaattggatttgacccagatgggtctgatttctgaacacatgctctttccttcatatttcctgtcatgatggaatgcttacttttttgaaagatgcaattcccagataacttttcagaatatagagaaaagataatcccatgaagcttttattttgagacagggtctcgctctgccatccaagctggagtgcagtggtgcgatcttggctcactgcagcctccacctcgacaggttcaggtgatcctcctacctcaccctcctgccatggagcttccttaaataataacagagtgatgaaataatctgtacaaaaaaaacccatgacacaaattacctattaacaaacctgcacacgtaccccaaacttaaaataaaagttaaaaaattaaaaattgatatagaatctgtctatacaatttaatctgtctatacaagttaaatagattttaatcttcataaaaatatgcctttcaaatgtaagattgcatgtttttctttgtatcagttagtagtacattcattacaaggaaaccaaaaatgtacccaacccacagcagtcttttttttttttttttttttttttttttttttttttgagacagagtttcgctgtgtcgcccaggctggagtgcagtggcacgatctcagctcactgcaaactccgcctcccaggttcactctattctcctgcctcagcctcccgagtagctgggactacaggcacccgccaccgcgcccggctaattttttgtatttttagtagagacggggtttcaccgtgttagccaggatggtctcgatctcctgacctcgtgatccgcctgcctcggcctcccaaagtgctgggattacaggcgtgagcaacagcgcccagccaccacagcagtcttaaacaagataaaaatctgctttgctctaagaaatgtagagataatcatgctagggttgttttaaagcaaaaaaataaaaagttatctgagacacaggtgccttccatctcttcttataggttctagagtctggaagaagggattagggtgggattggttctggctgctacagcattaacttcattaggagaaactctgggtggattgggtaagtcaccatcaggctattggccagtcatgaaataacagatatcatagaaaatcagagtgcccatggaagtctgttttcggaactttacgatgataaatgtgacagatctgggagcaagtttaattgccaggacaatctggagagctggaggcatattcttttgggagagccaagagaggtgcttgacagatggtactttgcctcaagcctgaaagaatcgaaaggttcctgtctcattttttcacatctgttcttggctccctaagtattactcttctatgtattcccctcacctagatgccaagtgttttctctaagaaaacattgcatcttttccagctgtactgtaacttcactctgtgacttgaatttaacacaattttattgcatatgaaaatgaagaggtctggagatttctctcttatgcatgaattgccaaaatgacatttctaaacctagaataatagttttctttagagaatgagattcgctaggacccacattctcttcaattaaatcttaatacgtataagtcatgatctcattgaaataagtcattgattcattttttccatattaaaagataacaaaaacggattatgatagactagaatgcaaattctaagttgtttcagtgccaaacaatgattggtacttaattttattaggaatgttatactaatgcccagttgattctgacaagcatgtctggatttatttgtaaataggttagttaatggagacatttaaaagattcctgaaggtacccaagaaataaaaacgctaagaaatgaaatcattgcaaacatatgtctcgtagttgacaaactcttcttttaaaatggcaaagtgcaatgtcctcctaaggaagctatgcttatctcttcctagactgatctacaacttaatgctaatatctttaatttctttaacaaacagtttaggtaagttacatttgagagtcaaaagtgagggcagaggagggacttggtgatcaattttccccacagcaaactgagaaaagaaaatgaacatgagatagttgacattcagaatgttctaaaaaattcagaatatatgattgccataaagtctggggaagagaggcttacgcagcatcctcaagtacagatactgtactaacacaggtaatgagtgaatggtgttcagatcatgggcacttggtacttaaagaagcgcagtgagacggaaataaggaaaagcaggcaagagcccagctccacgtgcttcatttacaatcttgcttagagtcagccctgtttaaaatggaggtgtggagagacagagagagacccaaaccgatctgtaagggacattaaaggttaatagaactgcgggtcaatgttcagagatttttcaacaagtctgagaagtgttaagaaaagaaaaaaagactaatggctaaaaccaaatatcatttctctagatttagcccactcttcagaggtcttgctttgtttcaaatttttgaatccgttaattttaaacatttggatcataccttgaattttttccgtcaaattgtatcaccacatctagtcagacacgcggcttgctcttttctttctttagtcttacgcacgtgaggaatttccactgctacaaaccctccatcccttcaggctttctttctttcctcccttcctcccctcccctcccctcccctcctccctccctccctccctccctcccttcctccctcccttccttccttccttcctcttgctttaatgtgtgtatttattattcaagagttataagtagatattaattatatcagatttatttagctatgtcataaatttcatttattgaaaaaaactgtgtgaaatcaggactctgtaggtatacctggaatgcatagtcattttaaaaccaaactctctattttgttaggactacgctaccacaaaagcttctcacctgctcctcctaccttccttctcttcattcaaccattcactgctgcctaatgaaacgctcttaaaacagaagttttgtttgtttctgttttttgttttgttttgtttgtttttgagacagggtctcactctgttttttgtgctggtgtacagtgccatgattttggctcacttgcagcttcgacctcccaggctcaggtgatcttcccacctcacctgcccaagtagctgggatttcaggcacgtgccaccacgcctggctagttttttgtggagacggggtttctccacgttgcccaggctagcctcaaactcctgggctcaagcaatcctcctccttggcctaccaaactgttgggattacgggtgtgggccaccacgctagggcacaacagaagtttttgagcttttagagacagtagtgttttctcaagggaaatcttattagggacatggaaacagagatttcaatttgaacagctgtgcactggcacagcagaaaagactgaagccacacctatttgaaatcgctaaagttaccacccatttttcagcagtttggggccatttcccaagtctgcattttaattactatcacccaacaacagttccttccttgaataattcttaggttaaaccttttttcacatgtaccctataaatatgtacaaatataatgtatcaatttttaaaagttactgaaaactccttaacatctcactattgccttcatgatcctcagtctcctttgattatattaaaagattatattgaaaatgagtaggaaatcaagtagaaatatataaagagcattgcaaaaagctaatttagtttttaacttgtctaattgaaaaccgaacctttctcttactgctcttttagtagtaataataatgtgtatggttcatgagaaaggctataaaatataactaagttttacattatccttacatcagaactctgtgtaacactgatgcaggagttttctcagccaatttgccaactggggacctccacggccagtgacacacacacccccacctgctaccagggccacagttggccttggaactgtcattggaggtgccctgcccacttggcctgcgtgtgctacagcttgtacccatgttcggcgattcccaagctcttgtcccccatccaagaagaatgaggatatgctgacaattcgaagggtgaagatgggtggagaggaattttattgagcaagggaatagctctcagcagagaaggcacgtgggggtggtctccaacccctgaagtcgggtggtttctttctcagtgtggctgagttcaggacttctatgggctcagaataggggagtgtgctgactggtttgagtatgcaaaaaaggttaaaacaaaagcaccacttaaaggtgggcatgacagtataaaaaacaaattagggaaaggtaggtatatgtaaaatcagtgatgggtagggatcaatcagaagaaagcgcatcaaatgggaagacaggttctcaatccagtccatagatttgacttgtagcttggctttcaggctttaaactgcctttggtttggaggggggatttcactggggacctgcccctacctgcctaggcatttgtctgcctcctgccactatcaacacctcacaagtttcaataatcatttgttgtttttttaactcaacaaatatttattgaacagctactatattttatatatctcagacactgttttaatcactaggaaaaaatatggcagtgaataatataaacctgtctatcctcatgaagcttatattccaaaggaagaaaaaggcaatatacaagataaattagaaaaatgtatactatgctaagtattggtaagttgtaaaataaaaaacaatcacagaatggaaacacaaagtgtaaagactgtgggtttggataaaatggtctaaacatgttttcccgcgacataacttttgagtaaaggctgataaatgtttgttgagtgaaacaggtatgaacaaaaaacagtaagacatttaagtgtagaattcaatttaacattttatttatggagtacctgctatatgtaaggttctgtagtacccaatgggaaaatactaagataaaggtgtatctgcacttaaaatatcgtatatatttgttaatacataattgattaggtaaaaataagttcatatttttagagttctctttaaattatctttaaattcccaaagtaacactggaattttaagtagtttattcaccttactagacctcagtatccactttaaaatgaagattttcaatgagcaataagattctatatctatcatgggaatgtagtactgataaatggcgaagcagataattttttctcactttgtaatggtgactttactgtctaaaatctaagccaattatgtaattataccaatggaaaaatatgctatatgtatttgtagatatttatctataaatatgctttttatttctctcaatcttttaaaaaattatattctttctagagtgcatattatatgaaaaaggcataaagatttttgcaaagcccccccaaaaaaaacaaaacaacaagcaaacaaaaaacccaaagatgagaaattataaggctgttatatgaaaataaagtttccatgtacaactaaatcattctagctacaagaacacttcagtggcattcagagcatagaatttcatcacagaatggaatcttgtattgccccttttatcccacacccgtgtgagctttggagggttgggttctgctcacttctctggtataataacataacaatgctcatgggaagtgtatcatcatgtttttcttctttttaacaaaaaaaaaacaacatgatcccaaagtaagggaaaatcagaaagtaagttttattgcctttaatatattgtatttttttttcttatggggacttttgcaactcagattagggcgttttggaattattatctgagctgcagtgtcaagagactgactccccaaagattaactccccaaagggtacaatggtgactcacatgaaggatgcacacgaaaggctttgtcacttcggtaattggagagcgtttttagagaggatgccaggcacccatcagagcattcctactctcttacaaacccagtgctgttagtgaatcttctatggattcagaagctgagatgaaactaatgtctcatatctgtggatacaaaagaagtaaagaaaatattgatttttgattttgaattagaaattgtggggtcatcctctgcctactttgtgaaacaaaatttctcacaatttccagaaaaaggtaattcatcttctattatgtgtctgcttgtgagaatttctatataagcctgcagaaagtgatacctccctgaaactctgtatccttgatctaaagatatgaggatgcaaaaatggttgtgactgttggaaaaataagagaagcctattgtcttgttttattttctggattccaagatggtaaaactgctctgattttctataattaagaaacgcaatgtctctagaaagatggtgattggaacgtgagtaaaaacaaacaaacaaacaaaacttattttgcgagttttcatccttgtgcacacaatggtgcactgccaaatggaaatgtttgctaagaccaaatacatataaaaggttgagagaagaggggggcaggaggagagagagggggagagagagagagagagacagagagagagagaaagcatgagtaactaatacgatttccacaatgtaaaaatagaatttgacaagccaacattcacttggcaaatactgtgcccttcctcatgttcatcttgctcataaaaatgtctttgggaaactattttattgaggttaggcatcacaaatcaatccacgttttaaacatttggagtttcatcttagttccttggttcttccttggagttgttattctaaacatcaatttgtaaatcttttcatatcttcttaagcaggtgtcaaaccaactcctttggcagaattctaaaagcaacttgtacgcaactctaagacagatgaatgtatacaaaattcaggcttcatctctgcacagagataagtgtgaactaaggttcatgcttctttcatcttgctttggtttctcagttgctttatctgtttttaaataaactgtgttgtgtatattgaagctatacaacatgatgttatatgatatgcatatacagtaaagtgtatattataggggagcaaattaaaatatccatcatcttaaacattttttccttttgtggcaaaagcagctaaaatctactcatttaacaaaaatcctgaatgcaataaaatattattaaatattttctgaatttttatttgaagtagtctacaaatatttactaggtctttatttcttctgagtaaacaacaccaaacaagatgagatttgtgatgtaatgaatacttgagtaatctaagcgcaatttaaggataagtctataatccaggcagacatatctaaataataacccttggaaataaagtagtaaaaggaagcacacgctttctaacttactttccttgacatgaactcagtttgagatcagtattgaacatgacattttctttttatttatatacctccgtttatccacaagtattaagtcaaaattgattttagcaacagaataaagctctgtaggttctgttcaatgatgtcaaatctatccctgacaagtgtcccatttttgctcttcctgaatagcatggcttcaaaaaaatctagaaaatgaaaaattctatagcgcagaaggttaatagtggtgaatctctaaaataagtagattgttttggagtcatgtttgtgtcttgaatcactttaaaaattttgaaaacaaaatttgatagattttgaaaaaggttatgtttgcatttctgttgttaaggtgatgtttcctggagtgatctaaaaagaacctatgaggaggtgaaataagagaactagaaaacagaagacagcatgtttctaatcccagaaattaggtttctgggacaggtaaggaaaataaagagcccaggtgtacaaaatcaataaagagcaagaattattaaaggtagttaagagagcctcactttctcatctagcatctcaagccacccactgtctctgggtgtgttcttggtaaaaacagacacttaaaagtttattactaagaaaaaggaaagagaataagataaaaatacagtcttttgaaaaaaatctgcccaattttattgacaaaattcaccatgcatttcaatatagaatgaggaaacattaaattaggtattatttgcaaaagaaaaatgctttgtatgagggagaaaataaccatacatattgagtacagtgtaccctgcttgagtgataggtgcactcatatctcagatgtcaccactatacagttcatccatgtaaccaaaaaccatttgtatccccaaatctattgaagtaaataaaaaatttaaaaaataaaaatgcaggccggaaacagtggctcacgcctgtaatgccagtacttttgggaggccgaggcgggcggatcacaaggtcaggagatcgagaccatcctggctaacacggtgaaacgctgtctgtactaaaaatacaaaaaattagctgggcatggtggcgggcacctgtagtcccagctactcaggaggctgaggcaggagaatggcatgaatccgggaggcggagtttgtagtgagcagagatcgcaccactgcactccagcctgggccacagagcgagactctatgtctcaaaaaaaataaataaataaaaataaataaataaataaaaataaaaatgctttgtatgtagtaaaatactaaaagttatgaaaatattgaataataatattttaagaagtgaaaaataaaagtttccctgaaagcataaagaatattatctttaaaattctgttacaaaatgtttacttataatttttttcaatgaaatgaagtagcattgataccctgcttacagaacagcatgagacttgaatctgaaaggcaaataaccaacagttaggagggtatagtactgtgtgatatatgtatgactgctatagattcatttatactgactgaaacacatgttctaattaacctgagtgggggtcttaaaggattcctggtcaactgttatactgcaatgcatttttctcactttatatttaagtataccccctttaaaagatggaatgctttaaaatacatttactacataggcaatttgattaatatttgtttttattttcccttcacaaataattcgatgagctagcttatgaaggcaatgcatctgcacatttaggaatatgttccaaatctagtctatgtttccatgggcatttaccaactgcatataacactcacagcaaaagctaaacaagattagtgattcccaactaccagaggataaaatcaatttatcatccattctagcagaagccatggagttttataagtgattaaattgaaggaggcgctttgggcaatgtagaaatagagcatttcttgataaaatgatgagtgaggttgtcaaatctgtgataagcctgtgatgccggctaggcaggtcagctcctctgggaccctagttacaatggcattttcttatgtttgacatgtatctggatccaagggagagaacagatttcccaaaacaaccctttattgttttctcatttccatgtcgagtaagtaaagcatacattacatatttgtgtgttttcttcgaattaaggtttgttctagctgaccacagaatagagacaataaaaattcatgatgtgggggagagttaactggattatgtcaggggaattgtttgtgtctagcccttgcctctgataattagttaccctctgaccttaggtgaatcactttcatctcctcgttttcagtttcctcccctgcaaaataatgaaggcaagcagaatcaaatggaaagttcttgccacctctaacaggtcatttttttttttttttttttttgccttcgtaaagcactacagtataagcattaaatttacttttgtatagtgagtattttcaggacgagaatagcatagggataaatgtatgcttggttttttgaggttgaatagtaaccttaaattttgttgttgttgttatttctatttgcattctaagaatatgcttgtgcagaagtgtagacgatggtgaagaaatgagaaagggtaaggcatgagaataaagacataggagactaaacaaggtaggcttatgggtacaagtggtaaggccaaatcaccttcttcaaaggtaggcctcaaaattcaccttgccagaatttcaaaagaaggtcaaaaaaagaggaaaatgagcagcaaagatctactcagccaaattgtgagtactggattaggacggattgtggagtgaggctccttcctacttcttatatttgctgggtctaaatagaagccccagatgtgccttgattgaggatggcaaaaaagtgtgaatgctctgttgaatgggacctcaccacagctcttccctgccctgatatgtgtctccaagtgtatttgtaacccatgcgacgtgaagaaaacatacagccttcttgggtgatgatcaagtctcctaagcctaaatggtctctagatgtggctctgagttcaggcggtgatgactttctcaaaagcccacaatacgcgtggacatgtgctgatgtccatgtggaaacatgctaaaggaaaggaaagttagaaacataagaagccctccatttacttcgtcaattccttgagtttataaaattgatcttttcagatacattcaccgatttagcaaatgatgataaatacattgaatttaatcctgtctggtttatggctattaaaaacaatgaattttaatggagaacaattgaaactaaaataaaaattacaatgaactagaataaaatagcacaaattaattctgccagtcagaagtgaaacattgtaagatatcccttgtgatcttctagaagggttttgctttccgaggctctggcaaactggttggaagctattgccttcctgattttcacttacttcatcccctaaaagccttcttttttttcccatatcaagatcaaagacgaaatccatgtctaccaggctgtttgtagattttatcacttatttcatggggattgaagaactattagatgatatttgagaataacagccaaatgagcatattagccattcaggtataacaaaaatggaagtcagcagtctatctttaattttgtcacatcctgtagacttaaatcatccaactgcagagcatctgttaatgtgttctcagttcttgagttatagttaacctaatgccactggccctactaagggggaaattcagaaacttcccattggaattgtggagtgggcattaacctcgagggaataccaaggtccacagtacatgtaatctcctttccacttcttaatgaccctgttttattgtgttcattttacaattgtgaaaactgaggctcagagtgaacaacgtgtcagtctctgctcttcttgtacatgcacctacttaccacttctacttattgaatctggtctcaggacttagtactttatctcctctgtttctaaatttgggttaaagttgtgtctattgattaaaaatcttaaacactgaaaaagtatgaatgcacttaaatttcccatttctgaaaaacatttactagttttctgattaaaacattgtttatctatctatatctgtggtttgtataatcatttttatcaagaattgaaggtaatgtattttcaaattagaaatgtatactttaccgtttactatttattaataaataagtcatattttaatatgcttcttccttccagtaaacaacacttctctttttttggagagttcaatgattttagccaacttcaggcttcttagttcctgagtctacagtgtacttcacccaaacttgtcttcataagtaaatccctcataatccatattcattctatactttctcttctccaacaaaattcttacctttctagtgttcttctatccgtcagaattaaaagaagaggtcttgtcaaattgattcttattgaatattttttgatgtgatttctcaagttctccctaaatgatttttttatttattctaacatgtatctatgattacttacttttaagtaatcatacatatgatttccatatataaacatatatatacattatatgtatgtaatttaatatataatatatttaagtaatcatatatatggtttatatataaacacatatatacaattatatatgtttattcaaacatatataaacatatattctaacatatacataaacatagaataaacatatatataattgattacttacttactaaagtactgtactggagttgaaataaagaaaaagatacatggaactcacagttagtaagagaagttaaaggtacaaagtaataaatggcatgtagtctgtgtagataaagcattaattgaattcagaagcaggaaatacatctggagatgatcttggagagcctatcaatgcaactggcattcacactgcttctaaaagaagaaggatttggaaatttaaagatgggaaaggatatctgaggaggaattatagcatgagtctgcctagaccacatcctcatttcccttcaggaactgtaatgaagaatttgggagcctccttggccatcttcaattacttcacagagagaaacatcaaaatttcctccaccataagcctgccctaatttatttttgttttgttctacagagcactccatttttagcagaaataactatagattgcaatgcttgaaaccaggttgtattttgtgaaaaatacttgttttaagataaaacaatttaattcacattacttaaaattctataagcttttccccccaaactcagagaattggatcaaattggactttagaaattttcattttcaattccgtttacaatcagtaataaaattaagcattttagattgactttttctttgatttgtttatatacactgtgaacgaaataataaaacaaagttgtataggaagaaagttgcaaaaaaaaaaaaaatcctgtcggttcagagttcatttagataaaggccctttgagtcatgttccttactttctggagaggagaactaatttttactccagtagatggttcatatatcaatttaaagagggaaaagtaacacagaaacacatttccaaaagcatgggtgctgaaaagacttagactaattttctctcaagagcactaatgtgttaatctagccaaacacagtcatagtgtaagatcaagaagtatgatctatggtgtcacatttttaaaagtacacatagcattgaagagaaatcttacctgtttcaaagcaagtcctctacattcagccttccatataatttcctgttggctgtgacttcttcatactgcatcttaaatagattatctgtactctgccaatgatctgtctattgacatgaattatgttccattctgacttgtatatatacaagctgcaatttgaaatcacttttagtctaatttatttagctgaatatatatatttatttagacagagttttgctctcttgcccaggctggagtgcagtggcgccatcttggctcactgcaatctccacatcctgggttcaagcgattctcctgcttcagcctcctgagtagctgggataacaggcatgccaccacacctggctgatttttgtatttttagtacagaccgggtttcactaatctataaaccaaatctataattccactaatctataaaccaaatccccaagccagcaccacactgtctttattattgtaatttggtagtaagttttaaattggaaactgtgagtttcacaacttttttgccccaacattttgactattttgtgtcatttgcattctatatgaattttaggattagcttcttttttttatccctccccttcctccccccacaccccgaaggccctagtgtgtgatcttcccctccctgtgcccatatattatcattgttcaactcctacttatgagtgagaacatgcggtgtttggttacctgttcctgtgttagtttgctgagaatgatcgtttccaggattagctttctaattctgcaagaatagccactggtgttgtattgaagctgtatatcaatttgaggagtattgctgttttaacactgtaactcttacaatccataaacactgaatattctttcatttctttgggtctttaaaaatttcttttagcaacattttgcagtttttagagtacaagtcttacacttttgtgtgtatgtgtgtgtaatttattcctaaatattttcttttttatatcattgtaagtaaaaatttttattaattttattttcagattgtttattgctagtgtttttttatattgaagttgtatcttgccatcttgctgaactcatttattaatttgatctttttgtgtgaattccttagaattcctaaatatcagattatgtcatctgagaataggtgttaccaaaacagattatgtcatctgagaataggtgttaccaaaacagattatgtcatctgagaataggtgttaccaacacaggggttcgggctaggtcctgcatcttgcagcacagaaagccaattactgagatgatgattattgccaaggaagaaggctttaatcaggtgctacagtcgaggagatgggagttcagtctcaaaccatctgcctgatagactaaaaattaggagtttgtatagcagggaagaaatgtaactatatatgagaaaacagaaacttagttggggggaggtaaagaagtaatcctgataaatgaggggcctggagtctcattgtctggttgctataatccggtgagtttcagttcttttctactttttgggaggcctgaagatatttttctgaggcaggaactcagataaaacaaatgtaagtttcaagctttaagaccaacagggtcaatttctatgtttatccaaagacgtgtctgtgagagtgttgggttggtttcaaagggatggctttgtttcttccttctaatttcggtacctttgatttaattttctagactattttatctggccagaaccaccaatacagtgtagaatagaagtgggctaaacagatatttatgtgttgttcctaatcttcaaagaatgcatttcatttttcaccattaattattgtgttaactatgagttgttcattgttggcctttgttagggtgaggcaatttgcctctattcttagtttgttgactatacttatcatgaaagggtgccagattttgccaaaatttttttcaatctattgagatggtcttgaggaatttttttcttaattctattgatataatatactatattcattgattttcatattctaaactaatcttgcatacttgataaatcttatttggtcctggtgtataaatttttgtatatatttttggatgatgcagtctgctagtatttttgttgaggatttttacatacatattaataagaaatattgatttatagttttttctgtgatgccttcacatacttttggtatgaaggtatataggactcagacatgaactgggaagtgttcccttctattctatattttggaagtgtttgcgaaggattactgttaattctttaaacatttggtagaattcaccagtgaatctactttggcttgaagtttctgttgtggaaattttttttttattactaatccaatctctttatgtgttttacatatatgctaattttacctttcttcttgaggcagttttgttatttgtgtcttcctaggaatttgcccattttccccagtttatctcacttgtaggcatagaattgtttatattattcctttgtaagcttttttatttgtaattaaaatcctggtagtaatatctagtaatattgctgttaatttctccttttcaaccgtaagtaattagagtattctttctttttctctttgtcaaagtagtgtgttggatagtggccttgaaaaatatatgcccacccagaacctgtgactgtgaagcatttgataaaagagtgtttgcagatataattaaaggattatgaatgagattatcctgtgttatcaaggtacatcctaaatctaatgacaagtgtcattataagagaaaggcagagggtgatttgaaacagacaaaagagaagacttagacaagggtagaagggaaggccatgttaacctgaagcagagattagagttattcatcaacaagccatggaatgcctggggctaccagaagctgaaacaaacaaggaggtatttgtttgtgtacccattaaccaacctctctttattcctctctttgccctatccttccgagcctctgatgaccaccaatctactcctaactacatgaagtgaatatttttagcattatatatgagtgagaacatgtgctatttgtctttatgtgcctggcctattttatttaccataatgtctatttccatccaagtggctgcaaataacaggatttcgttatttttatggctaaataatattccattgtgtgtgtatatatatgaatatatatatatatatatatatatatatatatatatgtcatattttctttatccattcatctgttggtgtacatttaggttgattctatattttggctattgtgaatagtgccgcaatgaacacaggagttcaggtatctctttgatatactgatttcctttattttggttttagaaccattagtgagatttctggatcatactgttgttccattattagttttttgagaaatgtgcatactgttttccatactgtctctattaatttacctccccatcagcagtgttcaagtgttgcccttctcttcatcctcaccaacatttattattttctgtctttttgataatagtcattttaagtggagtgagatgatatttcattgtgatttttgttgttgttgttttgaaacagagcccctctctttcatccaggctggagtgcaatggcgcaatctaggcttactgcaacctctccctcccaggttcaagcaattctcatgtctcagcctcccaaatagctgaggcatgctgcaagcgtgcaccaacatgctggctaatttttgtattttttgtagaaatgaggttttgtcatgttggccaggctggtcttgaagtcctgacctcaagtgatctgcctgcctcagcctaccaaagtgctgggattacaggcaagagccgcctcaaactgccatcattgtgattttgatttgcaattctttgatgataagtgaggttgagtattattttcatatacttgttagctatttgtatgtcttcttttgagaaatttctagtcagatcttttgctcattttaaaatcggagtttttttattgagttgagttccttatttattctggttatttatcttttgtcagatggatatttgcaaatgttttctcccattctgtaagtcgtaatttaattttattgattatttcctttgcagtaaagaagcttttttatttgatccaataacatgtaatttttttgtttgtttctttttgcttttgttatctgtgcttttgaggtcttactaaaaaaatctttgccaagatcaaacttgtccaacccgcagcctatgggccacatgcagctcaggatggctttgaatatggcccagtacaaatttgtaaactttcttaaaacattatgaaatttattggcaatttttgtttagctcatcagctatcttaagtgttagtgtattcaatgtgtggcccaaggtaattcttccaatgtggcctagccaaaagattgtatacctctggattagatcaatgtcctgaaacatttattcagtgttttcttctagtagtttcagagttttaggtcttacatgtaaggtcttacacttaagtctttaatccattatatttgatttttgtatatggtgagagaatgggtctagtttctttcttctgcacatggttatccaattttcccatcaccacttattgaagagactgtactttacctaatgtgtgttcttggtgcctttgtcaaaaatgagttggctataaatgcatggagttatttctgggttctctattctgttcccttggccagtgtgtttgtttttatgccagtactatgttgttttgattactgtcaggttccaacctgagctggggtctgaggggacaggtggcaggtggctaaaagaacactcaagggaccataggcagttgggaaatggtgttattctcttcccctcctatagagtcagctgtgcagttatatttctcacagacaacagtggctcaaagccagatacgagctcacacaaacaggttacattaaatggctacaaatgtgattacatagtgcgcggaattgtgcgcctgcactacaaacccactgtgtcatgctgtaccagatgtctgcctcagccttctcctgaccaaagcacagccactttccttacgctccaccctctaggctaagggagttctcctagcagggagacatgcccacagggcagaaacctggacacagaggccacagcagcaatacagggagcaacaactcactactagtattcctgctatgctgcccatgattattagggtccagcataggccagagcccagagacacccaccatgtctatggggggtcatcagtaaggctgtcagctgccttgatttcctgggaaactccttgcaaagctgctatgttttgttgattgtcagggatgaaggtacaacattgcattcccaaaacagcacagatgccaccttgggcagcaatcaatatgtaggcctatcaggttctgcactaccactttcctggtttgatcaacatcatctgtcaacagaaggaggacaacttgggtgtaattcaagtctcaagtgttatgctctggaagggccataacttgcatttctacagttacgacacctgctccagggatggttaatgctaagaggtagagccaccagggggctcatcacacttgcaaaaaccaggaacgtagcaccttccagttatgtgggcatctaaggaatgtggaaataactgtggcaagcacataaggccacccccaggtagagcggccaatcctgtttgctggcaaatatgaccatactgtgtctccacagtcccataaactcccagggggcacaaagtcctctggggcccagccttgatgtggtcacctattccatcacacctttggtgtggtgataacatattatatgtgttcagactatggcagacaaccaccccacggtgacattaccccagtgttgctctacacatcatgatacctgtgttaggggcaccttgtgttctcccactaacgagccccatccatcacagacattacaggtcagccaggaagcaagcatgccatgggttttgtggcatcccctatccaaagctgcccatgttgcattctaaacgtcagccatggaactcctagtgtccatccatgtccagttttccacagaagctggatgtatgtgccagggcaagacatcccctgctgctgcttgaagggtggtgcagatccaacggttggacacattggtcaactcatcgtaggtgtgggaccattccacaatgctgttggagcatgtcaacctatggtctaaatgacaaagtaggcacaggtactaacaggggtaaatcatgcccttcaggcaaaatacaggccaagctttcatctctagataacaatgcaactgcaaaggacttctgccctgggtgatggtaccacaacttttcagcaccccatggttcctttgggtctatatcttgccagagttactggggagctcataataggccacacaggaaatacagatgttccctggagacttccttccctggccattcccctatgaatggtcaatcatagaggccatatattaagtacccaatgagtgacatgtaaatcatactataggctctccctgcaagggactatgatagccaaccatacgtcatggtggacttggagggtctgtggccaaagccaggttttttgttcccctgcctttacagacattggggcaggcaacaacagattaccattgtccccatacctggttggaggaagtcatctttggtgtgcatctgtaagtggatggggtcagtggcacagtgtagcagtgcctctactggggcctggctgccttttcatggccgctcattcaagctttggagcaccaggtccaaccttgaactctagccccacaaagaggtggagtaacatgcaaatgtaacttatttttcaggagtcccttatatcactcaataataccagtagtttgtgggttatatggaacctccactttatgtccatccattgtgcccactgttgtacgtgctatccaggaaaatgtgttcccctatcacattcaacagtcaggggatgactgtatagggcacacaagtgttgcagggcctgaattgtatgttgttggttggccatcctgcaagggtaggcaaacagcagactggtggccgtgtctacagctgtcagcacatgcatatgcccctgcaacctcagcagtgacctgatgtagtctatttgccatctagtcaagagcatccaccctactgtcacttgttgtgtaacattgggcagctgtctctgtctggggtatgtctgtgtccacgctgggcatttctggcagacctcccagatatcttacatagacaaagatagaccatagcacttattgacctattccattagtttactcccgacgtggcccaatttctgctgcagccatagagctacatctcgtgtaggtgctgactccaaccaccggacctggccaaggcatttgcctcatcattgcccagggcagtgaaaggcacatgtcctgacacatgataaatagttacaacctttcgatggcccatttcccataggtctggccacatggcctggccccaaatgggcctgtgaccaactagctaattctgtaactttcaggtagttaaccacaaggttagggcttaataaactgcccagctaccagtgaagattaccataggtgtctcctccttagtgatcaccatccacagtgccctgagttcaacctattgactactttgtccaggtattaaaccatatggtatcagtactaggctggaccatgacagcagtccaggcagcagtagcaccctggctggacccatcctgtctaccatgcctcatcaggaatgggaggtgcctctcttgaaatggtaatggctcagtgtttaggggcgcctcaggctgacccatggccttatcttgcatcaggactacaggtcccaagacttcttataattctgctgataaggggcttgtactcagggtactctgctgttctaagtaggagccccactttgctaaggtggatatctctgccatcccagtctggggttcattacccatgaacatacttgctccccaactattgggtaagttgtccacacaatgactgtagcccttcctgtcacactctcacaagcctgaagggtggcatatacagttgttaattccttctctatccatgaatagcagagctcacctccattccaaagttgggaccaaaagcctacttgtgttctacagtgctctctgcactgccataggccccagccaaaaccttctgtggtcacatgcacatcaagttcaaatgggtgccccaggtcaattacttgtagcacctgcacttgctgtatggcccatttggctgccagaaaagccatctcagcctcattgtcccaatcccaagtaattcctgtttttgtcaactgatacaatggttttgttttctgagccaaatggagcacaaatgctttccaatatcccaagaggctcacaaaagtctctagttgcctcattattgtggtctggggatatgcctgaattttattaatgatggcctctggtatggcgttcgtcttacccaaccagataactcccaaaactttggcagacaatccaggcctttggaccttgttttcattcacagccaaactgcatgctgccaaatgttgctgtaggaggggtgccgctatttctaaatctgcaagagaatcagaggttaacataatatcatccatataatggaaaaggtggaccccctttatgacatatggtgggtttatgcacacagccctgcagcaacaccgtgaaagtctattgtcgccctttccatgtgaagacaaactgttcctggctctctggtgtgatgtcaattgggaagaatgtatgggccaagtccatcacacagtggtactgtcccaattccatcatcaagtgatccatcaaatccgtgatagacagcacagctgcatgtgaagggggtgttactttatttagttctcgaacatccaccatcatcttccaagttccgtcaggctttctgactggccataccagagaattgtagggtttgtgcattccatgcactatctgcacctcctctaacatcttactagtctcagttatcgccatatggccacctggaaagtggtattgatgggtggaagtaacctgtcggggttgtggcaggacctggggccagtgatacgtatgtccacccgataatggctcaaccacatgtatttggagtctgaattctctgaccgtggcttgtaaaaccaagctgtgaaaaatatctaccctggaatgtattcaagtatggaggagatatacacagtttataagcatgcagccaagtgcctgaggccaaggtgcaaagatgcaggcttcactcccactgactggcctctgtctatgtatgcaaccttgcctggaaacttatccgggttcccatagatgaggctacaatctgtgccaatgtctaccagcagcagcacctgctgtacattggtgggagaccagtggactgccaattccacatgtggcctcctgttgtctggtgtccccccaagctgggcaccttgaccagtttcctaatcaaacacaaaacgctctataccttcacccatctgcaagtagtccttgagctggagcatctgggtgggacatggtcaagcagcatcatcccgcccgctgttgggcattttctggaattggtgattcagggacaattgcctccacaaagttaacagcacttcattgggttgcctctcagttttctctcggtcaaccccagccaaaatcaaaccaatccacatatgtgtatgagtcaccactggggcccttttgtcccatgagatggccccctgcagaaggagtaccttccccctttttatggcatagactcctctgcttccccgagggctgccatggcagtagtcacctcatgtatgcagcaccctgcacacagattgacagtggccagggagccaaaggcactcaggggtgcagagcacaacacaaggtccctcatgtgggaggtaaggtgttcatcatctggccctcgggtattcggatcaaacatagcctgctgcatacccatctcctgaattacctgcaccacatctgtttatgactgccatttactcacagtttctggtatttctctggcatagtcccacaccatttgcatggcctccatcagccattcaattatggtgtggttgccttgcccctgtgctaaccacttgctcacctgcaattgctgatggagggagggatgagtcataatggaggccaacttttccatctcagaggaggagcagacaatactgttggctccctcatcccaaaggcgaagcatctaggtgggtaggatttcccccaagcgctgccagcactgtttactttattcccacaactccgttggggtataggcagtgtatgacttgtgctccatcatggtaggaggtctctgagcccacccctggggcctcaatgacttcctggtgtattttctgatgagccactgggggagcccacaacagaggttcttcctcctcggtgtcagatcgggcaggggtctctgactggggtggcaggcccaagcctacactaatagcagcctctaattctcactccaacctgtgtacgtcggccttcaggctctctgcttgtgcctggaggtcccttacctgtgctgcatcctgcagggactgagcatgcacttcccatagcacagtcaaaaatgcccatccaattctgctgggaaaggcacactccttctcagtgctctgtgcttccaggtgcttcagtgccttatccatgcacacaggggacctgtccaccaccacccatgtctccaccagggcccatcttagcagcatggctgtcactgggtaccataacccatattggggccacacggctgacctaggatcatcaggggccaagggctcactcacctcggaatcctgctgactacaccaattgtcaagttccagttcccagactaagctggggtctgaggggagctggtgaacaggtggcaggcagctgaaaaacactcaagggaccacaggcagttgggacatggctttattctctccccctcctacagagtcagcagtgcagttatatttctcatagacaacagtagttcaaggccagatatgaactcaaacaggttacattaaatggctacataaatgtgattatatagtgcatgggattgtgtgcctgcactccaaacctgctgtgtcgtgctgtactggatgtctgccttggcctactcatgactaaagcacagccatattcattacaattactagggctttgtagtatactttgaggtcaggtagtgtgatgtttccagctttgccaattgtgctcatggttgctttggctattcagtattgtttgtggtcccatgtacattttagggttgctttttctatttctgtgaagaatgtaattggtattttgatagggactgcattccatccttgatcattttagatattttcatcattttaacaatattaattcttgcaatccacagatatgggatatctttccattttagggggtttgttcttcaatttcttttgtcagtataattttatttgtagagatccttcacttttttgtttatatttattcccaggtattttttttttcttgtagctattgtaaatggggttgctttcttgatttctttttcagattgtttgctgttggtgtacataaatgctactgagttttgtatttaatttttgtataataaaactgtactaattttgtttatcagctgtactagttttggggtggtctttaggtttttcttttttctttgtttttgagagggagtctcgctctgtcacccagcctggagtgcagtggcctgatctcggctcactgcaagctccacctcccgggttcacaccattctcctgcctcagcctcctgagtagctgggaccacaggtgcccatcaccatgcccagctaatttttgtattttttttagtagagacagggtttcaccatgttagccaggaaggtcttgatctcctgacctcgtgatccaccctcctcagcctcccaaagtgctgggattacaggcatgtgccactgcacccagccaggtttttcttaatataagattgtgccatctgtgaacaggagtattttgatttcttcattcccagtttggatgatctttatttctttctcaaacctaattgctctggctagtacttacctagtagtatgttgaataaaagtagtgaaagcggttaaccttgttgttccagatctcaaaggaaagggtttcaatttttctccatttagtatgacaatagctatgggtttgtcacgtaaggctttattgttttgaagtatgttccttctataccaagattgttgagagcttttatcctgaaagggtgtattatatcaaatacttttttagcatctatggaaataaacatttttttaaaaattctgttaatatgatgtatcacatttacagatttaaatatgttgaaccatctttgcatcactgggatgaatctcatttgatcatgatgaatgatctttttaatatgttattgaattatgtttgctagtattttgttgagaattttgcattttattcattatgaatattgacctgcactttccttttttgtgttgtccttgcatggatttggtatcagcataattctggcctcataaaatgagtttggaagtatttcatcctcttaaatattttttgaagagtttgagtagaattgttattggttcttctttaaaaatttggtagagttcagcagttctcattaagtcctgggtttttatatgggaggctttttattactgcttcaactgccttattcaatattggtctgttcagatgttctatttcctcatatttcaatcttggtaagttgtatgtacctatgaattttttctttgaatttttttgttgaaggttttctgatttgttggaatatagttgttataatatgctataatcatcctttgtattttgtgatgtcattaaatacaaagctgtaatgtctcctttttcattttttattttatttatttaggtcttcttttttttcttccttagtctacctaaagctttgtcaattttgattatctgtttttaaaaatcaacttttcattttgttgatcttttgtatgtttttagtctcgatttcatttatttattctctgaactttatgatttcttgcctcatactaattttgggtttggtttattcttgcctttccagtttctctacatgtatcattaggcagcttatttgaagctttaccacttttttttatgtagatgttcattgctataaattttccctttagtactgcttttgctgtatcccataggttttggtatgttgtttttacattttctcttgtttcttttttttttcaaattgtcctaactttttcattggcccattggttatttaagagcatgttgcttaattttcatatattcgtagagtttccaaggtttttcttattattgatttatgattttttccattgtggtcggaaaagatatttaatacttgactgttttaaatttgttgagacattgagacatgttttgtggcctaatatattatctaccctacaaagtattccatgtactgatgggaagaatgtgtattatgcagccgttggataaaatcttctttaaaagtcatttaggtccatttgctctataattttgtttaactccaatatttgttcattaattttctgtctggatgatctgtccattactggtagggggttattgatgtcttgtactattattttattgtggtgtatatgtccatttagatctactaatatttgtttaaatatgaggcactgttgtgttgattacctatatatttacaattgttatatcctcttgctgaattgacccttttataattacatagtgatcttctttgtgtctttttacagttttttacttgaagtctatttttatctgatataagtatagctattcctgctttttgtttgtttgtctccatttacttggaaacttttgccatttattcacttttatcctatttgtgtctttataggtgaagtgagtttcttgttagaagtatatagttatataattggatcttttaaaaaatatattcatctaccctctatcttttaattggagaattttccatttacattcaatgttactttttataggtaaggacttactactgccatttggttatttgttttctgatgttttgtaactcctcttggcatttcttccttcttaccatcttccgtttgggtttagtaatttttctctggtagtatgttttgattccttgctttttattttgtgtgtctcttataccatgaagcttataaaaaatcttatagctatataaagctcttttaaacaaacaacaattaactttgataacaaagaaaagatacagaaacaaagaaaactataaaacgatctttgaacttcatccccccagcatattgacctttttgttgtctcagtttggatctttttatatctcttaacaagttctcatagttattatttttaaaaatttgtgttttagtcttcatactatagatatgagtggttttcacattgcaatgacagtgttagagtattctgaatttgtctgtgtacttacttttatctgtgagtctatacattaagatgttgtttaactgcatattagtgtctttttcttttaaactgaaaaattcattttattatttcttttaagaaagggtctggtcttggtgaatttcctcagcttccgttttctgggaaaagctcctcattccttcaggtttgaaggatacttttactgagtatagtatgttttgtttagcaagttttttacttcagtactttttatatatcctttttttaacttcagtactttttatatatcattccattccacctggcctggttttcactgagaatcactgagatttcactgagaaatctgttttcagattgatcagagctcctttttatattatttggttattttctctttccactttaggattctctctttgccttgatatttcactgtttgactattatatgacctgggatagtatcatttgggttgtatttacttagtgatacttgacctttctgtacctggatatatctatttttctctgggtttgcaaagttttctttatttctgtgaatactctttcttctccttgctttctctcaaccccctcttgaaggaaaatgactcttacatttgctctttaaaggctattctctagatctcataggcgttctttgtttctttccattatttttctcctgtgactctattttcaagtagcttgtcttttagttcactgattctttcctctggttgatcagtcctgctgctgagactctctgatgcatttttcatctaattcaatgtattctttagttccaggatttctgtttgatatttttaatgactttaatctatttgttgaatttctgtaataaatttctgaattgcttttctgtgttttctgggagctcatcaaagagttttgttttttttttcttccagtaactcaactcataccatctcattagggtcaatcactagtttctttctttgtacatttgaggtggccacggttgtgttgtttcttatatatgtacatctatattcttgcattgaataattggttatttattgtagtctttgccttctggcttggttagatcttcctggattatatctgcttagaggtgtactgtatagtttacttgttgaattctcttaactttagattgtggccttcttattagcattacatgtcacctcaatcctaggtttgccagggctcttgcaaaagcttggggtgctgcttttctttaatgggatgggtttcccaaatggaatatcccagctatgtgaaaaggctgtctatgggttcatgccaagaggatccatggagtatgcctctcattgtatggtgctgctgaactgcctttctgttttagtatttctgtagagacagcctctaaatttttcacactatggttgcaagcccctctttgattcttggttctagctgtactctactttctttttttcctcctacaggctttcaaaatgcttcccaacacatcttgcattaagacaagaattaacttactgcagaggaatccaagataatagagaagctggctgcctactctgatctcatttttccagtgagacacatatgtgtgaggggaacttttctgcatagtgcttggcatcatgcatacagaaatgtgtttatcttagtgtctgttcacaatttatcatttgtttgtggccctatggattttcacagcctaagttttgagttttgggatattactggtgatagtcttggtgccaaacagttgtttcagttttaattttgtgaaggagagtgatgccaaattgttgctgctccatcattttggtgatatcacccacttttgttgctcttcctattaataaggaatcttaagagcacgctagaatattgaggaacaaagacaatgttaactgctaggcaatatagatttattggatgcccaataactaaataccttgaccccaatgggaatttgtagttcttattgtcagaaaaccactggtcctatggaaaactaagtatgagctgattccctccaaatcatgaggtgtgaggtgggggcaatcgtagctggctcattgtccaagaaatccagagtgaaatcctatgatcacttttagacaattctgtttattgacatatcattaatcattatagattcctatctcaatatgtcagtaaaattgctgtactgggactatataaactattattcaaatgtaagtatataatatactaatgacagcttgaatcaccttctacgatagctgaagtagatcatcataatcttaacaccacattttttttctatgcattgatctatacatgacaactctcatttccactgcaatttcaacatgagagaaaaagtaatgagacagagtagctgtgttctggttagaggcgcagacaaagcagtttcaagagactctttactatcatgggtagcaattaaatgtgcaatggtcaatatggtcagtaatgggggaaaaaagcacatggtgccagattgagccaaccattgtgtacaaccattgtaagaaagagaaatttatctatgtttttctgattcatgcattggtacacacatttacagaccagaatataactctagaaattggcagctattttaatgcttccaatggtctgtttttgttaaatgaaaaaggtaatgcaagaatctattttagttatttaaaataaattttcctcatatggaagttgaatgttttacagcaggatggtctgggaatgggcattttgcggcagtattgaattttcatatgttatagttatgtagcaagtgagttcatcatgtcaggagggagtataagttcatctccttattagtctatgtctgtaatctatacgactattaaagctaatatttctcttgactctgcaactaacccctgaagagaaaaagtcatctggccaaatcccaaaacactcctgaatgcattagggtagattatgaacatgtagatgaaatacaaggtttatgaatctcccctctgttgcctgaaccccctttcccttgccacgcttctttgcttttctgacagtattttattggctataaatgaaattcaaacagtgccccaaaacgaaactccttcgcaaaatctttcttgcagtgaaaataactgtatgcacagtaatttaatcctcttcttcaaaaattgatacatattacagtagtcctcccttatccacggtttcattctcagagttttagttacccatggccaactgcagttcaaatatattaaatggaaaattccagtaaaaacaattcataagttttaaatcctatgctgctctaagcacggtgatgaactctggtgtcatcttgctctgtcccatacagaccataaatcatccctttgttcagtgtatccacactgtacaggccacctgcctgttttcacttggtaagcatcttggttatcagatcaaaggaacgtagtatatatagggttctctactatccatggtttcagatccactgggggtcttggtatgtatcccccacagataacagttgactactgcattaaaattaatccactattaggtaataaaaacttggtgaagaggatcatgagatttaattgtcaggagactcccctgaagaagtgacatttcagctgaaacttgaatgacacttaggtattgatgttggagaagagtaatctagcacaataaaatataaagtgggaaggtggaggtaagtttagcatcagaaaatgtctgatgtggcttgaatgtggaatggacagtgaatgggataagaaggttgacatagcacagatcatggagagactcagggacttgtttggatttaattctgaaagtaactggaagccatcgggagatataggcagttgagtgatataatttaatttgtattttaaaagatcactttggcaggtttgtaaagaaaggattgtctgatgggcattaatggaagcagagaccactccaggaactctggaattagttcaattgatagcacaaaacaacagagaggtggttagcagccatgcagatggagagaactggcctgagttaggatattttggagacatacaaaatgattttgatactatttagcagctgcataatagcccattatatgaatgcgccatgacttatttaaacattggaagaggcgctttcaaatttaagcaatcaagtgtattctgagatctactattaagattcctgcttcccaaattgtcttcatttacatttacccagtaactatctatttaaaacgcataaggtggtaccctggctgtactaaagaataataaatagttccattcacccttgctttttaaactatgacccatttcagttcagttttaatttttgagtaagaattagtataatatatgaaaagcattctgtatgcagttccaatatatattcaagttaccatagaattgaacgttatcatttcatgggatttttgtttttagttttgagtagaacaggcttgaaaaaaatataagaatacctgtaggaatcagatgatatttgataattgaacagctctttggttttaattcaaaattaaactccgaagaataagaataacttaaataaaccaataaagtttggctatgcaattcagagctcaacttaaaaagttacgcatccagtaaatttttcagtaggctgttcatttttatgctaattattaagtttcattctattcattaaaatgttaaactttatcctgagtcacctaaatcttccatgagctctgcatgtagaaaataatttggcagatgcttatttggaggaaattgcttacttcttaatacaacttttttttgagagaggaaaatattagcaaaaaatttttatgtccctaaaaattcaaacattttgatcatgagtaggagcataaacagagtgtatcatatacagttggaataaaaccttagatgcatgcaactcaaatggaatgaatgattccaactcatatgcttgttaggattcaatcaactctcagtcattcactgagttgagttacaagtagaagagagtgggtaatgttaaagacacactgcacaattcttgtttataatatggctttaaaatctagttgggaagacaagaccacatgttggtgcttttgtgatttttgcatgctgttccttctgcatggaatgactttctttaacttcgtggccacacagttgctaattatctttcaatctgtcagtatcacatctgtgaaggttttctttctacattaaacagtttataataatcgttgttatgcttttttggattcacatgtctgcatctctaaacgagcgtgtgttccttcaggaaaatgactatgtcatgtccggagtgcttggtgtaatgtcttatacagtgttggaccatcattaatattgagtattgataatataaggcagtttgctgtgaattctaaatgtctagatctatcgagaagtgtttagggaaatttgtatctctcaagagaacaagatcaccagggcctctaatcctggtattagaattacaatcagggcaaatcctgaaccatttgaggcttgagaagagggaacagatgagggaggaaggatgggttggggaagtcttcaagagtttttcaactctactaatctttggttctacatttcaaagtttgaattttaaaatagctctattacctatataaccattactttgtggtctaaaagtaaaaccataaaatcagcttagcacaacagaatgtactggactgaggcattcacattcagtcaatttttcacagtataactcagaaagaggttaaaaagttctctttgctttttgagaacccattttgtagttcattgttgcagattgtctgatgttgactttcagaagtgaactgaaatgtatgagaaatctggaaatatggtaaagacaaggaatcaaagccaagaagcaaacagacacgcaggggaggatatttaccgcatcgtctcactgagcatacctggaaaactgagaagctggcttttgaatagtgcatatataatcagttctttggtctgtaaattcagtaatcatgaaaccccatgaattagtatcaacatagcagtacatgtcttcattaatattttgtatcattacctctgtagcctctctgaggaattcagggaattttatgggggaaaaaaaaccttaaaacttgaagcaactaaaatttatataaaaatcatacagaatgaatgaataaagtatattaaatatacaagctcttttcttagagacttagaatataaaatgaatacgaacccactttccccaataattagccttgatacacaagtaagcataagcacaatattttttcttgccaatttctacaatgacccaaaacctttaatgaataaaaaagatatatcctaactaattaaataattatagttgacaataactttattaggcaaaaaaatctactaattttcattgtctttttaaatattacagtattcgggcattgttatatatacattataaaatatatatctagatatctagatatattcatatatatatatatatatatatatcttgagataatatgaatgtaacatttcaaattaagatatacacctctgaagagaaaaatgacactcatcaccatggggaaagatagtaatagtagttaatcaacaaatgtgtgctgaattaaattgaatgaatgcaggatcctctaagtggttggtgaaactgttctggactctaagttcatttcctaagctagatactctatagatgacatatactgaacaatttctataatgcaactgcttcttcctaggtcgtctttttacagaatggaggaaatggccttttaattccacaatccactctggtagctataattatattgtttctttttataatgaagtagaaagatatagtacattacaaaaagaataaatttataatctaacaaactatgaactcttaagcaaccaactcttaactggtggaatctggaaagcgcttcttaaataaaaaagaaattctatcctggatgtctccagaaatgagttgtgttactctagcgccctcctacattaatgtaaaaagtagacaatgctgagctccgcagtttttgtgcagtttccagctttcaaagtaccagatagaactctgactccaacactttccatccttatattccccaaaatgtatatggcattttaattatccttcaaaaatcttgacttttctgacccttcatctcttcttagtagaggaacaagagttcaggaacaagtgtggagatgggggtggggtcaaagggaaagaaatgcaaaccagactcttacccaatgattacttcttaaataatatggtctgtaacagaggttgccaagcctttcctatatagaaccaaagagtaaatattttaagctctttaggatataaagtctctgtcacaactactcaactctgctaatgtatcataagagcagacacacacaatacataaatgaatgaatgtggctgtgtttccataaaactttacttactaaacaggtggtagtctgaatttggtctgcaggatatagtttgctgaccatggtttatagcataatctttgagtatagcatacaaaatatcattcagccgatttttttgtaccagaaatttccaaaatcaactgaataatttacttttttttcccttaaattactctacagtaatctctgtggaagaaggtgaactgcatttacaattgcttgaaatagtgagaaaagttacaaaaagaaactacaaatacaaaacaggcaatatctgataaaataaatacactctgtcactatgttaaacaccagaatttttgtatttctatagagaacaccccaactatcagacctttttgaagcattattcgcatttacattcaacaaatatttaacctaatccttataatcatccaccatttttcaaactttggaaatccagatttagaaagataaagcagacctcttaaataggaagtggcaaatctaagatctgaaccttgatcatctgcttccaaatcctgggctggttaagaaaaatattagatttaaaaaaatctaaaatacattcaaaggctttaattccgcctagtgtttttcagtgccagataattttgtaacaggcaattctcagtaattgtaaaacacacaaatgatgactttcactgtttttagtaataagagtaaatcaatgcaattctcagtcattttgcttaatggagcacattgaaaaacaaaagagctatactccctgtttttttctaatattttctgatgaatttcaatagctagactctcaccatactttaaagatcgtcattcttccttaaaagcaaaaggcaatttaatgagatacttgcagtagataaagttgccgtatttgatgtttccatgttttattttctgggagatgacacagaacaatgttgtctgagattgtgaatttccatacagagggatcattgaagcacccgtcgttcataaaacactctgtcatgctggagacaaaactatcaaattttattaaaacttagttatctcaagtcaagctttacatttccaaatagaaatagtgaactgcaatgtgtcagaactctaaatttcattaccacagcaggtgtcattatttggcacataggactagggtttgtgataactacatcatacaactccaaaggaaatagcagaaatgttctttgaaagcactcttctatgtctaagataataccatttttgagcagtccagcctaagaatgaaaaaatatatatagaaatactgaggtaaaggccatgatgattttcatattacccacaattaaagtttgaaattccaggaaagcatttttagatattatagtatcaggaaaatataaggaaagaaaattagctcaagatttccaatctgactttgtgctagcaaataatgttatgcaaaataatatctattattaatatataataatatctattatgttttaaaaaataaaataatatctattataattataatcccataattttttcttatctctggtaaaatatctgctctttatgttatctcaagtcaaattatacagtttagaaatgagtgagagatacttggaatcatctttcctcattcataggcatctcaaggaagaaatcataatagaatgatatctattattttattttgtagtgtttatttttattttataaaatttttccataatttattggggtaccggtagtatttgcttacatgagtaagttctttagtggtggtttgtgggatcctggcgcacccatcacctgagcagtatatactgcaccatctgtgttgtcctttatcccttgctcccttcccacgctttcccccaagtccccaaagtccattggttcattcttatgcttttttgtcctcatagcttagatagaatagccagatataaatttagatggctaaacatttatatatcatcagtaaaatttcggtccaattctcatttctaaaaattttggtactagagagcactctacttttatgattaaaaattttaagaatcttcctttaagacaaaatatgactccttttaatttttctccctggatccaatatccccttattgtataaaagagtgtccatttccttctcatggacaacctttaaaatatttaaataaaactaattttaaccgccaccaaccctcaatcatatcatgtccaaaataacctttccaacctccttaatctatttttttttacaataaggtttattatttccttttatcagtgcagttttggatgtgcaccatttaaaaaataaggtctttctttaaaaatgctcataaagtaaatagaataatacaaatatagtgtcaggaaggcaaattgtttctaatacgtcttttgacctaaatggtgaatgcctattgttaaagcttcagattattaaagtttcaacagcaaccctgtcgaactattggctaattccgataattttcaattaaatcaccaacattatttgtttttaatttgagttattatccagccaccagtctaattgatttcatatttgtgcaactgattttctaatagaaatatagtactttgttgttttctttttctattacatttaattttccttgttcctgtgcctttattcaagttgctgataaaaactctaatctgaaaagtccgagcaaaactctgtggcacattcccagtaagctaaattccagatgggcatcaagcattaatcaatatcccagggcatactattaaacctgttaaaactctaccaaactttttgccattctgctcacaagagtatcatgcgagtttgtcaaatgcctagttgaaacatagactcactatgtcgatggcccatatgaggcccataaagaaaattcagagctcttaaaaagttgctatgaatctgtaatcccataatttttccttatctctggtaaaatatctgctctttatcttacctcaagtcgtaccagagagtttagaaatgggtgagagacatcggggatcatcattcctcattcataggagtctcagggtagaaatcataatgaccatatttcatttttttttctatgtctgtgcccttgtgtgatagtagcatagttgcttgacagcatattgaagagtcttcattactcactgccattttctttcatgtcctagaagtgaaaaaatgttgtttggttccagttgaccacgattgtatctgatcttttcttctgttttatttgtttgtttcctaacagtttatgtttctcaacataaaatactatcgtcgtcatgccagactgctctctaggatcaccttgttttctcaccacaatgccttagaagggagcagagagctcagggtgtcactagtcagcttatatctcatctcatgttatttgaacaataggactctttaggagatataagaacattataaatacaaggtgcaaaatgtatgtaattatgacacctttttaaagtaaaccatagcaaatcacatgaaatagtgctttcttgatacaatattattatcgtttcttctacaaacattatttcagttaaggagagtgtgcaagggctctcctggctacctgagcaagcatttgaaagattcattatatttcctagggttaaaaactattttcctggagtttctaaaaatgagagcctgccataaaattgtgaagtttcatgggaaaagcaaagtaacttttaaacaactgaaatttttaactattttctagaataaaaagtatagaaggtcagtggatcacagctattgttttagctgaaaaaaaaacggaataagttgatcatggttaggtagattataattttattattacttggtaaaattgaattgtttgggccctggtaatcctcggctatttgtgtgtatagattaaagctcctggttctcacttaaccaaactgaaaagcactaattgtcagagaaagaaatgaagtttttttctagtgacttgttttcgaaacaacgccacttacatattttcatgttgtcacatttacatctgagaattattggtggaaaacacaaatggcataactattaaaaatgggtttctaatcataattcaacatgactttgcatcaaatagaaataccaaattgagaaaaggaaatgagtgtttgactaaataaatgtaatgaaatggtagtaaaagagtcaaaaattattctttgcattttctgtcttttcagtttatctatctatctatctatctatctatctatctatctatctatctctctatctatcatctatctatcatcttgatgtattgattcattgattgtggtaggcatgagcttattatgtaaaataagatatgtgcttcagtgacactgtttttgccaagaggtgttgctttgaggccttccatagcagcttcctgggcatctgggcattgatgggcttgcgaatgagctgagttggcagctgcggcactactggttgtagtcttgctagtatgctttcaactgtatccccttgggatatcagctcccttacctcatcagtgcagctctcacccatgataatgtttgtcataaatgtgacacaaatccagtccccatgctgtatctgcttatgttagccaatggagccacacagtggattagaataacgcacaaggacactggaggaagttgttcataagagacaaagagagcatatacagacagtggacatgaaacatttaattgagtgaagcttttttttctgatttgaaaataaatatatgttagggtaaaaaaaccaagcctgtaaaggaaaacagaaaaattggagttaataaagggacccacagcttcactactcaaagaaaactatcgctaaaatttgggttgcatgtaactctttctaatgtgcatatatgtgtatgaacaacatatttgatgatgtgcagtactttatttaaacttttgcctggtacattaggccattcttgcattgctataggaaattcctaagatcgagtaatttataaggaaatgtttaatttgcacacagttcttcatgctttacaggaagtgtggtgctgatatctgctaggcttctagggaggactcaggaagtttacatttatggtggaaggtgaaggaagggcagatgtgtcacatggcagaagcaggagcaagagtgagagtgaggacgtgccacacacatttcaatgactagatcttgtgagaactcactgtcacaaggacagcaccaaggggatggtgctcaaccattcctgagaaatcctcccccatgatccagtgacctccctccaggccccacctccaacactgaggattacaattcaacatgagatttgagtggggatgtacattcaaactgtgtcacctactattgtctgtttcgttcattccaattgtttgatctgataaataattctatagaagacagtgtaggctgaattgttcaaacattttgccatatttcaagttaagttcccagaagttgggtttattaaaatttaaatattttaagactcattacatatatacacaaactacatgataaaagagttatgtcagtttacgttgtgaccatgatacagtggatttaaaactttttattacatttctttttctttagtagagatgaagttttactatattgcccaggctggtctcaaattcctaggctcagtcagttctcccgcctcggcctcccaaagtgctgggattacaggccaccctgcctagccatgatatgatagtcttataataaaaaatccctctcacattttttttagaaaaaaaaatccctcctcttctttacaaaatatgtaatgatttgcctttattttacttgtccaatttctaacacagtccctattaagttagaaagctccacaattggaatcacataataaataatattaactaaatggcttaaaataacacaaggaaccccaagaagagagcttagattttatgtaagtattcagtagtcacctacttgtattccactaaattgtgaactccaaaaacagtgttttttatttaaagataaatttttattcaatacctgttttgtattaggcattttctcattttttgagaatgcaaaggaaagcaagatagaggatttcagctactatgcatgagacagcaaggcaaggggaccagttgaatatcaggctcaatgtcatatgtctggaatttatctttacacagatggtatttgtaagggtatatatagaccaaaaataaggtgagcttggaaattgatgatttcacattaattttctgcatgtcacatttgaggaatggattttactttaagaataaataatctcttgacagcctatgcatcagaatccatgtaggaaatagtgaattagtcatagttcaaagttgatcatctatttatttggatgttaatattaaatcataaaaatacaatattcgacaagtggataatgttattgctgggatgcttgaacaaaatgttcaattattttaaatgttatcaaatcatttaaaattgaaatttggaagttttatttccacaggagtaaaactgaatcatttaatgtgacaatgtccaggacagagtttcttaatcaaaaccctcgttagagaaatttaactccttatattacattttacggcttttgttttaattttatctaccactatagtcaatgataaaatgtgaataaatagaaagaaaaatattgtcattttattgtcttctttctattgatataattaccagagtcttctcaaagagggcattaaaaactctcttagggcactgaaagtcctttttactcggtttgaggtttcttaaaaggagtaaatgaaaaagtagggtagtggcttagagaaatccaccctggagaagacatgaacagaaaaataattacttataaatgggacaagttgatgtaaaatttgtaaagatgggttggagagttttggcaaaaatgtgagctctggaggaagcctgttgggttcaattcctgttctgtgcactgttctttcttttatattgttagttttctcaactgcaaagcagtgtaacacagtcgctatgattgctatgaaggttaaatgaaataagacgtgaagaccatttagcatacagtccaacaaatacaattgagatttataggctcagaagttaccattagtaatattcaagcacctggaaatctcacacttaatattaagaacaaataatgaaataggcctaaagactaagatgagttataattgtattatacttagtgcaataaattagacaaaccaggaatagagagattgttttactcttcaaagccttagaaagctatggctgtcacagaagctgttgaaattagtgaggatattatatgtcagtgggtaggagaggaaatgaaataagactggccacatagtcatcaatggtgtttagagtagccacattgtttcataagaacattcttgtcaacatatgagaactggagggtgaagattaaaaaaagagagagagacagtgatatgcaggatgagctcagttacaccgaatgctgactttatcacactgcagttacagaaaaggaagaaaaggccttagttaaaatataaataatatatcaagaaagcggaagcaaggttcagtgaaataaaacacaaaaatctaagaaaagattaaagggaagtatcttgatattgtgtatttttgaaagggctgggacaaaatgcattttggtgtacactgtaaagaaagataatgctaaaatcatagactaaataaatacatatgaaagtaaatttacacagaaaattagaagtatattttttgtttgttttcttatgcattttttatatggaccagcacagtctatagcatgtggtcccacttatgagaaacttcgtgtttatttgttcaatataaatgttttcaatttttttgtatgttaacaaagaaaaaatatatgaaagtaaaaggaagaaaagaaattactcaacataaattgggagatgattttttgtctctctgtgaagcagataaaatggtcagtatataacttcagtctctgtgtccagagcaggggttcctaacatgaggtcaatactcttgagattaaaatatttggtgtatgagatgatactctagggtgataattcagagctttcatctgattctcaagaacattgatgatccctttccttaaagctcagaaacaagcgatcgggagaaagataagtaaatgtgactaatgcatacatgaggcatgccatttgtatttatggattagcttttagtggtaatggtttagaggaaagcagtgctaagctcacatgggcaggaaagcaggcagcatactgaactggctaatattaaaatgtagggccgggtgcggtggctcatgtctgtaatcccagcactttgggagtctgaggcgggcagttcacgagatcaagagattgagaccatcctggccaacatggtgaaaccccgtctctactaaaaatacaaaaactagctgggcatagtagcacgtgcctgtaatcccagctactcaggaggctgaggcaggagaatttcttgaacccaggaggcagaggttgcagtgagccgagatcgtgccactgcactctagcctggtgacagaatgagactccgtctcaaaacaacaacaacaacaacaacaacaacaacaaatcagatacaaaggcatttctctgcaaaaggggaaattcctcttgtaaaacaaaaggaaactttataatgtactaaaaaatatggcaaagtgacagataaagaaagttgtcttccaaaataagcaatggggaaaggactccctattcaataaatggtgctgggataactggctagccatatgcagaaaattgaaactagaccctttcatttccccttattaaaaaatcaactcaagatggattaaagatgtaaatgtaaaatctaatactataaaagccctggaagataacctaggagataccattctggacataggacctggcaaagatttcatgatggtgacatcaaaagcaatgacagcaaaaacaaaaatggacaaattggacctaattaaactaaagatcttttattcaggggaaaaaaaaagagcaaagtaaacagacaatctacagaatgggagaaaatagttacaaactgtgcatccaacagcagtctaatatccgtaatctataaggggcttaaacaagtttacaggcaaaaaacaacctcattaaaaagtgggcaaaagacatgaacagaattttccaaagaaggcatacacgtggccaaaaggcaaatgaaaaatgctgaacatcactaatcattaaagaaatgcaaatcaaaactacaatgagataccatctcacatcagtcagaatggctattattaaaaagtcaaaaaataacagatgctggtgaggttgtagagaaaagggaatgcttatacactgctagtgggaatgcaaattagttcagctactgtagaaagtagtttgacggtttctcaaaaatttcaaaacagaattaccgttccatccagcaattccattattgcatgtatacccaaaggaatataagtcattctaccataaaggcacacgcacacatatgtgcgtcacaccactattcacactagcaaagacatggaatcaacctaaatgcccatcagcagtggactggataaagaaaatgtggtacacattttatacaccgtggaatactgtgcattcacaaaaaggaatgatcatgtcctttggagcaacaagctagaggccattgtcctaagcgaattgacacaggaacacaaaaccaaataccacatgttctcacttgtcagtgggagctaaacattgagtacatatgagcacaaaaaagggaatgacagagactgggggctacttgaggatggagggagggaggagcataaggatttaaaaactacctatttaggactatgcttattacctgattgacaaaataatctatacaccaaacccctgcgaacaaacaatttacatatgtaacaaacctgtacatgttcccctgaacctaaaataaaagttaaaaaataaagctgtcttccaaaggaaacctatggaagttctatacaaaggcaaagcatatatgaaatatatggtcttctaaatattcatgttaagataatcagtaaatgcctggaagacatagattggcttagaatgttataaaaatgctaataatttatagcttttgttttgttttgtattgaggcggagtctcgctcagttgcccaggctggagtgcaatggcatgatcaaggctgactgcaacctccgcctcccaggttcaagtgattctcctgcctcagcctcccaagtagcgggattacaggcacacacccccacgcccagctaatttttgtatttttagtagagacaggttttcaccatgttggccaggctggtttcgaactcctgacctcagatgatccacccgcttcagcctcccaaagtgctgggattagaggcatgagccaccatgccggccctatagcttgtttaaacaacataaacttcttgagcacatgggggaaagtacgtatgaagaagcagaaagagcactatttagttactgaagtgaaaaataatgaaatatcttggaatcaacttgaacaagatagggggaggtatgttgagaaagtattggcagtttccattaaaaaaagaaaaataaaaattacaatcttggcgataaagagctggaactagggaaaaatatttttaaaatttaaagaagtaatacaatatttacaattcaaaaaagtgaatatttacaatgaggagagaaatgaaaataaattatactttgattccttcttaacatgacaacaaaatctcaagattttcaaatgagaaaataggtaatttaggctttttttgcatggttcttcagaatttatgattgtagtattctacagaatatgctctcaaaatacagggatttcaataaattccatattgcatgattattataaaaatatggaaaagtgtgttgatgggggatgctaaagttctctgcttataattttatgcagcttattattagatttatccacagactagcttcaggctctgaacatttctaacttttttttctttccttcccactttcttctgaaacttggagtgttattgtataggacacaattttatgtgatatgactctcagaatatgacatctagcctcacaaccttatgtcacaacatggggtctgttggcacaacattctgtaagcgtatatttggaactcatttctatatcaaaatagctaacaatagcttaattctatatggaagtaactgcaaacaatttaacttcctcttactaaccgaaactaaatgtacccccacttaacattttgttactcagactctagaaatattatcagacactccaccaccacttgacacaaggaaaaggtcatagagggaattaagagcagaattggccaggcgtggtggatcaggcctgtaatcccagcactttgggaggccgaggcgggcggatcacaaggtcaggagttcgagaccagcctgaccaatgtgctgaaaccccatctctactaaaaaataaaaataaataaaaataaaaataaattagacaagtatggtggtgtgtgcctgtaatcccagctactcaggaggctgagggaggagaattgcttgaacccgggaggcagaggttgcagtgagcagagatcgcaccactgcactccagcttaggcgactgagggagagggagaccctgtctcaaaaaaaaaaaaaaaaaaaaaaaaaaaagctgaatcatacagccctctgaatcagttgcacttttctagaaattttgcaaaaattttatgaaaaacaaatgaccaagtgaacacctagtttcatacccaggactttaaaggtggtctatgcaagtgggaaatttgaagctcaaacattgtatatgcccacataaatctacctataggctaatgtctatttgtggataagggaatttagaaagactatccaaaaagttaaccatattatagaaaagatgaagataaagcaaccaagggaaaaacactggaaatataaacattatgagatgtaaagaaactttattttaacattagtcaatatgtccacttgtgtattgctgaagggagaactagagtcttaaagaaaaagtgattgttcctgatagaacaataatttattgcaaagtacacagtcttataaacactaccctttgctggaacatgataagatttgtgttcatggttcttcatattcactcttgctccagagtcaatcttgaaataaaaataagataattccagttcattttcagagtcctctcagtccatctgtgtcatttccctgtccctgaccccatctctggatcccattgctgttatgattccaagtggatgggagaccatcttcttggctttatgttgggcaagtttgcatgtaatattcagttttgtttgctctctctctactctgtttcaacccaagattgcaagctgtatttcttaacaattatttattaattatagataaaatactagatgttattggcaataacataagagtaacataaatattaaagttaagttagaaaagcattgaattaaaaatagtctatgtaaaattccaatcttgttaggaaaatcaggcctaaaacaaagttctacaaatgagtcctctgtcattttagatggtataagttaatttataatggaagtttgcattttatcagaggataatcaaatgactgacttgctgcatttgaaagccttctgatactaaaacagtctgtataggagaaaaatgggggaaagaaggacttcctggtgagagtaaaaatatagaattcaagcctacaaataaaattgaacttgatttttttctgtggatactttctcgtattctgggttaattttctttataatattttgaaaggaagtaaaatatgcagagtgccaaagacagcaacagaaacctcccatactcctgaggctttaggaacacctgtcatgaaagtgggtttggctgacgtaggaataacagtgatacaatatgagtgccttttatttttgacagtctctgcgtttatcaattgcaaatgtacggtgtatacagccagcaatttgtcaaagagtgttgtagaaatatgtctgacccacataaaaagaccctatgcgtagaaaagttttgtttatctgaactgtatgctcagtaatctaacggggaaataagaacaacaggtttctaatctttcttggccactgagaaaaggggcttcatatgttgtaaaatgcagttacatgctatctaaagtaataataaagattgttttcagtcctactcttaacttcctacaatttagacattaccagtagaattcttttctaaagttcctacgaagtcaatacctcctgtctgtctattgcatgctttacactcaggactagagtctaaatccaagctgagcaatttattgccattatgattttaggcaattagaattaaggttttcttccatagctcataaacaaaaatagtatcacttaatgattaggcataaaattgctgagatgtaatataagagaaatattttgcatgcatcctaaaattctatagttaatgtacacacacgctcatacacaattaggcgtgccatgtccatcttttctaataaaatgtagttttaatttttaaaaatgatacaatgtactttacctaacatgtatattttatatatatattatatatatatgatatatatcatatataatatattatattatatcatatataatatattatattatatcatatatcatatatatgatattatatcatatatcatatatatgatattatatcatatatattatatcatatatcatatatatgatattatatcatatatattatatattatattatataatgtatattatatatgatattatatcatatatattatatattatataatgcatattatatatgatattatataatgtatattatatatgatataatatatgatatatatattatatatgatataatatatgatatatatattatatacatggtcatggtaggttttcacgacaggcatgacactcaaatctcttaaaataatttttacttctttttaagtaatcaatcaacatttgtttatttaaactttaaactttctaattcgtattttttaaattaattgtaattgacaattgtataaatttatgggttgcaatgtgatttttttcaacttttgttttagatacaagggctacatattcatgtttgttacaagagtatatcgtgtgatgctgaggtttggggtacaattgaacctttcatccaggtagtgagtatggtacccaaaggatacttttctaaccctttccccctcccttgctgtccccacttgtagttcccattgtctattgttcccgtatttatgtccaaaaagtatgtgttaaaaaacggttcatctcacattgactgtattccctactttatgatcattcagtgtagatggatggagtttccttgatggtggcatttaattatgcttacaaagaaatgtgatgaaaattcaggttaaaagagaaaatatatgaaaggaattttcttcatcaggaacttcagcaaggtaagtattgtgctgcaacagcatgcaatcatccaatatccacgtttattttctcctttctccctcattctacaataatgagaaaaaagcagacacatgtgattcctaatccaatttaaagttttgccacctgatggtagattgttatttttgaaccacatttagcaaaggacagcaaattgcactcagaattacacaatattcactggaatctgtatctttcattctaagtcgtttttctttctgcaattgttcacttgttagaagcaatatctgccactacttatatacatagaagagagcagctgagagtaagcattagttccacatcattaatatgagtattaataataataaaggaaaccctttccaaatggggatttatgtttgagaattcagtattttagtccaaaggaagaaaaacaggaaagtttttgggcaggcttttctctacatttttaatgatgcattgggggagggtgaggcaataagagacacagagaagcaggtggaagggaagtaaggagggatgagaaaagcagagtactgactgttgactgctcactgctgcctcccccatgttccccccccaccaccatttttaaagactcatcatttgtagctttatggaaaagaaactaatgcatctagagcagaaaaaaataaataatgtacttgtatcacttgtttattgctgtgtgataaaacactccaagacatctctagtcacgttgcgtgaagggtcaaggacacacagggtcacattcattagacgctgtgattgtgaaaacgtaccacagataatatatttccccaaaatattaataaatgcaaaagagaatcatcaatatttttaatttgagaaaactctgtatttgcaaatagttcaaaagcatattttaatcaaataattatactagaacttaaccattaaaataatcccaaatatgaaattagctgtttttcaatagtgaatcttgtgtaaggtagaaagacatttatatttgaacggttaaaattattaccacaagtcccctaatgtttcataacctaaggcatggatttggggagaaaatcaacaatttatagtgctaggcaagccaacaatgatacagtagtaagttttgatagataagaaattttgttggattctgaaatatacatgacaatatctgtatcctatcaactttatgaatgtgtcctatttggagggagaaaaggtatttaggagataaatctgacacagaattactgtctattattataaatgttaaattaaaaaaagttttcaaaataagtatctgagaaaaatgaaattaatgcctattttaaaacattaaaatacctacattttaatctcctaaacatataatttctttctttattctggcaacatccttatttacttactaagtttgtatcaatgttaaagccttcaattaaaaaaaagtaaaattgtaaaaagagcctgtcatcatgcgagtcacagtctagtagagtcaggaaagtaaattagtaaaatatgtcacgtcagatggtgaacgccaaggagacaacacaagaaagggaggtgggaagctcttctggtggggaggccttgcgattttaagttgggtggtatgggaagatgtcactgagtagatggtatttaaataaaggactaaacaactgaaaaactaagccttattgttccctgggacagtgagcatttcaggcagagttggaagagcaaatgcaagtaagtgcctgaggtaggcattcattggccaggtttgagctataacaggccagtaagacttgggttgagttacgtgggggatattagcagcagatgacactggggagagagcaggcatagaggtaggtagattgaatgaaactacaatggctaggtaagtctttataagaattttggctgtcatgtgattgatgtgagacgctatggaagggatttgaacacaggaataacataatctgatttacatttgaaaaggattattctagtactatattgaaaatagatggtgagtcagaaaagaaaggaagaaatatccaagccagttaggaggctattagagtaatcatatgagagaccatggtagcctatgccacagtaatcgcaacaaaggtgatgagaagtaatctggttttggaaatatttacaaggtttggaaggaagagctaataggattatccagtatcttggatatgggctatattaatcaactttaatttatgtggccatgacaaacaacctcaagtctttccccaaatgtcagtaatttacaacaatgagcattgatttcttgctcaagttacataaagcagctgtgggtctggctctgctcacctgaaggtcagcctggagctgcttgacttgtgctcatgtttaccatgcatcctagaatccaggctgtaggagcagtttctatcacataaatgctctattcatggcacagggaggggtgccatagccacagtgggcaatcttcttaaaagtcctgtggagttaaggcataagtcacacctggttacattctgctgccccaagcaatgtggccaagcccatgtggctgggtggggacaaacacttctcctacgggaggtctctcaggtctctttatctgacagagaagggagcaagcatttggcaagcacaacacaatcttcaacattgcagacaacagaaatcaaggcttttctcctaacaaactagaaaaatgaagtcactgtccaccgagatgggaaagacaacaggtagaataagtttaaaagcagacaaaaaattgatgataatatgaaactgtgatgtgatattggaattattttaaacattatcataaaaatttattataaaatgtagaaaatctaagttatcaaaagtctgatcagttgtacaagtgacatgaaataaggtactaggtcattttcatttgaagtgaaataaccacccaattcagaacaattaacagggggtaatgaaaatacctgtattcatacacgtagcccattttaaagtcatataattattattcacagatcatcagctacatttaagggatggtgatattcaagctgtcttgtatttcacatctctaagtgtcataaatatttccctttactatagaaaaagcaaaccagtatcaaatcgacacagaatgattatcaacgtatatatcccttgtgtagatgtagtattctgcaacccctgtgtaagtcctttttcacaacgctatatcatgcttcttacagcacttaagctgctggtacatgggtttctgaagaatgaggaagggttaatcagcttttggcagagatcagcaaaatttgcaagcattttagcctctccatcaagactcataaaatattttggaaactacaggacaaaaaaccaacccatccaagcagaaaattaaaaagcaatctgccagttcaatggaattcaacctttgctaggctgcaaatgatggtaaaatggttaaatattcattcatgattacccagagacataaagctacggtagaaacatgaaaaaaaaaatacatagactatgggcaggtgggaaagaaaacaggactaaattgtgcatcttatggagcagtgctgtttgttttcttttaacctgatttctatcaagatgctgaagaactgtagatttagataagatgaggaagaagagggggatcatctctccaactcctggtttaaaagggacactcttttttctttttgcattgaatttttgcctaaaatttccttttattatagacgtgttctctttttcttgcttgagagtaaaatattccacaaagtcaccaatcatgaaagtcaagaaatgtttgttgtattgactgttaatttcctaaaagaaaaacaaaacaacagcaatagttgaataagggaagactgagtttattaagcctgtcatggtaaagaagagcacacctggacaaaggagtgccttgaaaagggaagtcagaggagggtgtttacacaggtgcagcttctgggctgagtgatttttaaggcgtcttgcaagacagagcactggataaggccaggcagagtttagaacttaatagctttggattggtgagcacagtgtggcaagagtgttaaagtgattacatgagcaaggtcttaatcttgacagctaagctgtttacttggttcatggccttatattccagaagcaagcagttaaattatctttattggattcagtattgtttaatatagggtcagagaatggtgtccgtttcaatgttctgttgagagtttacctatcttgtgaagttttgggagaaaacttcaaccaagtttagagatatctgctccatgtcccaaacttcccagataagggagattactctggtatcattctctgccagacatcacatcaagaaataacagaagctgaaactggaattacattataatccataaaaggctgataacagaaagaagtattacaatgaccctgtcttcttcagaagatccaataaaaaggctatgcaagactgcagaagttactacctctaatttcttggcttccatacatatcattttatttcttttctggcctatgagtcccaaaatgtggcatagatattgactccaaagagaggaagtgattaaaatctacccccattggttagaagctggccattaccaatactcctggtatagcataaaaatgcctcaaacaatacggcatgcagtactgctctttgagggctagtgccaattaagggaacttgcatacttctgtttcttttatttttaacttactgttagaaaaatgttaactaaatttttgaggggaaatgttgtcattacagaatgcgtgtttcattatgcatatcctattggtgaataatttgcaaatcctcatttgacctaaggagtgtttgattgtcaagctttatatccccaaattgccatcaagcagataacttgtctctatcatttttatttttgatagcaatttttctgactctaagaaacctataaagcataattgttctaaaatatctccactattaatccttttagtctcattttttcagaacatactgaaacagaaatagtctgtcacctctgcctccacctgcttttcttcttcctccttgtacttcagagctaaggaatgaatacagaatttattctctcaggagagtgaaacaattgatccagtaattgccatgtcaagggttttggtgagagaagtattctaaaatcacaatataatgcaagtctcataaaggatttcctaaacagtatgttgctctccctactgaataaaatatacctcatcctacatttcctccttgaggtctaataaggagagacctatctggtctatggatttaacactctaagataatttactttggacaaagatctttggagaagcttcattatattttgaagtcattaacatgactcaagaaagtccccaattaaatgaagatgagtcatatgacagtaggcaactgtagatagtctctgcccctacattttgcctctgtagaaatattctttacattcatgggcttccataggcctgatgttttcctatttttgttgttattctgcttcattactgcaaatgtcagacctttaagagtgaggttattaaacagcaaaacacagagcaataggcatttgtaaaagatatatatccagggaagatgctgctctcccactgccagccatacaagctgaggcttccttctcatcactgaagaagacaaggagacaagaagcacattatgtcataaaggcaataggaatcttgcaagtaaccttttcaccagaaaacctctcatttgccctgccttgcatgtactgttcttgaatgatttattgccaaaatattcttgaatttcccatattgttaatttaatgttcttagtaacaaaaactaaccgtgggattgatataacagaaaattccagtcacctcagggcagaaattattattttaatctagccatgaaaataaacattttttttcaggaaactcaagtccttaaaaatgaggtgaagtgtgtctaccacaaagtgtcggcaagccagggaaagtcaggcagggtgttcaaggaaattaaacacatccagcttcttttttctactgtcttcttgtttagttcttctaaaaatcagttttgatggggagctctggcaaatgtttgtgttccgttagtttaatgtgatagaggaaaaaacattctggctggcagctaggctataaggggagtgctgagatttgaaacagaaaccacaatttataaaacgactgcaataagacttgtaaaacacataaattatagcaaaccacacaagaatcacagatgatctaagaatatactctttaacaccagctcatttagatctacatgttccaaggtaagaacacaaataaactaatctggcagaaaccatctagacttgtgttctaaagacaactgttccagtaaatcctctttatttgaaaattcagaccaatccctgctaaggccatcttatcaggtaattttggcccctaaactctaaaggtatccttccctgactctctcctttagagacccccccttacttcctgtgatatgcattctccctgtcaagcattttaataagtctgactttaactgtaatggtgttggttgctcttagctggaaggctttaacttaaaataccaggaagattagagagataactataagtaaaaatcatctaggttatgataaataagctgttgaattacatgacttgtttctaggatttttctctaaacatgtattaagtcaaactttctccaatttggagtgaagttaatgatatcttttaaagcttctctatagaagcagagagtagaatggtgattaccaaaggctgggaagaggggatgggagttggggagatgttggtcaaaggatacaaaatttcagtcaaataagaagaataaattcaagaaatgtattgtaccacatgatgactatagttaataataatgtagtattcttgaaaatggttgagtagattttaaatgttcttgccacaaaaaatgataaaactatgtcagataatgcaatgttaattacccaaatgcaaccattgcactatacatatacatatataaacatcatattgcacttaataaattttttttatttaaataagtaaataattttttaagaaaaactctccaggtgattctaatgttcaaccaaatatgagaaagtataagttaaaatattaacacctttcaataaaacattttttaaattacatgatgaattacatatataaaatggataggtccatggtgagtgactttgacatacataaacctcagtcaaggtataccccatacccaagaacattccctcattcccctttccattcagccccctcccataagtaaggattgtttttctagcaccatagattagttttgcctgttcttgaccttcatgtgagtgaaatcacacaccagagcggttgttaaagatgactgacatgagatccaaaaatgtcaacctagaatgaaagggcttcagctttgagaagctcttcagatacatttcactgtaataccctaattttccacttgagatcaacaagatcacacagctagttgatggcatagttgtgaacaaattcattgtttcctaaaccctctttactgatattccttctgtcattcatcaacatgttgataagtagcaactaaactataaacttcaaaatatatctaaaacctcaatttttactgcttctcctttagttcaggcctgatgaactacttaactaaactttccagacaaacttccagactggtctctgtctttagattcttacttatttattcattcattaaaaaaccactccttgggaattcatagtctaatgaacctcattttgcagtccactcctgactttattacacagatctgattatgaagtcttcattggttttaattatcagggttacaaatatgtgggctgctgactaaaggcaatccacagagctgatttttccttctcataaaattagtttaaaaattaaattacttgctaataattaaaactgggacaattctgagtgataatttagtaccctgagttttcttgaaacataagaatgtctaataacacagagttctcacttttcttctgtaatcactggaaactgaggagtgaatatgttctttagtttattacagctgcaacaagtgactcactgtgtttctgacaatgtggccacatgcagccacacttcatttatctgtcaccttcttacctatttaggcattttacattttcaccctagttttctgagatgaagtctaaattctttgtccaggcaagtgaggcctttgcctttaacagcacactttccgctacatcttactgaattatatccagcctaaaacagttgttcttccctgagtaacaaaatatgaatgataacactattttgattggaaatctaacaattttgcttttcttctcttttttcccccatagaaataaggaatagttgtattttcccttacttcttgggatggcatcctcacccccatgaggaaagataactaggatctcagttgattaggctttaaagttaataggaaattagagtctatatttaaagaacaagaaaagcagggcctttatcacaagaagcagagtgccttgaaggagttgatattaagcaggttgtgtttcttttgcctgctgagccgggctctagtagaccaatagtgaaaatgtggttcttgctaaggaagattgcaaaccagtctcagagacggataagtcactagatagtgttgacagtataggaatcatcacagggtactcttgtagcataggagggagtagtatatactagaggacctgccatctggactagaggaagttatttctaagtgtctgaaacttaggcctgaagagctagtacatatatgagtaagcaaagcaaaaaggtgtttaggcaggggaaatctcaaagataaatggatagctcaccaattcaaggtatctttggggtagtttaccatagtcacagagaagctcaggtaggagggagtatggaaagtcaatgattaggggatttggagaaaaattgagtggaacagaggtagaggatgaaatcattagcccttgcattttattcagtgtaattttccttctttcctgagggagtgggagttatcaaaatattttttggagaagtgtaggatgacagaattgtaatatcagctaccgtgaactgttcgaagttctctttgtaacacaaaaaaacaaaaactgatttattcatagtttattttttaaaaatactttaaattctgggatacatgtgcagaacgtgcaggtttgttacataggtatacacttgtcacggtggttggctgcacccatcaacccatcatctacattaggtatttctcctaatgctatacctcccctagaccctcaccccccaacatgccctactgtgtgatgttcccctccgtctgtccatgtgttcttattgtccaactcccacttatgagtgagaacacgcggtgtttggttttctgttcctgtgttagtttgctgagaatgatggttgccagcttcatccatgtccctgtgatcattaaaaagtcaggaaacaacagatgctggaaaggatgtggagaaataggaatgcttttacactgctgggagtgtaaattagttcagccattgtggaaagacagtgtggcaattcctcaaggacctagaaccagaaataccatttgacccagcaatcccattactgggtatatacccaaaggattataaatcattctactataaagacacatgcacatgtacggttattgcagcactatttacaatattcagaggttttatggtaatattggtaaacaaatatagcaaatagattttaaaaatgaaaacaatggatcatgatatattccacctcatatgatcagaattcatttagaaatgggcttcagggggcttgtggcattcagagaaggctttatataagaaatggaacatcctcctaaaggaaacatgggtgttgaactacagtgagattgggggtaaaacatttcaagttgaaaagtttgaggccatggtatgtgtatttgtgtgtgtagcttagagggaagactgatgttgggagattctgaaatgtgactgatagctaataattttgaaattgacttggtagaaaatttctgactcttcttaagcaggagagtggcctaatgaaaataatgtttggattattgcgtgtggcattcaagttttctagaatgcaaagattggtattagcaagagctgttggatggatagcaagatacactaccaaataaataatttagaaaatttgaaggtacaaaacaccagtgtaaacaatgtttccagagttgaaacctgaagctcaggtctccaaatcactttccctgtaggaggagtgaggaaatcagttttccttgtaatagagctgcctccccttctattctttctacttggtaccatctaagttatacttggtctcagaaattatcataacaggttgtattactccattctcacactgctgtaagggcacacccaatagtgggtcatttataaaggaaagagatgtaatggactcacagttccacatgaggggaggcctcacaatcatggtagaaggtgaaggaggagcaaaagcacatcttacatggtggcagcaagcagaagtgctgagtgtaagtctcttataaaaccatcagacctcgtaagaactcactcactatcacaagaacagcggcactggggtaactgcacccgtgattcaattacctcccactgggtccctcccatgattatgggaactacaattcaagatgaaatttgggtggagacacagccaaaccatatgagatcattctaacagtaataggtatctctgttgatgtatccacctgaagaagagagggagacaggcaggggagtcgtttaggtcgtaagcacttagtgtgacttttcagccacggtgtaagttcgagtgtgtccaaaggtctgaaagcccaaatttcacaggtgtacagaatgtgtaggtttaccaggacttattctactcccaatggcatctttgttttgcataagagtctggtattcttataattcttttcttttctattattttgagactttaattaagccatagagtgtaactgtaaattcatgtgacctgaaactgtaatttttattatgtttcttcttaatttacacattggaagccattttgttttttaatttttattttttgattttattttattgtggtaagaacccttaagatctatcctcttaaatgtttaaatatataatgcagtagtgctgactacaggcacaatgttactccagacctccctgattttgcacaactgaaatttcatgcctgtttatttataacttaccatccctcttccctcagctcctggaaaccaccattatggtctttgatttggctattttaggtacctcctcccagagaaatcatgcaggatttgtctttctgtgactggcttatttcatttagtataatatcctcaagattcatccacattgcatattgcagaattttctttattttaaatccggatagtattccactgtctgtgtgcgctcatccattaatgaacacttaggttgttttcataccttgggtattgggaatgttgctgtgataaacgtggaagtgctaatatctcttcaagatcctggttttaattattttggataaatgctcacggtggaattactttatcatggttttttttttttaaaggaaccttaatacggtttccgtagcagctgcaccattttgcattcctaccaataccatgcatgggctccatatcctcacagacacttgctgcctactgcatttttttcaacttttattttaagttcaggggtacatgtgtaggtttgttacacaggtaaacttttgtcatgggggtttgtcatacagattatttcatcactcaggtattaaacctggtactcattagttattttccctgactctccctcctcccaccctccactctcttttgaaaggccccagtgtgtgttatttccctctatgtgtccacgtgttttcatcatttcactcccattcataagtgagaacatgtggtatttggttttccatttctgtgttaatttgctaaggataatggccaacgtctccatccacatccctgaaaagggtatgattttgttcttttttatggatgcatagtattccttggtgtatgtgtaccacattttctttatctggtctatcgcagatgggcatttaggttgattccaggtctttgcttttgtgaatagtgctgcaaagaatatacacttttgactcaacaatcccattactgggtatatacccaaaggaacataaatcattccattattaagacacatgtcttttgcttttttcataatcaccatcctgagagaaatgaggtggtgtctcattgtggttttgatgtgcatttccctgatgactagtgacgctaagcaatcttcataggcctttgggcccttgtgtgtcttctttggatgaaagtctggtcaagtccatagctcatttttgttgatgttattataaagttctgttatcattgttgtttttgttagtgagttggagtttcttatatattttggaaattaatcccttatcagatataagatttggaaatattttcccattctctaggttttttttttttttttcgttttgttaattgtttcctttgctgtacagaagctttttagtgtgatatattcccagttgtctatctttggttatgttgtctgtgctttaggtgtcagagtcatgaaattattgccaagacgaatgtcataaaagttttcccatatgttttcatctaggagttttctagtttcaggtcttaatttgggactttaattcattttgaattgatttttgtatgtgtagtataagagtccaatttcctttttttttttttgcatgtggatgttcagttttgtcaacaacatttgttaaagagactatctttacccaatttcctatctttggtatcaagccattttaacaagaattttaacactatacattttctgagagatgcatatgcttaggatgaacagtttaaattactaaattgatagcacatgccagattaagttctgttatgtctttactgtaattctttgatatttttaatatttcaagtacagatacattctaattttgatttaattctgccagagcaaaatgtatcttatttgtttatattgaatcaatattaaggaaatatttacacaaaaatatgatcatatattttaaatatctgtactgtaaggaaaatgcttttatatcttaaaagttattgaaaaccatgggtattattaggaaacattagtcattattttgattaatagtttaggctaagtcacttgaacccctgatggtgcctgtcagattgtggaatacacatatatctatttgcagcctctctgtcataagggctatgacaaaaattattatttaaaaactattttgagtttcacagaaggaggctataatttctataaattcatgtttatgtgactttgaagtagattcaaacaaatgttattaatatcaatttatcctgttaatctagggacacagcacactgatatttcccaagaaagagtaaaagattgaaaggacatcaataggtaaaaccatcatttgctgaaaactctttgccctgagaagcagaagcctgtcaaagtccaacacaaccatatatcaacctccctgtcaaggacatcacacctgcagtagaatcaacactgtaacaggttgaggatgaccttagtgttgtgctattgatttagtctccatgttgttattagtctgatattctaaggttcaatgaatttgatccacataaagtaagtatcaaaaagaaaagcgtggaacctaaaaagctccagtcaaaagcaatcacttccaggttttcaaacataaaaattaaagggattaaacttggattgattaaacttaggggaacgggactagtagatttgataattgtgttatttgaagatcaactgaatttttgcacaaaccttcatggccaatagaaatgagttgtgcccccatgtacctaagggtcaccgatctgcaacctacaagtagggtgacctgatttgcctgagactcttccggtgaccaaactcaactcatcattgacattaaaaggagagcttttaaaatatagatcctatgggcagcaattcagagttacagagtctaaccttatagcagtgaggtccattaatctgttttttttttttttttttttttttttttataaagtacccgagatggttttgataatatgggtgcttgggaaactctcctccgaaaaacatagagttcctgatttggaaatcttgctgcttaaataaaatatgtgtatatgtgcacacatgtgtggtgtctatttttccctttcctttttccaaaatgccaacaattatttccccctgtgtattatgactatagcttgtgcaattacaatgtttgtatgtatcacagttgattctaattaagtattaagacgttttatatactagaccaagaacttatttaagaacttattcctctctttttctgtttgcaatgatcagcatagagcctgtatatagaaggtattccataaataagctaattaataagacaagacacttggaaccattcagatttttaaacctgttccacaggacattgaagagaaatattcaggggatgcttcatgaatgaagtgacacctgaagagaatctggaatacactaaggcccagacagggaggagaggtttataagcaggagggaaaaaataagaataataccatgttgacaggcatgattgcgggaaaatttgtagatggtggaaagtgtgatttggtaacgtaaatattttagattcttcaccaaggggcaataagatggcagtagagtcttagtaaggcacatgtgatcataatgaatatgtttggagtcaagagaagctggtataaggaaattctggtggatgtttacaccatatagtacgaacgtcctgctcagagtcaaatgatttcagtttcaaaatgtgccatgttggtgtgctgcacccaccaactcgtcatttaacattaggtatatctcctaatgctgtcccttccccctccctccaccccacaacaggccccagtgtgtgatgttccccttcctgtgtccatgtgttcttattgttcaattcccacctatgagtgagaacatgtggtgtttggttttttgtccttgcgatagtttgctgagaatgatggtttccagcttcatccatgtccctacaaaggacatgaactcatcattttttatggctgcatagtattccatggtgtatatgtgccacattttcttaatccagtctatcattgttggacatttgggttggttccaagtctttgctattgtgaacgtaccctaaaacttaaagtataattaaaaaaaagaataagaggccaaaagacactaaaaaaatgaatgaaagaaacccatgccttatctcttgttatataagtagtgttatttattttctggtctatgtatgatttataccgcaggaccacatttgtacagagtccagctcctgagcaagcttttgtggtgggcagcatatgaccataaacaaagcttatttttctccttcttcccatctcttttcttccctcttttccttctccttccatttctccccaccttttcagagaacgagactgcattgattagttctgagttattcagctcatatgatgtaatcattttaatgtatgtgatgagtaagatacaatctcctcaatttcaactacagattgctgacataatgaaaaaaatatatttatatatgtcactggaaatagataaaaaatgcaactgatataagctgggctcatgaagggtcctataatactctgtggaattcacaccattctaacagccatgaagaaatactgaagtattttaagcaaagttgcaactattattatatattcattatagctttatcatgcctaaatactattgtataaagttttcttcccacacgtcagaaacaataagattctgaaaaatattataataaagttattcttctgacaaatgaatcctagagaaaattccccacctgcaacagttccttcctcagttttctctgactcaatacaatttcattcttttcgttttgcagctcaaaaatcttggtgctatcattgtctcttctcagtttctctcttagacctaacgcattaacttcacactactttcaaaatatattctgggttcgatcacttctaaccaaccaaatttaagctaccattggatttttctcacctggattattacggcacacctttaaattcctgtttttgctcctacccacaatatggtagccagaaagatcctgttaatttaagtcagattacagcacttccctcctctaacgactttccttctttctttcctccccctaacgactttccttctctcttagagttaaaatcaaatgcacttattgtaatgtatgagacccctcttggtttgtgcccccattatctccctgccttcatctgttttgactcttcccctctgctctctcctttagtcacatggtccccttgctttatgaacatcctggcattctcccgacattgtacatacatgcaatgcactcagcctgaaaagtctttcctcagataaatgcatgtctgactccctaattcccttcactcccttcctatcttcattccaaaggccactttccagtaaaggcttactttgccgcactgtctaaaattttaccccttctctccaaaactttttcatattcccaattgtactatgttattaatttggtgcaaagtatttgtggtttttgataataattgtgaatattactttctctctactggagagaaagctctttgagacatgtattttagtctcttctgttcactgttatatcccctgatatgtcagtatctgatacataataggtactcagtaaacatttgtcaaatacatgaatatatgaaattatgacaatatttgaaataattctaattatatttgaaatgctagaacatatatttatgtctattcttgaatcataacatagaagaagtctatagaaaactccattcttttatttcttatataatctatatattggattgttcttttgagctctgagaatatcaaattaaaagtactgaagtaaatactaattagtttctatcggtacctttatttgttctgaatgtttctcacttgatgtttagtgttagatatataccaagacaaaattaaataaaatagataagtgtttttcctataattcatcctaattattcacatttaaaatttagaagggactttattagatgcactttttatctatttttagataggaaaggccaatttgcattctcttcaaggaaataattggtattcataaaagttggactaacaatttcatttacatttgaaagaaaattaaaattaatccaatgtaggatattatacaaagattactatgcaaatatatttttaaaagttgctatatcacatagtgaacatttcaatggaacattctaaaaatgttgaggttttgtttcttaaaaaaaaaatacattcatacgtaagtgtgagctcttctcacttccataatagaagtgagaattatgctgtctgcgtactcatgaccggcatagttttccacaagtgctggctttaataggtgaatataaaatgatgtgattttttcttttttactgacatgaacattattattgtgcctttggttgaaataaatacttgaaatgtttgaacacacacacagccccatataaaacagttaaaaagttgttcttttgggcattccatttgttggtcagatatctgtattaacaccgattcatatccctcaagctgatgagaatgcagtgtaactaacgttgaatctaaggccaaaaagtatctacaaacaactggagccttgctggaaccatttgaggccgccttctgacctcctgtctcggcatatagctctgccagtgctttaacttgaactagtgagatctgaagcccctaaaaaaatactcatttttatagcttctaacgacagtatttgtcttttgtgtggaaatcatttttcagcctcaaacccttagattgggttcatgtggatttcaaaataagttgtcttaaaaatattttgctccataataattaaaacccatatcaacacatttttggtaactatttttttgcaatccttcatattaagagaattgtaatactttttttaaaaaattatatgcttagccatttgtatgtctttcctctacaaattcctcaaaagtcccacatatttttttctgaaatctcctctattctctcttagtttgttgtgttatattgtacatggagatgaaggatggtataatgtttaaaagatttttggctttctgaggagtgtttgtttgacttatttgcttttctgcagagcagtggacacagctcacaggctggccgtgctaccagctcttgctattattcactgtaaactcggtgtgcagggtaccgaccacagacagctgcccaggcaggtggtgtgcactgcacagagtctccgaggtaaggcagcgtaagagccagcaagacctttttaacaaaataggcgttagccagggtgaaaatggggaaattgcacatatatagcacttgagtgtccataagttgcatttcacctccttttttctcactgaacctcataatcatcctgagatctacttacgtattatttgtcccattttccaaataaagaaaatggggtaaagagaggttaacttatttgccaaataagagatagtggatgaaatcttgatcctcttactacaggtttcttactcttccctcagcagctcagcctcctctattgctcagcaggcattgtggagtgaatggcacagacctctccattcataagtccctctttcccattttctttctccttcaaagagcactggtacagtcacctgaaaagctaaagatgcagtgtgacaactgctacatcagcaattccagacccaccttcccacaccatctcacccctaccttgaaaagaaacctttgctttagattaacattaattaagtcatgcattagactaacataagactttatctattatctatctaatctaatcttttattctatccatctatctaccatctattatgtatcatctatttactgaattatatatctaatcttctatctcatctatttatcgatttatccatctatatgtaatctactctgtatcatctgtctgtctatctatctatctatctatctatctatctatctatctatctatgcgatatctatcacttttcaacacctaattcacaaaaaagaagccatgagggagattgtagactgtaggagaggtacacttatatatgtaaacatttagagaacaataaaagactacaaaacaatattatgtttaatgaaattaccatccaaaaaacgtgtttgggtgagcaagtggtaccacatctgagggaaagttgattgtgtggtagaaaaacagagcctttggcatcagaaggactgagtacaaaccttggctctgccaattaatattgggtgacctggaagaacatgtctaacttctccaacatacacattttttttcttgtaaaagtgatggttatagactcttctaacagaagtgttacaaagattaagtgattaatgtctgtaaagctgaagctcagtgcctagcatacaatccactctcaaaaaagagagcaggtttccacacctgtaattcttaataaacttcattaaatagcaatgtctaattattttgttacatagcaatattttatcagcaacgtttattggattccaacaaatattctttcaacaaatacacaaagaaatggaatatttcatggttatacttttttctattgtataatgtcagtctttttttttctcaagtagtaattaaaacttgctttgaaaaatactagtgtaacctaaaactactgtattccttaaaagtacttagaataaggagagggcagcaaaacaccacaggaagtataggggattgcatcccagacagacatggtcttggcttctggatctgcctcttggtagctgtgtgactttggatgaattgcttaatctcaccttgttttaagtgagataaaatggggaaaataatatttacctcacagttctgataggaggggtaataacataacgcatgtaaatcatgcagaacagcgtattatgataggtgcctaataactgttaattccccttcttctctttgttttactttcttctacttttctgtccctaatattctgatcataacacctccaggaacaaaagaagaaagacagaaatactaggacagttaagaagatccagtgagaaaaactcatatagagaagacaagattattgaaaattctaatcatttcactgaaactgatgtttccttgaaacaaacattacccataagaatggctgccatggtttatttaggaaacaaagtgtaatatttacaggggcagagaggacagcataagaatgaaaagagttagtgaaatctgacctttggtgagctggcactatttagtaaatctcccttgccttggtgaaagggattggcttccagtacagttaattccacatggaagagaaatataggagctttagccctgagggatattgctctataagcccaggttcttttcagattattctggttgattaaacacacagagaaataacccttttaaagttgtacatatattaagaattggagtaggcatataagcatcaccttacaaccgacaaaacagatttccaagcaacatacaatttaaattaatgcagttgtacgtaataatgattattttccaaatgatctatttgattggtatacatgctttctgactcttctcccaacagtgccatcagctgtaagggaaggattgtggactaaactcactcccgatatttagattatgaaggcaaagaaactatggagaggataagacaggaatttttaaaaggagaggactaagaagacaggggcagtatgtactatattgttaccctcccaggctggaggtgtggaaaactattataaaccgctaatgatcatttttttggtgttcgttattagaaccaatggaaggaaacatagcaggtgaacctcactgtattctctaaggtctttccagaaaagttgtgcctttataattaattctattgtctattagagtatacagttaagtgcatataccaaacttctttggtaaaatgtatagaattaaagactttcagggctgataagaggcccagtaagtcatacaggttagaattctcagaaagttaaaagccttatgagaaatttccattggctcaaatcagatgagaataaaacttgatcctacgtgtcttaatattcagtctaggagacttgccagtacccagtgcttctttattgactgattaaccattttctaactcactaattaggcaaaccagaatatttgtatgctccctgtgtgtgattgtctaggttgcaaattgagctaatttaattttgttgtttacaattgatacatttatttttgatatcctttggtagccttttgttagaggtgagagttatagttttatttcctgatcacactatcatctcatgttaaaatgagggtaaaaacacaacaatcaaattctacaacattttcaaacacttattagcaatgaaacagaaaatgtaatacaatctaccctgtaagtttaattaagtctcaacctttgtgttttttagtactgtgacaaactccgggcatgacagtttcacttagacagacatgacagttttctgttagcaggacctggttaccttgtagctggaatcaggccaaagcatcttctggaagaggttgctcataggacttgtggacattcatagcctgaggcaccggggtgaagagtggaagtgacactctaggtgctgggacatgttgtgcacatgacagaggccccacgtggtatcttagcaagtccacatgttttatgtcactcatgaaacatttcagtaatgagaaatcattgcccctctgcatgatgataatgaaaattttgaaggttattaggaatcagcatagctgatggattataagaacgacatctggcatgtactttttttttaaccactttatttgggtatgattgacatataaaaactttacatatttaatgtatccaactcaacaaagttggagataagtatggacccttgaagccatcaccacaatctgtcataaccctatccatcaacttcaaaagtttccttcttcctttttatttatttattattattatgatttttttgggggggaaataagaacatttaatataagaggtacattcttagcaaatttttaagcacacagcaccgtattgttaactcaaggtggatactgtatctctaagacttattcatcttggaaaaccaaactttgtattctttaactaacactatcttctcccatatctctcctgatcccacccctggcaactaccattccactctctgcttctattaactacttcagattcatcacctaagtggtaccatgtagtatttgttccgtgtctggcttatttcacttagcacaatgtctacaagattcatctctgttgcctgagtgtgggattttgattggcatctcaaatcctgacaatttctgcagtatgtttattgtacgagtttttcaaagatttgccaactgtcccataaaactaatatgcatttaaaataaagtttttaaaaatataacaaacaacaaagtttgagttgggcaggaggaatatattttgagatctactgcacagcaggatgactatagtcaataataacatattgagtatttcaaaataactaagagagtaggtttcaaatacctgaccatcatttcacattgtgtgatatgtatatatacatacacacacacacacatatatatcacattgtaccccataaatgtatataatttatcaattaaaataatattaatttggccaggtgtggtggctcatgcctgtaatcccagcaccttgagaggccgaggtgggcagctcacgaattcaagagatagagactatcctggctaacgtggtgaaacctcgtctgtactaaaaatataaaaattaactgggtgtgttggcgtgtggctgtagtcccagctactcgggaggctgaggcaggagaatcacttgaacccgggagtgcggaggatgcagggagccgagatcacgccactgcactccagcctggcaacagagcaacactctgtctcaaataaataaataaataaaataaaaataaaaagaaacagaaaaatcgaattattttatttcctatgaataaggcatttataaattattgtggaaagtgcctgtataacagaatattttttgaatatcataagtttgatatttatttcaatcatattttggatagatttcagcccattgctaatcatccattctccttgttttatgcaatgtcaaagaccacttcattttgctttggataaataagttttatttgatgaatgctgttgtcatttaaattacatacaaaaaaaatgacacaattacattaaatacatggaaattaaatgcccgtctccttcctacacacccacacacatttacatatctatacctttgtcatgtcatctcttcccacaaattataattttagccattttttctgtatttaaaatgaataattatctttcaccagttaaaacacttttatttgcttgcagaaacgtaatcattttctaataaaatagtagcagacactgcagtaaattctagccagaatttggttattatattaatctcacttcccatcactgaattcctttgcagggtaattagattgctatctgattctatcttgagtccaccaagtcaaggtgcaggcaggtggaaagtgtgttaaataagtgtcctgcttgatgggttctttttaatgccgatgagtttgtgccagtacaaataaaattatataaattactgtcaatcattagaggtttaaaaaagccaggttatttattatgatggtgtatatacatatatgtttatatacatatatatgtgtgtatatatgtatgtgtatatgtgtgtgtatacacgtgtgtgtatatataaatatgtgtgttatatgtgtatatatatgtgtgtatgtgtgtgtgtatatatatatatttggctaagagtttcttataagcatttcatacatggctaattatttctccagctttactatgcacagctatcaacctaagccctactctagctgatcatccctaaattcccttcagaatcctgccatattagagtaggagaaagagatgatacttttgtgtcaagtgagtagagtgagaatatgtcagttttcatatttatagagtgacgtttgacatctttaaagagaagttcctgaccttccctttgtctttttctaaccaagaaaatgtcagccacttccattgcctatctccagccgcatctagtacttctctctattccaaagcttcaacatactcttctgtcattatctgatcatctattggtcttcctctttcatttcaattcaagggaccttgacttatttctcatggttgtcttatcagaacagttcctgatgaaattaatttactgaatgctggaacaattccagccttcattacataaggaattcagtgaaaccttccttaagctcacaactctagtgtcaattatatattataaacacacaatcacaaacatttttaaaaacatgtctgcattataatgtcaaaggtagaaagaaattgcccatcatcgtccaggttgtcttgaccatccttaagagtgccttctacatttcccttccatattttctttaatgatagaaaattgtgtagaagacaatagaagaggaactaccccctctaggtcaataagacttttcaaccacccccaaaggtaatatctaaattgtacaaccagaatttacctgactggccagcatatataaaaggggccattacaaaagtatggcacacaggtcagaatagagatattcttctgaaacaaattacaataaggtcgggtacagtggctcacacctgtaatcccaacactttggaaagccagtgcaggtgaatcacttgagcccaggagttccagaccagcctaggcaacataatgagaccctgtctctccattttttagaaaaaaaaattagcagggcgtggtggcacacacctatagtcctacctacttgggaggctgaggcgggagcgtcgcttgacctagggagttccatgctgaagtgagcagtgattgaaccactgcactcagactgggtgacagagccaaaccttgtctcaaaacaaaaaatgaagaaactccacaaaatcacaatgacctcctcctccacagtcaatgatactagtggtgaaaatgatatgaaattccggcaacttttaaaaataaaatttattcctacaaatttttgttgtcgttgtttattgtttttgagacagtttctggctatgttgcccaggtcataatacagtgatgcaatcatggctcactgcagcatcaacctccccgggctcaagtgatcctctcacttcagcctcctgagtagctggaaccacagtcacacaccaccatattcagctattttttatatttttttagagatggggtttcacaatgttgcccaggctggtctcaaattcctgggctcaagcaatcctcctgccttggcctcccaaactgctgggattacagcatgagccgctgcacccggcccaaaaacatttttgaatctccttaacttgtttctaaatcaccactcttatttccactgaccacttaaacagatgacttgaattagttataaaactgctctggctgtttaatagatttgatataaaatacttttacattataatagatttgttttagatatgagtttttctttttgggaaaatgatattaaaataaattttacttatatttttaaaaaaatttctcattttattgatagggtatgttttaaaaataagattctagtcttccattaattaaaacttgtgctaaaaaattaaaaaggttagcctttcaattttaaataccaaatatagaaaacatacatgttaatttacagaatgtgtacttgataaaccaaacttaaattgagcaaggaacaacatgacgcattttaaggcaaatacataataaatgctaaaatgttgtagcaatattctggctttaaagaaatattgattaaatttattaagactgggctttgtctcaacacttaatggcaactatgatttaaaattaattaaattatgtttaacgctactgtgcatgtccttgaaacctcagtcaaattatatggtcattagctttcatttttatgataatgaaacaaaaaatacagtttccaaaatatatttttcactaaatctatggctaaaattgaatttaaatttctaggtttttttatttaatcaaaaaggaattttacaattcaatcaattgattgaaactaaaacttcaaattagggaggatttaattcaagcctgctattgtatttattattatttaaatataacatgcagacgcctaaactacacagcagacactctattaggttttgtatatatagaatcacacacacatactcccctagtttgtgagaaagtgctctaatattacagacacagattaaagtttagagaaatcaacttgtccaaggttacatagctagttgcacacacagaattttaaatcattcttatgtgactctaaaagaaaatacggaagtgaactgattaactttgcagttaagtttgcaggaataccctgggcaacacagaccctctgtcacagccaaatgttttgtttcgttgttgttccttaaatatgaccaatgctgtcaattctgcaactatattcttgcatttcctcatggctggaaggtctcatttttttttctgtcctttagatattaatcatcctttaaggctaactgagagccacatattcaaagaagacttccaaaccattacactattgaactatcccagcttttacctttctcgtttgggaacttagagactcaacttatggtattattaatactgcctatcctcagaccccagagacaaaacatgctgtctactttctcagtatcctccagagagcatgttatagaaattgacacatagaaatgatctagtcaatatttatttactaccagttgctggtacctggaaacattcttagtagtcttggttttcctggagtcctaatatagtatagtacagccagagacctgtttggttcacagaatttaagtaaacttcttgatcttacggtgtctgctagcatcatgagaacaggcaatgcaatatcttaagaccagttaaaaggaattagttttgagaaaagcttatagaggttacaccactttgcccttcacagaatctttcatttcagccacaaacccacattatcaattccctttataagctgtggatgacttgtcaggaaagatagtaacagtcaaccaataaatggaacattgtctccctaattcattcagagatgtttgcccatggagatactacctggtgatcttgccttacaacatcttgggcccagagatattgctgagattcttgtatttcccctctcatgtccagcattaatgtataagtcaaatacccatattctgtaaattctacacatctaccagtaggcaaggctggagatccaagttcttattatttaatcaactaatcagaaaggaagttctggctgatatttagaagttctgttaacatttcatagaagtaaatgtacaatttcccagaagaaaagtatcttgggaacacagagaccatctacatggacaaaagtaggggctaataatgatatgttacctcttgatattttagagaggcaacattgcttagtgcataagagtcaagacctgtggttgaagtcctgttcaactctgtactctcaatattaccttaggcaaataattaatttctctacacctttatttccttatctgtatctatatctctgtcggttgagttacagagagggtagctatgaccattaaactagatattttctggcacagagtaagtacttaatatacaaattttatatatgtttcatatatcatatataattatatattagagttgtatattatataacaaatatacattatataatgtagtttgcaaataaatattatataatgcaacatgtaatattatatagtatatataatatataaatgtagcatattatttaaaaattaaaaatatgtataaacatatatttagaatagcttacttcaattttatttgaggaactcattttttggctgtccacaacataaggagtaatggattattggtagattttcacagtctgattgtcttttattagatttagatcttctttctttccttctcatttctaactttattcagtttatagtacttagtagtttacaaaatatgtttacatatatcattgaatttgatactcctaagaaccccataagcaaagtatgatctcttattatacatattctatagataagaaactgagcatctagaagttaagtgactgctcaagatcacgtggctaggagtttacccaaagcctaaacttaggtcttctgatttctaatctagtgtttctcctactataatatttcagtctgctttttcctttcactctaaggcttattattttcactaaattcaaattgccttttctgctttgttaaatactagagttagacatttgtaaagttaaacacacacacacatacacacacacacacacgacattaagggcaagatatatacttccaaggtttctgagaggtacagcttatacaaggaaaatcttttgtaagaaattgtatagatctacttattcatgtgctgagtacacattttcaattttgactattggtataatttagagaaattcaattaaaaagaaaaaaataagtactcctctttaggcatttattctgttcacctgaaagtatattcatagccattttttttttgttaatgttaaataacagatccctttccagggatcctttccagggatccgttaagtgcagtccatgttagagttaatgaaatagtaccacagtttcagagataataaatatatgggggtaaggaactcacattgctacgcttttttattctgtttgaagtgatttgctttttgaaaaattgaaaatcagtggaaagctagtgaataagactgattagatgcagaaaaccacttgtgttctacaggtaaattagaaagtttgttgctacaaaaaacatcccttcgaaatgtaggcatacacaatgatttttaaagttgttagaagaagtctgcacatgagctgttcattttctatttagaataaacgatgtgagtggttttgactcctttctcccagtggcccatgccatacttcaaatatgaaaggaaataaaactgcaagctttaaggaaaagataaactctcatgcctgctatatttgcagagtaatcaaggattatggtatatttatcccatttcctcactcctcccttcttgttatttcagtcttcctcatcaaaacacttacttttcactgaatcctccaaattagcttctcatgcatattcaccggcagatcacacagtgactctgtaatggctgcagcctctttgcaattgaggcacagtgggccagacccccaccaggcaggttgcctgttgctggtgtaggctctgggaggtgaacatcagctttgttattccagctgggtgctgcagtccttgaactagcagctttagtcttccttaagatagcatcgtcgttttaatgagagtgaatgcatagcaataaatgctatccaagtcacaactggaattctcctaaggggagatgacctttcatatttttaatgaagatttatctttcaatttccatgaagcaagtggctaggtattttgttatttcatacgaaaataaaaggcatctcatagtaattttttctttgaaaattatttctcaaatttttagacttttagtggaagcgcttttatcttggaagattccactaaaaaagtagaatatttaccactttgggaggctgaggcgggcggatcacgaggtcaggctgaccagcatggtgaaaccccgtctctactaaaattacaaaacaaattagctgggcgtggtggcaggcgcctgtagtcccagctactggggaggctgaggcaggagaattgcttgaacccgggaggcggaggttgcagtgggccgagatcgcaccactgcactccagcctgggcgacagagcaagactccgtctcaaaaataaaaataaaaataaaaattaaaattaaaattaaaaaaaaggaaaagtagactatttacaagatttacaagtaacctagttggattataacccttcctcctgcaaatttatttttctatgatcctagaaaggtcttcatagtataaggattcttttggacttttgtgttggagataacagctaaaagaaaaatatccatcctctgacacacatacatacctcattgtatttatttacttatttattttttattttttaatgaacttatggcttctactttcatagcaactgactagaactacacaggaaactatagacagcaaccttagttatttcctggtttaagtgatgggatgtaatcatactgtatagttgtgaatagataataaaattgcatgacaaaaatgaaattgagaacagacttctgccacccttctgtaataaacagtataggaacaacactagacactagaatgataagaatgtgtcaggaatagcccaatacaggaattcattttttgtctgccttggcatactgcattctttatcaacaaaagttatttttaaaatgtcacataataataatatatgttgtccctttttttaatcttaaaggatcacatgttaaataaaaggaacaattagtagactatatgaataccttcaaagcaattttctaaaacaataaatgtagtcagatttgaaaatcaatcaatttaattatatttgaaattatgatagtaaaaatctatatagtcttaattattagattatagtttacctatcttcattgcatttgatgaaaaactttaaagtagaattatactttgatataatttagttttacttaaatttgttgttgcactaaattatcaagctatattttctttcctggttattctaagtagtgtcaagcacatatcagaaaacccactaaattggtactttaacttttaaaaacagtcttattagtgccatgtggtttaaaacttagcttaattcaaacagatataattttaacttaaaactttttttgggggacggagtctcgctcagtctcccaggctggagtgcagtggcgcgatctcggctcactgcaagctccgcctcccgggttcaggccattctcctgcctcagcctcctgagtagctgggactacaggcgcccgccaccacgcctggctaatattttgtatttttagtagagacggggtttcactgtgttagccaggatggtgtctcgaaaaacattttttatatattaaagtgtttttcaaatttgacaatgtagaaaactataatattttatttcaagaaatgtgtataccttaatccaattagcacctagattctgacctatgttggcacatagtatgatcagccagggcaccagcatcttgattacagaggtgattggatagatccacccatgtcaagcagacccaaatgttttcttttgacttcgggctttccaaaagatacagtagagataacagaaggattgatgaaaggctgaaaccacactatgaacagcatacgtaatctactattaaaagttcctaattagggtagcaacaaaaactttagtcagatctggataaggcagtatctctggctgtgttcttgtctgtttctcctcatcctttttctgttattctcttaatttcctgcagagaggtagacattttagtccacctattttgttaatacaaaggagcagtttctttatattgtcgttaatttactgatcgtataggattatcaacctctttcattgcttaatgttcaaattttaaaaacactttttcataaactatgcttgcttctattgctctaacaatatttgttcctatgttctactctaaattatgcaggtttaaaatctttctcttattttgctgcattcttgtgaagtctgcatacagattcttgattcaaaaaatcatggtttctgtacctcttcctcaggagaggttttacagattctactgatttttggtagacagaaaccaacttttaaccagtgtactacttggaaaaactctttccaaatactgtagaggaaagatgttgggctttgaagccaaacagacttgtgtttgaaacctggttcccatgtttccagctgtatgacaatagcaatttacttcctaaacttaatggagtaatatcgtattaatatttatcccaaggtgtgactgtttggattaaatgagattatctatgggtgtcccaaagtcacgcaaatcacaagttcccatcttgttttttctctgtggttacttctttttattttttttatttttaattatttatttatttatttactttttgagaaggagtctcgctctgtcgcccaggctggagtgcagtggcgcaatcttggctcaccgcaagggctgcctcccgggttcacgccattctcctgcctcagcctcccaagtagctgggactacaggcgcccaccaccacgcccggctaattttttgtatttttagtacagacggggtttcaccgcgttagccaggatggtctcgatctcctcctgacttcgtgatccgccctcctcggcctcccaaagtgttgggattacaggcgtgagccgccgcgcccggcctctctgtggttacttctaatgttggaagtcatcacagtgaaattctttgtgctatcttcaccatgggaatctttctgtttattccatgcccaattacatatatttcacatttcaaactttatcttgagtgaaaagaaagaaggactagctcctgatatattcctcatggatattctcataaaaatttgagtgtttcttttccagtaaagtaagttaatcctttccaacgctctgattattagctcagcacctctatggtattatagttctttttgaaaaatactgcaataattttcattttcataaattcagtggaaactgagttgctccaggtagggtagcccaaagctgactgacaacttcaaagctcacagacaagggcaaaaagcatgtgtgctgctccttgtgaataatactacaggaaaaaaaggcaaaattcctattcaggtaggtagatggtcaaaagagtttcctacaagacagtgtcacgtgcaattttatctacattgttataacttccctacctgacaagacagtgtcaagatttgttaatgagatggcctcacaagtgtatatttaaatattttatgaaaagccattgtagctttctatggatctgacagtagttaaatgcatgagctcccaaggcctatttcaggggctacgtgtatatatctttttccttccaaagacagatgaaggtgtgcaagtcactctactgatttgcaaggacaagaaatgtgctttttctctaattcattctgatattagctattggagttctctttgccctatttcagcactgtttgtacataaatacaccttattactacagaaaaaaattccatgatgaaacctgaagtgctttaatgcactggtctgtagacacagcccatttttttttttctctttacctttgattatcaaggagtaatttgctcaccagcaaacactggataatgtaatatataactttctctaacagaacagaatacagtgagtaggcatttttgaacggtctgttttgatattttggtcccactattctaaattttggggatgcttgtgcggaggtaatgcttaatctggtatcaaataattgctatctgcatctgtgctcattaaatatcattttttaatccagaattttttcctgtactaaggacaaaatgaatattaggccttagacatttttatgtgacatctaaaaattgaagcaggtatatctctaagtaaactaataatggttgatgattttcataataaatgtgcacatttaacattttcctcttcaaattctaaaggttggaaagtgaaggtgaaatcctatatgaaattgtctatatatgctataggttataaatccagattatcattttagattctgtatgttgacatgacatgtaagaactgatgttgtatgaagagtaataataatgatattagaacaaaatgtaatttcctatcagcaatgattagtatttaataataaaatatattaataattaaacattttgaatatagccaaaactttgaaataagaaatgaaacacttaggtaataaatgagaatttagtcacaaaatactgaagtaatattttagctaacttattagcatttagccaaataataagaaaatacttaggttccacttacctaaaaataaatctagtgatgtttccagatgtttagaaaatcattttctttaattaagagatagatacatttctgtgttgtaataaagaatgcaaggagatattttcttataaacctgaaaaagatgtcttctgaatattctggaatctgttttgactcatcggctctattagactttttagttaagtgtctgtttttaagaagatataattcatggtgtactcaaaataatactgttggcagactgtatatgagctgtggaaaggattgcaaactgtaatgggaagtattataataggggatctccactctgctcagatacagggaacatttgataaaatatttcttgaatgaatgattattttacataattattatctagtataatgctatgttttcagataaaaatattttatgtgaaaatatttttatcagaggtcaactttaacgccaccaaaaaattgaataaacatttttgttttgctttcatttcaggtactagaaaattaccttgcatatcattaatagtttataggacttttatttgggaggtagttttcaaaaagttatgatttttgtctagctctgagctctataccagcctctccatcccatgcaattttcatatgtcaacctattaattttgaaacaaaacaaagatgcattgaaatatttctaaatgtccattctacatcgagttctgcaggcgatagtgttgttgcataggcatttaaacatttaaaaacttttcttttctttctttttttttttttttgagacgcagtctcaatctgtggcccaggctggaatgcagtggcatgacctcggctcactgcaacctccgactcccaggttcaagtgattctcccatctcaggttcccgagtagctgggattacaggcgcccgccaccacacccagctaattttttgtatttttagtagagacagggtttcaccgttttggccatcccgacctcagatgatccccccacctcggcctcccgaagtgccgggattacaggtgtgagccaccgcacctggccaaaaatcttttcaataaaacgtgagttctgtgggttgcttggaaaaatatattctagggttctttgaatttaaagacactaagtactctattgcagtcttgaatattaaaactcaaattcacattcacattttaaggtttatgaaaagtcaaaaagtccagaggattatttagtctagacctcttaacctagagctgccaaaacgtatttgagcagaaaatctgttttctctatatttctgttgtcttttttttttttttttttttgtaatccctaaaaacatccaaggaaaggacattgaaaatccctgggaaagaaagcaatgcctcctgagtttgaagactgggtctcctatcttttttctttacagtctcagacttagggatgtctttctttggataaactatttacttccttcattttctttacttgatctttcataatgggttacattgctattaaccaaaactatgaaacatgaataaagctgagaaaaccatcagtcaagtaacaggaaagtgcgcatatttgcccatactatggacatcccaatgttcccagcgggcaggggacaaggaggacatgaacatattctccaaagccaggggagtttcaataacatttttaaagtaatatgttgccattatggttgtcaaaactataatggcactatgttagataaaacagtatgaaaagcaatatcataaaaaagtagataaaggatggcatgattttatgtgttgaattccccaagatatagtacatttgtttttttccttgtgaccttggacaaaagtaacgatattctataaaaatgtggtttgtataactggagttagtgtcaggggtaaaatgaaagttggaacaagcagaaaaagaactatgtatggaaaagaaagaaaggattgtttaacaaactggtgatatgggtttctgtgaaacttgtgtagataagctggaaaaagatgaatgatggaggagcacccaacaaatattaatatataatgtcaacttaggggtaaatatcaagtgttatgcgtctctttgggtccttcgatttctccatttcgtacagtgctttagaaaaagacacacagatgtgctctcctaagttttttgtttggttggtcctttttattttttgagacagagtctcgctctgtctccaggctggagtgcagtggcacaatctcggctcactgcagcctctgcctcccaggttcaagtgattctcctgcctcagcctcccaagtagctgggactaccagtgcacgccaccatgcctagctaagttttgtatttttagtagagacagggtttcaccacgttggccaggatggtcttgatctcctgacctcgtgatctgcctgcctcgaccttccaaagtgctagcattacaggtgggagccactgcgcctggccttttgttgtttttggttttggtgattggacaaagaactctggagagctggagggatgacagaaacattgcctgacagaattatgacccaaagcacaactcaagcatatcaagcgctctgagaaattttaaaatatcatattgaatagtgtttaaatgtgctgtcctacatttgattggaaaaggacacctgcataaagacctaagaatgatttagcggcagtgcacacaaagaggagtcagttatttttacttatcaagcttgcaacagcacagtgtgaggattttgcgttcctgagcctttagtgtcaaattttttgtgtgtaaatccaggctctgacattagctatgtgttcttggtcagtttcctaagtaagtgtttgtcaattaaatcttttcttcatagggtttttcttattttgttaaataggattgttaagtggattaaatgagataggtgtaaaaaaatgcatgttatattatctggcacataaaaaatgtggtttatttcaataacattagatgttattatgttgtcttaattgtttgtatctggaaactttgtttctggatacgccatttaacaagaaatagaggctcactggaacatgctaagaggaaggaagagatacctgtcctatgaggcgtgcttgacaggattcgagtctggagataaagaccatgtctaaatgtcattccaatcctgggattccatgattttagagtatttctccttaatcccttcacttctctgttctttaaaacaaaacaaaacaaaacaaaaataacacgcatttttcttcatagaattctgtgatgagttgtattggtttttgttttgttttattaccatacacacacgttcacgcacacatagagcaaaattatctaacaattccatttttgacataaagttaaattgttttaagtcaggcatgcaatattaattaataccaactggttcatacatacaaaacaattaggccaggtgtggtggctcaagcctataatcccagcactttgggaggctgaggtgggtgaataatgaggtcaagagatcaagaccattctggccaacatggtgagactccgtctctactaaaaatgcaacaattagctgggagttctcgtgcgtgcctgtagtcctagctactcgggaggctgaggcaggagaattgcttgaacctgggaggcggaggttgctgtgagccaagatcgcaccactgcactccagcctggtgacagagcgagactccatctcaaaaaacaaacaaacaaacaagcaaacccaaaaatacaacacagtttcttataaaatgtatgtgaaaacagaatctaattttgtctctctttttctttcttactttcttcttcattttttgaaaggagtgggaacagtagataatgacctactgattgacacaattgctagacttttatccccactaccagaggtggctacccgtgggctccaaatcctattctgaagcatcaggttgccaagcaagtttgcacactgcctttctttcttcctttttccccctcttgtttcccctcatacatttttgtgtcagagattgataagttttgacaaaaggctagtggcttacattaaaaagttagaaccccaaaagccttagcctatacaataactgttcatttaagctctagtgatacatttacaccctggtatgtcagaagaacttttttttctgtcgcccagggtggagtgcagtggtgtgatctcagctcactgcaacctctgcctcctgggttcaagcaattctcctgcctcagcctcctgagtagctgagattacaggcgtgcaccaccacgcccggctaatttttgtattcttagtagagacagggtttcatcatattggccaggctggtctcaaactcttgaccttgtgatccacccgcctcagcctcccaaagtgctgggattacaggcttgagccaccatgcccagcctagaggaattttttaaaaagctaacactttttagtaaatatttacttgtaattaattgtaattattggggaatagatttttaaaaattaaatacttagggctgatccaatcattacatttgtatatttaagtacatcccatttaaacttgtctattactatattaaagttattaaagcaagtgaaacaggagtggtgacttttctttgagggaattttaatactggtggaaaaggccagattgccaacttttaaaactgaaatatgttgtcagtgggaacaaagtttgaaagaaatgtaacacaattttattaccaatgtctctaaggcgataaaatctttctaaacttggtagaaaaatataagaatgcaacttcctagcagccacatggcagttaattttggcaatctgttttgggccattgtaacccacaaatatcaataataactgaaatggcttaaatcttgtctaccgaaaggcttacgaaaaaggaaaagaaaggagagagggagtgaatatgggaggaggtgaagatacaccttaatggtgattcaaggctgcagcatattctgtgtacaaataaataggcttcaacacctgctgatgtgctggcatctggcctgaaagcaaccaacatctgtttgtaattttcagtgggagcccatgacagtgaagaactgtatactgtcactgaatatatggccttgttaacatactaaaaggatccagaagtgagatcatgaatggataatttgggacatgtgactcccatgtgatacggtgataagatttgttgggttttctttaaaggttgccattagagttttatcctgaaccattatttaatagactttaaacgttggaaagtgctttctagaggaaagcttattttaaaagagaattttcccaaccagcttacatcttccacacttttaggggatatgtgttttattggggtagatatggacattgtacaacagctcaaatttatgtaacccccagtgcccttgggagagcccatggagaagaacccagagtgtgagcaggagtcacagtggggttggctttgagcctcaaggcaggtcagaggggtacttcaggagtcctcctcccctgtctctaaaaacgctggagttcttgtgcttcttgattatggctccaattgtgatattttaggcagtaactcaccgttttgtcacctttcctctgatacaagtgctgatcaagttggtaaactcccaggtcagaaaattggggaagactttcctacatttctgttgagggaaatgaggaactgaggccttagaatttctctttaccatttcctcataatcaggaaagttctagagatgattttgtaaaatagtacattcatatctatctcgatggatcatgaccatttttctagtttcacggattcagtgaatgaattctctgttgtaattatttttaggtgtaacactatatgtagatgattgataaaatgcctaactcctaagagtggtgagggctccaccataataactacacatgatacatcattacaatcaggctttcattcagaatttctaaatttaagaaatattacctattatttgataatcttatcacctgccatcattcatttttgcaaatttgaaattttgtatctaacttagattgctgaattagattagcctaatataataaattcttattacattatttttatttaatatttaaagtgaagactatggaaggaatttagtaatgcttttgctagttaaaaacagtatttagttaataaagataaaaacaaaaatattgttctgcacaggggtaaagaggtaggtatctgtgacttctcttttattggcagttaagtttttgcctaagtgctgagactagatttagagcttccttctacagagatttgcctacgtttacaaacatacacattcctttaaaaatatgtgctgcatttcctcaaaaatctaatttttattttttaagaagttcaaaatttaaagcacttctactgtgactgtagaacaaaatagtggtaataattatcaagaatccaacatgtagatttaaacaagctatcacagttttcatctaattagacttttaaattttttttgtttcgtgattaattttaaaatacgtattcagggaatcaagaaaattttcaacttaaaaaaagtggatttctctgtgaataacatacaaaaaaagcttagtataaaaataaaactcttgaatatctacataaaggccataaacaagatcaatatttgtaaagcaatttcctttgctcattaaaaatgcacaaatttaaacacattaatatttaatttcatttttaattataaagaatacaagtaaaaatcaagcatgttcatttttgatggcttttgaaaagtgaagagtttgaaaaaaagaaagtgaaaaaaagtgaagagtttgaaaagtcagtcattttgttttcattttttgactcaggattgcttgggagagataaggacatgtgtatagatacagagacctgggtatggtaagtagtgggagtagaaacccaggtcaaagttgttgcagcatagaagtcatcatccaactagtctccatagacaatcattttaattttctatgcctggttattaattattctaataaaattagttatttgttcctaatttctttaatactgactacttttcacagttttaaagtatcgctaagttatttttgcccattaaataatatttctaagttataatatattttccaagtaccagaaagtaaacccaacaacgtgaaattaaactgtgtaatcttaattgagtgagatggtagttttgcctggagccactagtaaatctgtacttctccaagtgttaattagtgagtctgtattcaattttgctcagagaacatttgaagcactcaatatttaatttcttattatacaatgtctgttgctagaatcttgtacctgcgtcttagacacatgcatgttgttcatcctcagctccagaaaaacacaaccttaactaacatacataagaatattatatgctgtttatttttcaaatgaggtagttaattgttttaagttagattgtgctattttgaaaagaagggattccgtaagaggttacagtacattcagagtacttaaaatttatttctactatattttcttgaataattactataagttggcattttctatgtgctgtcttttataaatatctcccaaacttcattttatctctgctttataaatgagaaaattaaagattcaaagaagtgaatctgttcaacatcatctaacctgtaagttctaagctccaggatatgaacttcaaaacttatactccttaccacatgttatgcacttataactgtgggtttgttactcgctgtagacagttagtaaatgtgaattaagtcagattttttttaaatccctgctccattaactcccctttcaattatttctattttcaatagtatgcttcctattattttccagatgaaaaagtcctttaaatattttttaacaatgtaaaacagatgggcaattccttgagacttgggtctccaaaattgtagctgacgtattttactttgtgtttatttatttgtctactaaatatgtttttgctgggaaaaaaggtctgtccatagtgatataaaatcactctccctagatgatttcattacatatttgatccaacagagaaatttcgggtcttgatacatttcacttgggaaggtacatagccaatatctgattccctctcaattttttttgttgttgttaaatattttctaaacaagtatttttttaattaagtctcaaacagctacttctcaaaattccattcctttctgagctctatagaggaaagatatgataggatctataaacctaaataagcaaacagccattagaaatcttaaagatggattgtattgatgataatatagacacctatacaccacgctccattgactaatgagaatgttataataggaagtgcctcagacctctttgtgtgccaaaatgccagcccactgagaagttaacgttatggtcaatagtgtttgcaaccctccagaaagctccgtaaattgaacagactgttaaccttcacttaagctttcacatcagtctaacgggtgctctgtttgctgctgactgcccgctagagactcactcattgaaagatatgtagttcatcattcatcatttcacaaatttggttccaggaaaagactaaaaattaccctaggcacaagctgtttaatttccaccccctcacatgaatctaacaaacaaccaaaaatacaaacgacattgagtagaaaataagatgtaagttttggtgcctcagtgtcatataatgtaaaggtatttatgtgaaaataacagcttgccttgaagtttcttagtgtacataatattgcagagaataacccctttcacttttaacccacgttctcttaaacctctttctgatcctatttcctgactcttacttgctgcttgtagaagctcatgattctacaattttagatccaaccaaggcagcaagctcaaaattcacccccaaacacactctttcccctcacctaaccaattatatttcctatgcttaaggcatgtattttcagtaagcagttaaaaagacagcatgacttttttattaaaccctaaataatcatatatagcttttctggtttattaatgtatagaataattctgcagtggtagaaatttaacaggggaattttatccataactatcaatttcatactttacctagataaccagaattatgtgacttgtttgttgaaagtaacatgcgttgtatgacttgtttgttttttattgaagtttgcatctcaaatgataatttaaagtttttgttagtgaaagtagggcagtgaccacacctttatataactattattaccttgattaattgctacattgtaaaagaaaatattttctacaattacagaatcctcagaacaactctgaaaacaaatgaggtattatccccaattaaaaaaaaaaaaaagattcaagagatttagtaagtacttcggcaagatctaaatatatggaagcaaattagaaacaaaccacatttttctgagctcaaagcccaaactattttctgcctatttcattatttcttctttcctggcccacactcctgtaagtgtatgtttcgtcttaatatatgatgtttgctttattaagtgcttgtaatgaagaatgcttgtcaattgagatcatatttaggaaatgttagaattgctgatttgttttgtgataaatattattaaaatgtaagctcaaggtaagctggatattttgtacgttttcatcaaagctttatccccattacctaggtcagtctgtgcctggaaaatagcagtgggtagttaataaatgctgaataaatgggatgtttagatacatttggccaagcgacactctcacctcaaatttgtgtgaaaaatcaccccaagaaataaaaggcaattagagacaattgaaaaattaattcagctgatagaaccacttgtcaaatattacataattcagaacaatatgactgaatcatgatgaaggctaaaattctgggtcttaagcaactttaaacctttcaaggaaaggctgattgacaaacacaccttctgtgtttaatcaatgccacaaaacatacggacccaagaattggtggaaatctagactcatcttcagaatggtaaattattcttgagttataaggcctccattgcctaagtgactaaaatgtatgtttccagaaagatttagcattttcctacaggttattatatgcaagaaatgcctttctccaacaggtgatagaaaggtcagaatcagccatctcctaagatactttattttattttgttatattgcaataatatgcaatgcttcagtgttataccaatgaaataaaatgataaattataatagcagtagctgagctttccaagattatacaaattaggtttagaattgaaattttatgaaaacaataatattttaactgcggatagaatattgaaagtgacctatgctgagagaaaaaggagaaaatttaggttacaaaaatatcagatgcattaatccaacataattttgtaaaatggttatcaaaggtcaacactcaatgtaatgtattataataaacaagaaaatgatggccatttttagcaaaaaaaaaaaggattatttgaataatccaattttattttacttagagacatttttcatataaaattagaatgaaatttatgttttaagctactttaatcatacatttttgttgttgaacaggatgctaaggtacagaggaaatcatgcttccaagttgattgccaaataatagtagcattgtctaaactcaactagaaattttgtcaatgcttttttttcttattgcccaaaatgatgcagtgagaattgataagataaggatattctgaccacgaggagtttacaatctagaaatgtggtcatatgcataaatagctgtaatacaataatgactatggcaacagtgaagaacaaaagagtgatctggcaataagaaaaaataagatttctgttccctctaaagaagccctttctagaactctagtgaaagttaatgggtaatcaatctaccatcacaagttaatgggtaatcaatctaccatcacagaaaaagtctagtctggagtgggtgacttcaagaaaaggtttccccatagcaaaatcaagtgtaactttccaaaggctttgagattatattttcacatctgtttttgtcgtttgcatgcatatagaatcacacatttatctctttctgttactgtgctatattacacaaaaacaactggttgggttttctcaagaggatattttggggtgacctgagttaaaatagaggttatatcatcatttaaattcactttgggcagccttagaagacaccccaaagacataggctatcatcctagagaatgctataactgctgataataagggacgtgccatagatattaagatgctaccgggagggaaaataaacagtgatttataacgcaagccctgatttgaaagtcacaaggtcagacacttggaattgcaggtgttgatttgtgatcaagaggtttttcacatggacaactctagaaagccttatgcagagtgagtaacagcacaaaggtactactagaatattggcaaaaattaacccaagcaatgcagagaccagatcactctgaatgtgtttctattttcatagatttcacctagtatatttaggttaaagaataaggcacaatgaaccttccctatctctaaaaaggaaaagaaattttttttgctttcattatcacttttctaaatactgagcagctcgttagtatcctcactctgatctataaatataaatataatattaatatatttatgatattaagtataaatattaaatatagccgtattaatatatctataatatttaatatataatactcattaatagataacgaggcaacactatggcattttgttccctatgttttaatatcttggagatggttatcttgtagtatgttgcagaaatgcgttatccccatgagagcctttggaatgtgatgacaaccatagtgtgggagccgacagagtcactgcttaggtgggaaatgtctaatagaaagaaaagaaaacttagaacatagctttgaggatcttgtattgaaggatggagaagacagcaatctgagaaagtgaccaaaaatatccaggagaaatactgggaggagtgtagggtcctggaagtgaaggaaagagaacgtctcatgaaagaaagggaagcgaggcacagtggatggaggcagctgttggaaacaccacttgaattacttgattgtagttcaatcagttttcaaaccccagtgagggaaaacctgagatgtctgtgggttgaggagggaatgaagttgagcatgagaatctgaagggagaaggaaggcaacgacggctcacagattcctcatcaccaaaggaggggaggtggatcagggaaggtttgggcttagctttttaacacaccattgcagctatttttaagacaaatgtaagaaactcagaacaagagatcgcttataaaataattgaaaaaatacatagtttaaatcagttcttataaaacattgaggtgacaagattaatataggtcttgttacatttttatttttccattgttaagtgtaatgcaatttatataaatatcagtttcctttagcattacttttgcatgaccttagctctatgctttattcatatatgctatttcatataaatgatataaccctttgaaattcaatttagaaaaataccctaaagatattgtgagccatatttatacacagttgtataacactctccttgtactagagctggttttacataacgatttgggattgagttccttttttatgaatgcatttttgaatgccacttctcttgtaggcaagtgtatgggtattgtatatttgtccctgatgtagattataaatctagatttataaggcatcattaggcctagcagcccaagttttcatatctatttcttcaagacaaaatatttcaacattactaataaatcatgaaaagtactaacataaggagactgaaataatttgttaaatgttatttttcaaagtaaaacaatttcactcctaggctttagagtcaggaaaacaaacaaacaaacaacaaacattgtttaaaattatgggttcttccatgttacactgatactaccatatgacaccccgagcttcagttttcttatctgtataatgtggacaatcatcattgcaccgaaagaattcagtcaatgctaatagagtgcctagcgcataggaaaactgtcagaagggtacctttagctgcaagtaatggaaaccccacttaagtctagcttaaacaactaggaaatttatttgctgacataatttggaacatgagctggggaaacagtcatgattgatttaaggagtccactttcctttccacagtggtgcattcctttatttgcttgttgtctttggggtaccccttttatgttggctagttacagaaatctacattcacatcctcgcactacatcattcatcagaagagagtgcattatttccataagctctcttgttgtagtaaggaagctttttcttccagaagccggccctgcccctacatttcccctgtgtctcagtggcctgaccgtgctcacttctgaagcaatcctaatggctaggagaaagccaagggcctattggccaatgttcttaaaccaattattgcaaaggttatgggattatccttagggtcacttttggggttgtaggctgggtcagattcttatgtatcactgtatgaagaagggaatgatactcaaaaatattagagttaaattttgaataatagtagggcactgatgaggcatcaaagtgacacctatatttaacctgtttggggccctattccttcacaccaaagaaggaaaccaaagcataagtcccatctgagccaattcagttcatgcgttgaatcacaatatgttggtggtcctaaaattattggcccaaagttgagtatcttggtgttttgttttgttttgttttgttttgttttgttttgttttttcggagtcccactctatcgccagactggagtgcagtggcacgatctcggctcactgcaacctctgactccctggttcaagccattttcctgcctcagtctcccgagtagctgggattacaggcacatgccaccacacctggctaatttttgtatttttagtagagaccaggtttcaccatgttgtccaggagggtttcgatctcctgacctcgtgatccacccacctccgcctcccaaagtgctgggattacaggtgtgagctaccgcacccggcctaaacctgagtatctttgctctctatcattcccattttcagcacccgagccttaaataaggtaatggaataaaatgaaaaacttgtgcaaatgctttacaacatagttaggtaagtttatctgaaaagataaactaatttcctatatatgactttgttacattattctcctatgagtgtcaagttattttaagaattcagagttacctattaaaaataaaattgacgagttatcaaaataggcctagaaatttagaacatggctaaaactcatctgtacgaaagaaggaaggaaggaaggaaagaaagaagaaagaaagaaaaagaaagaaggaaagaaagaaaggaaagaaagaaagggaaagaaggggagggaaggaaggaaggagggagggagggaaggaatgagagagagagagaaagaagagagaaaaacaaagaattggggtggtcgtgtgcacctatagtcccagctactcaggaggctgaagtaggaggattacttgtgcttgagaggtggaggttgcagtgaaccatgatgatgccactgaactccagcctgggtgacaaagtgaggccctgtctcaaaaaaacaacaacaacaaaacaaaacaaacaaaagaaaacaaagcaaaattacaagctgtaatttcacacctgtggtatattttattttgcttaaacaatatgctttaataaatatatattgaaatgacagaaaaataatattttaaaatgtatctgggtctacacattaagatttagtttgcagtattccaaacatcatttaatggaattaaataaaatttccaaatttataaactaaagaagtgctgctttcttatgaattcccactctaaattcattaatttaagatacatgtggcctttctttgtaactttaatatttaaggaaaattcagaatacttagcctcatccttaatcaaagtgtaataaattacaaaccccaccaaaatctctacctactgaaaacttctaaaggtaggagagagtatagagcctacagctgactccctacaatattctacatagcaaagtgaattaatattaggcttaacataaagcatctgttttctaccattgacatttacacacacatacacacacactcccccacacatatagagtttgttagggttcaccaaaggtaattaaccatcagatgtatattaatcacacacacataaacatgcacacatatgtattaactaacacacacacatttacaacaaaatagtagacagaaaaccattataagtgcagtttggtaactttaaggacctttgatgagaaatttcaaagttggtgacagttcatatgaggaagggtttttcctctgacaatcagatgagctaattaatcagcatttgacccggctggatcttagccagcctaactgttaatgagtgtgcactgttttgccagcaagagcacagtctcttcaaaaaataattgtcagggtcatttttgctatgaacaaaatcttattttgaaatgtgctagacttttttaaagcaacaataagaatgacacgatcattcttaaatatttcttattaaatattatggtaccaccaaacatgagcattgttttatttttttttttttaacaaactcattgctcttcatttatagttttacattttaaagtcatatgatgagaactatttcttccagtttgctttctgctgccaccagacttgataccacaaaaggtgtctgggtgcatgcctgtgatgatattgccaggccgttcctttcttggggcctgtgtatacatgggcctgcctttttattagcacctattataatatatggccattaattattagctgtacatattttctactagactgtcagctccttggaggtacaaaacttatttttctcatttgtacagcctctccgatatcttttatcaacttcatgtaatcctgatagctcagtgaggaactgaggagtggggtcccctaagaaggacataagtctaatttttaaagactaggtgtagggctgcagcttggctctcagctgtgtatgattccaaacaccgaagtatctccacgtcatcaccttttaatcacattttagtgtgatttataagcacatatttggaataccaccacaaacacacacatacaaatgtcattgttatttatatgcacgtatgatggtaatatatatgtctgcaagtttgtgtgtgtttgattaatatacatctggtgattaattttctttttcatttttttttgagacggaattttgccctaatcagccaggctagagtgcaatgtcatgatctcagctcactgcaacctccacctcccatgttcaagcgattctcctgcctcagcctcctgagtagcctccggattacaggtgcacgccaccatgcctggctaatttttatgtttagtagagatgggggtttcaccatgttggccaggctagtcttgaactcctgacctcaggtgatctgcccacctcagcctcctaaagtgctgggattacaggtgtgagccactgcgcccggcctgatgattaattttcaaacaaaccgtgtgtgtatgtgtgtgtgtgtgtgtgtgtgtgtgtaaatgtcaatggtattagaaaatagatgctttacattaagcctgctatggattcacgttgccatatagaatattgtagggagtcagctgtaggctctatactctctcccaccttcagaagttttcagtaggtagagattttggtgtggtttgtaatttattacactttgattaaggatgaggttaagtattctgaattttcttcaactttaaagtacaaagcccacatatatcttaaattaatgaatttagagtgggaattcataagagagcagcacttcttctttagtttataaatttggaaattgtaattaattccattacatgatctttggaatactgaaaactaaatcttcatgtgtagactgagatacaactttttaaaatatttttctgtcatttcaaaatatatttattaaattaaaatacagtctttaaacaaaacaaaatataccacaggtgtgaaattacagcttattatatgtatttttttttttttaaatttactctgtcaatcaggctgaggtgcagtggcattatcactgctcattgcagtctcgacctccccaagctcaggtgatcttcgtaccttagcctcctgagtagctgggactacgagtgtatgccaccacacctggctattttttaaaaatgttggtagaggtaggattttgccctgttgcccaggctggtttccaacttgtgggctcaagctatcggccggcctgtgcctcccaaaatgctggggttacaggtgtgagccactgtgcctggcccacatatgaaattttgaaccaacaatcttctgagctctttttatagaaattgatgtaagatcacaattatttagtgatctgatatattttagctgctgtctataatatttggaaaggatctgcaatattaaactgctttacatttcagttataaaaaaaaagttaaaatttcatgtcactataattattacaggtcacctcattcactgtctttccttttccttagcatccttagatagccacagaacatttccttaaacatttcttgttacttatttcacatactcacaagttcccccattccatttctagaaagcttttggaatgttttataaaacagtatgagcattattgctgtaagaatgctattgaaagtggagtgtaggtaggcttactatacaaagtggagtgtaggtaggcttactataaaaaacaaggtatactaaaacactcactgctataaaaaacaagcctcaaagacacatgcacatgtacgtttattgcagcactattcacaatagcaaagacttggaaccaacccaaatgcccatcagtaatagactggataaagaaaatgtggcacgtgtacaccatggaatactatgcagccataaaaaaggatgagttcatgtcctttgcagggacatggaagaagctgcaaactatcattctcagcaaactaacacaggaacagaaaactaaacactgcatgttctcactcataactgggagttgaacagtgagaacacatggacacagggaggggaacatcacacattggggcctgttggggtttgggggataggggagggatagtattaggagaaatacctaatgcagatgatggattgatgagtgcagcaaaccaccatggcacgtgtatacttatgtaacaaacctgcacgttctgcacatgtatcccagaatgtagagtataaaaaaaaaagcccccaaatatataatggaatgttgcaatgtaagtttatgtgttattcaagtgagattaaaaatgtgtgttcctggtttgcagaaggcaccctccacatgatagaggaagcagagttttcctttggttcctctgcatccacatagtataccaggaagagaaagaatagaatagagcacaaaagagattttcatgagcttttgtagaaaaagcctgagcccctttcactcacattactttggccagaactcagtcttctgactctgtctacggaggaatgaattttagctgtgtgccaggaggaaagaagaacaggttcatattagctttccggcttcgttgtcttctcacattttgttcccaccacattgacttttctgtttgttcgtttgttttgttttgtttccagaaggcactacagggtcatgccacaagttgtttcttctacaaggaatgcggaatgcttcccactttatgcaggttacccagctgacttctatttttcatttaaaactcaattcaaatatttagttatcaggaatgtctgctctaatatgatacatattattattcataacacacaatttcaacatcagtgagaatttttttgatgaatgtttatctcccgaagtagactgcaagtttttaatgacaatgatcatgcctgtccaccctccattattacacagctcctatcaaagtcaatagaatatgaaattatgtttttaattaatgaaagaaaactccaccctccaactcttaatgacagtacaggttgagcatacctaatccaaaaatctgaaattcaaaatgcttccaaatccaaaactatttgagtgccaccatgacatcacaagtggaaaattccacactggaccttgtgtgataggccgaagttaaaacacagatgcacaacacaccatttattcagcatccccaaagacaaagagattctctcagcctccctgagctgtgatatgtttctgtgcatgcccaggtttccccatgcaatcacgcccacaaatggtatcacacagcatggtaggcagagactgaaagcttgccattcttgattgttgctgttctttaacagctgatacaggtattctggtgatgctactgtgttagtcagttatcctggacacattgttttttcttatattaatggtatgttagatttttttactgttaagttctgacatgtgactaagcataagaaaatgcttgcttattggtagcatataaattcagagtcaggaatgatagtgagagaaaacaaccacagagaaaacagtccacaggtgtggctgagatagtgatgcctctgctttctgatggtgcaatgtatacaagctttgtttcatgcacaaattatttaaagtgttacataaaattaccttcaggctgtgtgtatatggtatatataaagcataaatgatttctatgtttatacttgaattcaatccccaagatatttaattatgtatatacaaatattccaaaatctgaaacactttttgtcccaagcatttcggatgagggatactcagcctgtactcccatacaatgaggccttaaccacagaagaaaacaataggttcttcaaagaaattggttgtgacatttaaagggtcaaaatgggtggtaaatgtggaataataattgagaaatgtaaaataattgagaaaatagccaagaatacctgagtatgaaaatagatgtgaaattttagcagtctatcaataaaatcttgatcaaacaccacttattcagctgccatatatgagtgtcaatgaggagactgtagagcagttagcatgatttttacattcagtttattaggtagaagaaaccctgcatccattgtcaacattcattctgaatgcaatgtcactatctattttattggcttctttttcccaatgcaatatttgtgatgaagtgttccccaagttatgcttttatcttctttgtgtccatctaattctttgtgggtgatgtccactactctgacagcatcacctatcataaaatgctctggatctataattccagtcctgcctgagtcctgtttctgcattttctttgctgatctttactcaaagatgctctgaattcctctgaaacttaacctgcctcaaattaaatttaggataagacttctccttttcaatatccttctcctccagtattctctgtgttaattcagagtatcaccatccatcagttatcaaagccaaaagagtcatttttcatttcctctgacccatttgccatgaccaagagaagaaagagcttcagctcctgagcctaggatgtctgtttttgccaattatgccaatccaaatccggctgtcatgaaacctggatggaaaaaacaaagccagtgccagctctgttcagtaggatggaaaatctctgtggcttggtagcctcccaggttcctacagagaaggttcattctgagatgaggatctctgtggcatatggtcttcaggaggagaatatctatgagaaaagagtctccctaaaccagaaaaatgagaaatgcaaagaagatctggacaaggcagtggtggaagtgtcccctttagatatttggttagtgctggcattactgcctgtggaccagatggtcccaaagttactacacactgcactgtatgcctgcctgctttcctgcctgctccagagtctactgagaagctgtattatttgtggatgtatgtgacacagtctctgcactgtagttataagccatgtgtcgctccaattcctaagaatccagtcattccagagattactcctcatacatgaaaatcctccagattcctactttctgataaagaaatattattgtgaacagatcagaaccaatgtaggaattcaacctcaagttcaaaaaaatcatcttctagatcaaaatgaggaaagactgcaatttaccattcaaggcaaaaatatccatatattgtaccagacacctattaacttcaataaggatggtcccaggttcaagagtgaggagaagagacccacagccagtgaatgaaacatggggtttatttgatggggacatacgggacagtccagtggtggcaggctggacagaaccgctacagcttgcaaactgcatgcagtttatgtagcattttcacttagcaccctctccttagcaacctccaggttaacaattcatttcttaagttgttattgctttcaggtatgtctgccatacagggtcgttctcggggtatgcttaagttattgctgtcaggtacatctctcataaaccatagtaatccagaccaagactgctcccttccacaggccaaaacctccaacttcatctttctctgtcccttgcaggggtatagttaccctgtttactatgtttattattattattattaatattattattattatttatccctgactggtgataccctgaaagtcttcccacctgagagcttggttattgcttccaaccccgggtgaacccctaagctagaccagtccgttagtgaccagattccagtgaagaagggggcagttggcttgcatatatggttcatgttgaaccagcccttcatgttcctggagctcccactaaggggatggagaagggatcaggaaagagggttgaatgaagaagagaaacacgtataaatgtaaaaacatgcatctgagaaaagaatcttagccccgttcttaaattcagaactctatttttgtgcttttaaacctgtcagtcctcagcgtcactccctccaccactgccatctcagccctgaagcttcctggtttcttcacagaacaaagatcagtacttggaatgtggcaagtactcattaaatgttttggattgtgcaaaacagtcacaatcaattggtacctctctattaatgctcccccacctctgtatctctgctcatgctatttctcatttgcaatgctcatccctccttatttctcctttgaagttttattaatctcaactgaaaaaaggttttcttcttgaccaaactccaatcaggcttccctgaactctttttcaactaggcctgacttttagacgcctgtgtttgtgtgcattgtctaattgcagtaagaatcttgcagagttggtttaattttagcaagactcttgcagagttagtttagccaggttctcccatgcttcatatctgatcaccatcaatatctaattgggttccccaccctccactatcctccaggtgatgtgaagggaatgatatctgatgaccctggcctgtcttcagcaagaatcctcataggttagtttaaacagaattcctccttacttctaatgtttcttctaagtaattttccatccactgactcacatcgtgctttttggctgtaattccccctcattcatgctgtatcaggaattgaacccagttctgttctgaggtcccttttaccctattgcaataatactgaatagaatctgtttctattgccttaactaccgtccagttctaatgttatttgatacaataatccatcttgtcatgttccatatgtagccttccaggcttttccagatgagcctggcttggtaatcattatctcttctaggatcttacagctctatttggtgtttgcacgtctattactttattctataactgattttcttactagtgtttacacacacacacacacacacacacttttcataaatgtgactccctataacccaatatacattttggtatatttggatcattgagtaaatacattaaactttttgttttcttttttgtctcaaaaacttacaaatcatctggcttttaggaggtgatttgtacacaaattacataaaaagtgaatttctttcatggtgttaactgttgagaaaatcttacgccaaccttttcaggagccatggtggttccgagatgctttaaaaataaattaccaatcctctgtaattttgcgtcctctcatctcacctactcataataaatgaagagaagatatgtcatgcctcacaggcaatcatatactgataaatatttaatgactggctctcaaaaaatattaaaaataccaatttgtagtgtttgctgatttttatgatataaatacacccaccatgacagatgcctaattaccaacatgacaacgctgaccctggagttaggaagaggtgtgtagtgacacatcatcatatctttaccatccatatatgatagctgtgaataaactcgaggacataagtcatagtaaaatccaatttttaatgatggatatgtttaaccactggcttgaaacttcctgatatttaattataagctctcaaccactgtgtgggttggctccagcacatcagaaaaatggattgcagcatattcagattatataatcactctcagtagcataacaaggatattacttggcataaaaatttcataaattgattatagacccgtgttatcaagaaacatactctatatattatttcatcactagtgttccttgaaactgaattttacaaggttctaacattgtcacatgcctcaaatcatcctccaaagatactaataatctagttattgagttatataaatgtataaggaaggtacgtgggaaaaatatataatagtatgaatacatggaattatgttgatcatgaccattattccttaagaggaatattatattttcagaaagatttgaagaacttaaagcttatacctccagtggcccactaattcacagtctaaaatgacagaacatgataaatttcaatatcttatacaatttctcatagcctctggcaggagcaattcttgaaacagtaggtggaaatatactcattaagctgcaaaattgcctatattcaggacacctgccaagcaagcattccctaaattaccacctgttaccataacatcaaagacatccaaaatacttgcttactaaatctagtctccctaagtatatataattttcctataatgctgcttgatggtagagcagtatcttaatttcatatacataaatcaaagttgtttctggacagctagggctcgaacctggttttcaacagctattcctgaggtatagttgatctttagtgttctatttgatgttgagttatagtcacactttttaacttgtccaggtgtaaatggtagttgctgaggcctttatataaagcaaatttactatcactgatacatgaaagaaaatcattttactgatattgtagcactgaaagttgtcaatggattatctaagatgattagaagctgtggataaattagtagtaggccaatatattttgcttgagatcatgtgtcaatatagcagcatgctccggagcagacatctataactaataatcatataaattctgctatatatgtctatagtcagtctatccacatagattttcagtcactgttacattcagtaaatagaatgtaacaatatcatgtggaaacttggttagataattctgcaagacatatcaaatggatgagtgataagaggaaaccaactgctttatgacaagctgaggtggagtgaattggtacaaggacacccagaagcacaatgtcaggtgatgaaaaggctgtgtaataatgagaggaaacagtaataggagaagaggaaataattagcaatcagaaacatcgtgattagaagagtgcataggttatgagctgatgaggctaagccctaaacaccaccactttttaataaatgtgcctacattattacccaaaaagagttctttcaaagaatttttggccacattcacccccccagcctccaagaaagagagagatagaagggagacagagagagagagagagagagagagagagagagagagagagagagaaattgttgaggggctaatgtgagccatggtggttttattcatcactataacagtagtttagagactacaggttcaggggccagacagcatggattcgaaagtgagcaatatcatttcttttgtgaccttaggcaagtgacttaaactctttatatctctgtttcctcatttgtgaaatgctgattgaaatgatatcatatttcataaggacattgtgagggttaaatggaataatgcaaagaaagcccttggcactgcctactgtgatgaaactgttccaaaaagtcagctattattttcatccccactgcctaatatgtagggtgtcagtaaccgtaaataaatgttgaggttgaatgaattcacattaccatccaagatactttcaaaaataaccaggaaaaaaggcatacatccctttagaggaagatgaagaaaaatgttattgcagcacgggagagcactgtattcttattaaggagtttatgttctggatagaacttcataggaggcatggcattgatcatcactggtcttttatcatcattatcattatagtttggtggccgttgttggcataaatcaaaatcatagaattgtagatttggatgagagtgtaaaggttatttagtgtgctttactataatacgatcatctgctataatatccgtgagcatgtcacctctggtcacgtatccacagagaataatctcattgttggctttagaaataaaataaatacctgagagtccataatggcaattttaaaaaaatgaatacattgagcataaccacaagcataaattatatggcttaattattttgacacgcacacacatacacaggcacatgtataagttttatatatagaagtatatataaatgtaatatttgccctttcttggtgctttacataatactcatgcactgtttcactaatcctttgtcttcccagaaccttagttatatttagcaatgttatttcacaatttacaaaagaaacacaacttattttgactccgacattatggacatttctggggatactgctttttggattgagttctaaagttggacataaataattagatcaacattgtggagaaaatatactataatttaaattttacgttgttatttttattaatgtgggtacaataaaataataaacatgacagcattaattaaactatgaaatagcatctcacaaaattgctaaaattataacaatcagcaaaatcctctctactccgaacctcttctcctagagtcacatgcatcttttggctcctgtttctcctctgaagaacactgcagccttacaaggtcataactgtttcacctcctttaaacttccaggcatacgcatgctcctctcttcagtcacactcacttggataaacctcagctcacaccaaatccagtccctgcctactctgtttaatcatggaggcaactaagtcaggctggagaaaaacatgcaactttgatgacttgtctcactgtgtttcacgaccattgaattaaatgggctgtttctgctgtctgggcaccatcccattcataaactccagatgtcaacacagcaattgtctcttcttttttctgtttctcgattttacctttctactctatcacttccatcgtcataataacatgctgttatttttcctttcaaataagaataaaaaaaaggaatctcgatctgacaggctagttgagttcctgcctatttctctgcacgtcttttggtagatctcctggagagttattttttatactcactgtctgtactgtttcctgctgcaattatgttttgaacacctcaagtttagcttttgtgctcactactctatcaaaatatgtcttgtcagtgttaccaatggttttcacatggctcagtccaacagtcaattcacattcctcatttatggacctatcagaaacatttaacacagttgtcctttttttctggaatacttttgcttggcctctggaaccccttccctatccacttctttactgtctcattggctggaacttcttttcctctaaaaattagagcgcctcagattttctttctcaaacttctctatgtaaatcactctttaggtgatctcactcagcatcatggctctaaatattatttatattctgaggaaaaaaatacatagatacctttactcagaactgtttcccaaactccacattttcaaatccagacttcattttctccacttcagtgatgtaaattctcaaatggagaatgcactaaatgcactaaaaatgaaaatccttccaattccccaaaagcctctttgttccagttccccatctcattaactgacaattccaaccttttagctttggtcaaaaatattggagtcagtcatttttttcccttcactccttactttccctgtcatataaaaaataactaatcaaaatatatgttgtctctgccttcaagatatgtctagaatctaattacttttgcactaccaccattgggcaagccattttctcttacctaaattattgcaataacttgctacctgttttctcttcttctgccttgaacccatgaataatctatgctcaatctactagctaaaataatcattcaatattagagacacattgtgtctcttctctactcaaagccctctaattgttttctgtcaaagccctccaattattttctgtctcactcataataaaagccacaggttatacaatgcctcctataagtctaacatggtctgggatcccgtatttcctctctgatctcattgtgttctactcttcttcttgctaggcatattctacctgtgcctagaactatccactttccttcctccttttatgtctatacctaaatatatccaccaatcaggccatttccctgatcatcttatagataaaaatctgaactccctttttccccgccgcccataattcttctcctccttatattatgctttaatgtattccagcgctcacaacacttggcttaccatcagctttttggttgcttgtgtgagccctctcacacaaagtttagatagctatagagacagagagccagaaagacgacagacagagatagatagatagatagatagatagatagatagatagatctctagttttatgtactactgcatcgtttgtgcttacaatgcctagaatataagacactaaattttttgaatgaaatacttaagaaattaattatgtactctatgcttttgatggcattctgtaaaactatgtgtaaaatgttgatttatagagatttatatttcccgttaatttccgttatgctttctgaaacatgtttctctggggagtgaaatgaccttaaacatacttaagggttagtctaacatttatctttgagagcattttctcttcggaagctggccacctagacacattaatttttcccacacaatactggttaaagaggtatttcagtggctagcgatcctcaaccattcgtaagcaacactccataatagtcagttttcaggagcaggaaaatgaaggctaatcctagggcacccatgatacctggctgtgctaagtagcaaaattacgggcattttcttttcattacaactcacgtactgcaaatatgttatctgcattttgacattaaattatattgccacataaaatatgtttaaataatcttatttttgttctcattagtacccaacttaaaaatacttacaaaatagttaataataaatactttaaaaagacgttttaaaataaataaaaataaacactttaaaatcgctcacaaagcactactttcatttccgatgcattttttctccattttttgcacacataatcatattctaaaaggtgaggtggaaagagttactggtcctaaaatatctgtttgtaatgttttgattatacttgtgctttgggtgtgtacacgtttacatatatgcatatatgtgtgtttgtatccaggcatgcgtatgtattctgtacctttttagtacttgtattgttgcatcgctgaatacacaatataatttttacttatcctttttatgacccatttgacctccatgagaaaacatgtggcatattcccttattcatctatgcatttccaaaacctagcttagtacttgacatataatagctggtcagtaaatttgctttattttatactgaaatatattgctctaagccagattttcacaaattgttatgagagatatagtaattctgcaatatgtgagtaataatattctagggtttcacatacagaataatctgaataatgaactccctcttgggatgctgtaatgttcattaacataattatactctctaagaaactaaaaattaccaacaaaaggcaatcgttttaacactgcttaagatataaacaactaattttcccatttccttttttaaatatatctcccctgatatcttaattttagaagcagattgcattatgataaatacttacagagtgactagaatattgtttggcatagatctaggttgataatgacattaatgaactttgcaaaccgagttcaattccagaaatgggtactgtacttttctgagaaattgctatctcatgtggcagataacttatatatatgaaaaagtatagtaagaaatttgaggaattttgacttaaatgtgtgaagaatttttataattgctgtgcctacagtgaaaatggctattttgtcacctaaacagtcagggagaacttggaaatgtgaaagtccttaaaattctactgcttactgtagtctcagtatgaaataatgtaattatgtttacttgtaagttatcctatggttgcagataggaagactcgatactataaatatgtcaattcttcctatatcaatccatatttatgttaatataaaagtaaaaaataagccaacagtgtgtttgaacaaaataagcttattttagagtttatatgataaaagaagtatgcaaaaaaatctgcgaaattatgttgaagaaaaacaacatgggagagctagctctataagatattaaaacatataaagtctcaataaatagaacagtatgatactggttcaaagaaacaaaacaggaatatgtgcaaatacataggaaaaattattatacataggaaatggtatgaatgcaaaaaaagtagaagaattaagttgactccatataccatttcttatacaggcaaaattccaagaaaataaaagatctaaatgaactaaagtggtagcaattagaagagtgaatataattttaaagaaagtaaaaaaaataaataaataaagattgaacccaaatggatgtacaaagcattcaaaacaagaatccacaaaaacttgtaggtaaagacaaatgttttattttgggaataatgcagaaaatggtatcaaaattgacttgagttaaataatcaatttgaagttgtggaaacctgaggatgtcatatgctcagtatgaaaactgggtttgatgttagggaaagatgtatgttaatttgcacggagacccttaagattatatgcggctatagagggaaatgtggctatgatcttaaggatgagtttttggcggcatccactgaaaagatgtaaaaagtaggagagtaacttgagtgcatagactaggcatgtcaagacctcaagggaagaggtagtttgaagaatttattaggtgatcaacagcatctaatgttgcaataggtgtttattcatacagagtaagataagagatagaaagacagcaaaggaaagaacatgcagggatattgcttctaagttttccactatgactttcaatgatcttcaatttccatttccacaaagaatgtttacttgatatttaaaaggaaattaattgtaggcatctcttatttcctttgtattttaatgagtcatcatttcaaaacttttgtcacatgtcagtgttaaatatgacataactacgttgcccttgatactagttaaaattaaattttttactgattggaaaatacacatagtgatttatttcagagggtaaaaaatattatactaaagtctattaagaatcagttgtgctaggagtctccttcaatgtgtttcaaatatttggtgtgttccaaattaagacagagtggagaacgaaaactttcaagtttgaaacaccaaagattgtataggatgggggagaccaaatactattaaaattcaccagggtcattctatcttggaggtctcttaggaatccatgttccatctcttccgttattcccagataacagcatgattttgccattgtcttcaatttccagatgcattagaagtgtggcaagatacaattagagtgtgtaacttaaatgctagtaagacctattcaagcaagcatagggctctgcacttacagaaatgtacaagtaaatctaatttactaaaatatatttagtacatgtaaatttaaaatattgcgatagctgggcgaggtggctcacgcctgtaatcccagcactttgggagaccaaggcgggcggatcatgaggtcaggagatcgagaccatcctggctaacagggtgaaaccccgtctctactaaaaatacaaaacattagccgggcgtggtggcgggcgcctgtagtcccagctactcgaaaggctgaggcaggagaatggtgtgaacccaggaggcggaacttgcagtgagccgagaccgcgccactgcactccagcctgggggacagagtgagactctgtctcaaaaaaaaaaaagatacaaacaaatggaagaacattccatgctcatgggtaggaagaatcaatatcgtgaaaatggccatactgcccaaggtaatttacagattcaatgccatccccatcaagctaccaatgactttcttcacagaattggaaaaaactactttaaagttcatatggaaccaaaaaagagcccgcattgccaagtcaaccctaagccaaaagaacaaagctggaggaatcacactacctgacttcaaactatactacaaggctacagtaaccaaaacagcatggtactggtaccaaaacagagatatagatcaatggaacagaacacagccctcagaaataatgccacataactacaactatctgatctttgacaaacctgagaaaaacaagcaatggggaaaggattccctatttaataaatggtgctgggaaaactggctagccatatgtaggaagctgaaactggatccctcccttacaccttatacaaaaatcaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcccaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagataccatctcacagcagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgtatgtttattgtggcattattcacaatagcaaagacttggaaccaacccaaatgtccaacaatgatagactggatgaagaaaatgtggcacatatacaccatggaatactatgcagccataaaaaatgatgagttcatgtcctttgtagggacatggatgaaattggaaatcatcattctcagtaaactatcgcagggacaaaaaaccaaacacctcatattctcactcataggtgggaattgaacaatgagatcacatggacacaggaaggggactatcacactctggggactgttgtggggtggggggaggggggagggatagcattgggagatatacctaatgctagatgacgagttagtgggtgcagtgcaccagcatggcacatgtatacatatgtaactaacctgcacaatgtgcacatgtaccctaaaacttaaagtataataaaaaaaaacaacaaaaaaaaaaagaaaaaaaaatactgcaatatcttcccgccttttacactgttttttaataattattttatatcctttctaaactgaaagttccatggacatagagactatgtcttgtttctttattgtattcatttcactgtatggctagaaactagggctggccattttgtgtattattgtacttgttccatatctcatattatcagatgattgatattattatcatcattgttttcattttaccaatgaggaaatggattcagagattaaacaccttgctctggatcaaacataactcttactctggaagccaaattcttagccacctcatggtgttgccctagtacctcaactgtattaatgcacttagtatagtcatgttatgcagaaaaaaggactctaagatggtggagggtctcagagccaagttatgtcactaatgaactacagatattcaatgtaaattcaggaagaaataagagaggtatgtaaactctcatgaatatttgaggtttgccatatcatggatgataataatcatgctgaagtattatttctgttagtattattattttaattattagcatttgaatccacaaaaagaagatagaatgaagtgtggtagatgtaacacattttaattcaatagtgagcatagttgaataactggcatagtgatacgactgatatgattcatctttactgctggtgactaggcagatagtagatgattatctgtctcgaatgctgttgaaaagtctaaaagtgctgagctaacttcttccaagtgttatgaatctatggaatttagtatagtgctcaacatttatcatgttgagaataagatttccattgacttgagaaaagtaaaacataatctataaggcaggaatatcagctgttgttattccctaaggtcaacttaaatgtaaacctctgatttacatagaacattaatatgtatgtatacatttttagaagcagatttgattgcagtcataaatttgctaaagtcctaaatgcattgttggcatccaaccatttactgttttggcataattattaatatacttactattattctgcctatgaatgtgaatgagtgtgatatcagaataattagaatgagtcatattataaatcctctgtccaactttgaattatattgtatgtatgcttgagcattatagatgtaaaaagtgacatgagttctacatggaatataatacaagtattacatcaagacattttcatgtagattattttagtagtcgtagaattttactacattgaaggaattgatattatgacatttttgataggcaaaccaagagtgaccctttcaaattgtacaatgtcaacttctatgaagaaagataattgaatattgttatttgttatttagaagattgaaaaatttcagtcatattgtcatagtctgttgattgattaagcctagccataagtctataacattcatttttatgttttgtctcttttgtatggttatgtggaatcgatgctattactttgacctccaatatttaattcaacaagcagaaatataaccttttcacttgacaaaacccacttattttgcttgagaaattataaaacaaaaccagcaggtgcctgagattcagtacttgaaattatcatttaaagcaaagtgtcttgtatggtttcaacattgttcactccattttctggcagctgacactcatttactctcaacaagtgaataagcagtcggtgagtgtccctgatgtcaaggagctgtcataatttccatggagttagctctgtttggcattacagaaattcactgtgatcctgctgacaactcttttgtatagtcataaagtatacagcagaacagtttgtcccagggctaaggtcaggctttttattttgctattatgagaaatcaataaatacacaatactatttatcttatttattctaaggaaggaggagaccaaggcatattttcctccttctaattcaaaatatttctaacattattattagattagtactgatgggtcagtcagtactacaggaaaacaaaatatgtagaaacagtgatagtctgtcaaagtttcgagctaatttcaaacagattgggtaacgtttgaatcttctatggaagcattccccaatgtttaatcttcaagatatctctgaatttatcttcatcagatgttggatatgtcccatgtgtccaatgatcacacttctgcttgacttccagccccagcccttgctcctctacctggagttgcttccacttcacacacgaatgggcatttaggctgccataacccaaactcaacgagcctaaaactagatgggccatcttttgtttttctttttaaaatttatgtttttattattattttttgagacagggtctttttctgtcacccagactggagtacagtggtgcaatcatggctcactgcattctcaatctcctgggctcaagcatttctcccacctaagcctgccaagtagctgggattacaggtgcatgcatcatatctcgctaattttttaaaatttttatagagttgggggtctcactatgttacctaggctggtctcgaatgcctgggctcaagcgatcctcctgcctctgccgcccaaagtgctgtgattacaaacatgagccaccgggcctggccttcaccatctttcttcttaaatcacttattaacttgggatttgtcacaattttatcatccaaacctaaaattttccctcatgtgcttccaaaatcttctgaatttacatattctcttaatattctccttcaagtttaccatgcctcagtccctttacttgctttaatggtatttattcctttcttcattttgtaaaaaggacacattcatttaaaggaagcagaaaatgcagaaagattaaaaggacataaaaaccccttgcaatgttatctatatttaagcattattaatatttggagctaaacttcatgttctccatcttttaatgttaaactaaacaaatactttataaagtatttcttgatcatggcagcaggatgcattctctttttcttgctgcctgtcaatatcacttgagtggcatatacagtcctattgaagatattcgtgcaaatatattgttcctttttccaggtttaaaactctttaaggccaaggcacatgcttatacatttctttgtttaagacagatctggtacagtgtataatgttaattcaatatttgttgaatgaatatgcttaataattcagatctatttgaattatcaccgtgaataaacaagtttaattctcttctatagaatgaaaatatgtgtgagtaagctggttaggaggaagtgaaattttttattcagttaataatgacaatacagattacatgcttcagtgaagcaaattcctttgtataaagtacaatacattgttgggttcacaattgcagagtcataagaaaatgtatttctcctcatatttctctcttacagaatgtaccattcaaaataattgatgtaagtataaagaattgtctttttgtgctactaaaatttccactacttattttcatttgtcttcccagcacttcttctgatcaattgtatatttttaaggcttttggtattcattgttgatattccatttcattttatatgttctatctctaacaatttcatcttttttgggggatgatctcccttttttctgtgtataattttaaatttcaaatttcactgtctcagcaacatgtagtgtacatacctcttactttctcctaaactagtcagattgcatcctattttttgcagaaataattcaaagtttttcctctttataaataaaattatttccaagttagggaaataaagacagaaatccagccatactaaataagtagtactatagaactgctttcccaagaccatgcatacttggagacactcaaggattatggcatttgtcagtccattttattactaggtctcaaaaatctcatttactatttcctacttcaaatgacccaagtttcttcacattgatcatctaagttttgcattctttggttagagtttcatcaaaaagcacctagtgttgcactcacatgcatcttattctgatgatcaggtggtattgttttgtcttcttctgtagtgagcattatcggtatttgcacccaccccatagctgcagtagtatttattcacatttctaattttaggattgtggaatttttttccatcacaaacaaataggattttatatttttcttccacatagtccaagggtcattctgaaaacaggatttctcatgtgtcaccccaatactgcactgttatagtattctgctgtgaatactgtgactactaattcactatatctacatttgaaaattgaaacatcagtctgtttgctgttcattttgtgacaaacttaaaacacttgagctttttgaaggtcttggtacatgaatttttatcatatacctaaaaacactcagatactactgctgagagattttgggccatggtagaggtgtttgtccaaaaatagaaaaaagtaattggttaagaaatatatacaagtaaacagaattatttctaggtaagttttattctactcaataatacaaaatgcactttgcatggcattgttgtgagatgtccattataggccttcctacatttgattagaaaaagttatcataattctagatagtataggaatcagctggagatttcttaggtctaactccagaccagtggttcacaaagcatgcttataagaccagaaacatcatcacctgagtacatggtagataagtaaataatggtctgcaccccagacacagcgaatcagaaactctgagggcagagctctgcaagctgtgattgaacaagtctcccaggtgagttccatgaacactaaaggctgaaactcggcgagaaccattgtttttaaccaattaaaatacaatcttcaggtgagtcatatacactgccaaaattgagaaagcttgagaatcaccgaataataataatcatcattttcaggtggtacttggtaaatttacaaacatgtaaacctgtgggatttgcctagccagtcacacatttattaggattattctcgtgtagtcgtctcctaggagagagcagagccctgggtgataggaaaggcttgaaacatgagcagcacccaaacagagtagttttggaagacttgacatggcaggaaaaaggtgcacatttgacaggtaaggagaacctgcatgttcggaacctaaatattactggctttgttgactttgtgtttgtgtgtgcaaatttggagtgcaatgggataatgctaaaaatgtggcaagaatgaaaatactagagcataatgtaggtagataatattaaggtcagaataaaggaaaaatatagggaattcagcattagtgaaagtagttaatttaatattctactatcatctcaaaatatgacaatattttaaatcccatttttgagacatgattgcactttcttcttaatagctcctcctctaataatcttgatttatatctatgcaaatctagacttctaatggttccggttgttttaaacatgtaatctggtctctgaactcaagtagttattctagatttagaaacagtgctagtcatctgttagcactttaacacgtaaacctatcctgaattggaatatgttttgaaaatgttccatccccagagtaattttgttcttgccttgagcccctggtgccccaatgctgtttatacattaatttagtctcttatatgcttaagaagaaagtatatgaatgcaaatgagaaagtcccaacctctgggatttgaatctgaaatttaaaacaagctaaaagagcatcagaaatggaagcaggattaccaataacatttatgatttaatgatttcaggaagcattaaaatgatagttgtgtatttataagcaaagccgtttatgtattttgcttttacttatttcatttttgagataaggcctcgctctgtcgccaaggctggggtgcagtggtgcaatcacagctcactcagcctctgcttcccttgctcagcttcctgagtagctagggctacaggcgaaccccattaggcccagctaatttttgctttatttttttgtcgatacagagtctcactatgttgcccagtctattctcaagcccctgggctcaaggaatcttcccccttcagcttcccaaagtgctgggattataggcgcgagccaccgcacctggtctattttgcttttaaagttaataaactactagtgttttagttggaaaaaaaattctctcatgttatttgtagaaatgctgtagaagaaaaaaatacataatattatataaaatttgctgccttttcacatgtgaaagtatttgaggtctaaaatcaggtatatctgagggcaaaaaggcaaagattcatggtcattgaaacaggaatcttaagagactgtatctacaaagaacatttcttgtatatgttgtagacactttagcagtaaaattttctattttgttctctgtctcttcagtgagaggtacccttattaaaactctgcaagggaatatataatttaaattacatattttggtataactttaggcaagctttatagtagtaatgcttttcacatgtattgtgccttcagactatcttgatattcaagtagatcagcttagcctggaaatccagtggaaatatggattgtccacaggccaaacagaaagtcttcttttgcaaaatcacatgcagacttttcaatattgaaaggatttgttcaaacttccagttctctgatgatatatacataacatataaaaggttatccttgtccatcgatgagtcaaggggataaatgtgtaactaacactatctacaataaaaatatttttgttacatcagattacagccccaagctttatttaaattgacaacaataggactcatgtaatagtgtcgtgaggattaaattagatttagaatctaaaaagtaaaaagagcctagaataatccctagtagatacgacaaacatttaataaaaatagttattactgttaacagatatgtgatttatattagtaatgtaaaatagcatactctctcatactcacatggaccttttttcttgttccatgcaatatgttaacagcaaaactagtttacaggtgagaatgacaagaagatgtgaaagattatttcagctttccctttctttaaaaagctagcatttcaagacataatttttttaaaaatgaaaattctaaattgttacttactttaaaagtatttaaaagagattctgccaatggtttaatataagaacaaaaaggagtatttttcaggaaatcaagccagagattatgagtatccattcttgttggcagaccttatttgcttattttaaaggcagtgagcaaaagatgtagaactccaagagacagacgttgattagaagtttttctttaagatgtcatttttattttctgaaaaagcatttatttttaaaacttggcacggattattaagacgggtacagcttaaatttcccattaaaaaatcatatgtcattcccaaacctgttcatatacacagagaaaaatacttaggtatgtactcattactttggcctttccttaatctgaaaaatttttttataaaactgagtatttttgtgatgttgctccatcagctcatttaaaaactactatatgatcttgttcaatgttgtttaatcttaggaccactttgtttcacttatagctctaacatctgtcttttttttttttttttgccacaaactcttttgtttctgtgtttagtagctatccatgctttttgtcctcccactcactaccaattgctctcaatatgatgacaatttaagagaattgtagcaagctaattgtcttccttatattttccctatctatagatttgtttactcaaggagctctatgagaagtgtcaggcatttgcagagacaaattgtcttggttgcatccaccactgttaaaacctccaatgtcacagggagacttgtctgtaatttctagagtcactactggaagtctttttatgaacacaggtcatcattgtggccacacaaaggctctggcactaaagaactctgatagacaatctataagaatgaagcttacattttggctaacagtcctttaatttcttatctccaaattttaagaaaattaagtcttcatgatttattcatcatacataacattttgttcatttgactttcatggtgatttttgattatagtaaaatccaacattcctatagaaatataattcaattaacatgtgttctaaaatattctaccatctacattattgagtaaacaaagataaatacattttatttaatccagtgtgtcgaaagagtaaaaaaagataaaattaatttattttatttaatccaaaaatatgatttttacatctgttcaatatgagaactataggtaggatgttggacatattttttaaattaacgattccagtgtgaagtgtattttatacttgcaacacagcttagtttgaactagctacatttcaaatgcttgatagtaacagtgacctatgactaccatattggacaccgtgggaatcaattccaaaataaaaagtataaattacatgatctttaagtgttctttcagcttttctttcacagttttctgttgagtgatttctatacctctaaactacgtgttccaagaaacaagtagaaagtgaatatatccttgaaatatttagcagtaaataaaaataagtaatttattatttcttatcattgactgttttgggaaggaattcactaagtagaccctttatcatattatcatcaaggaatactacttatttcttggttactactatctctttgatacatttaaatacattattaagcttttattatgacccgtgagtcctatttaatttttaagcaatgcatttgtagaattcctctggttttactagagttaaccttttattttctgctaatgacttaaaactcctcttagaaatgtatttaaatgctcacgtgtacaaaagggaaattgactaataactgattaagttatgcacaatattttatgtgtaagctttatttttataaatcgtgtttatggtcttcctaaataagcagttaaggaaatacatataaatgttagtaaactatcaattatactgatactatacatgaattagacaaagttaaaaaatttagaaaatttttcaacctggcatataacatgtgtccaccttgaatataacaaatccagagacacaagaaaaagccaaatacagagaatatgattctttggttatgagcatgaagcggtgctgcagtgtttggggaaaagggccacaatcatgtctgctggggattcaccctgtaattatatcaccatccagctgaatgcaaacctgcagggaaaatggttaaggtagtcttgtcaaatgttgtgcttgcaatctgtttctctgcatgctgacaagaaggcaataaagtcaaagacaactacacaactaatgtatactggagaagaaaactaggctcagttgcaatgtactgtaacaattttgaagttatatagtaccactaacttgagtgacctagaaaaattgaagttcaagatggtagcattatataaaccagtgaatcgtgtcattaccgtatggatacaaaagtggattatttattttaaatattctattcagttatctgcgtatatctatcctgcatatatccatatttcacagactgcaagaatacatataataaaagaaggcaaaaaaaagcttttgaaaaaagaaaatatactgggaaatgtaattttaattctgtaaattgtaaaatactaatcttggtgatttgggggaaggagagctgatggaaatgaccaacaaaagttgaccctttgctaaataatgaaattgtatcctctgcctagcttacttgatctcttttagtcagcacagctgtgtgctattaatattttctcttataaggaccctgagcctgaaaaaaattaagttgcacagtacacaatcattaaactaaaaagctagatctatctaactgcaaagctcacattgtttacaagttacttgaaagtctagaaaattcagttctgagtcttgccagttatgtccccaaacaggaatttgacccattggactcccttgtgaatcactagattaaccaatgtgcttattagagcccttcagaagggccaagacatttcttcctgtgaaataaatatggaaacaagatattaaatatcttctgtgtttcagaggaaaagtcatgctcagatattaaatacatacaaaaatgtagcaatgaaataattggttgcaggtgctgttggtgactcacccatatctcatcaacacacatcactcttgtgcattccaactggaagcacctgagactctttctgaaggcttttctggccaaggtgtctggctcaactgaagggcaaatggaaatgcatgcattcatatcacctgggagcagccctgaatcaatgactggcagctttgtggatcaatatcctagttcctttgttccttggtggggagaaacctgagacacagtatacattgcttctcaaagttgagcagtggtgttgggttccaaagatcttcatgtgctacggtggtagtctgctcaacatctcaacatcgtactgattccttgtccccttgggatcataccagtgcttcccttggaacatctctccccacataatattaatactcacgtatttgctcaagttcttctgggagaatttaatgtaatctgtaattccagtgctggaagttagaattttagtatgacaatggtaatcctttaaactttcacaaaacaccactgctccatttgtttttttcctattgcagtaaaatatagaaagagaatctagaaggaagagcacaaagtctataaaaataagaggggatgagagagaaacaggaaagagaaatgaaacgggagttgagaaaaggagggaatcacaactcgggagcagaaatgagtaaaatgtgagcaaagcaaaggatcacggtgaggggaacattttccagaggattcttttgaaacgacttgctggaaatttggaaaatgagcaacagtaatgtcaaatactatagctctttgaaagagagagatgaatgaataaataaaaaatatttatttgttcaggcggaagaatctggacaaataagtgaaatttgcagtgaggatgatgattgttcaatatgaggatggcctttctaaccgaaaccatcttctagggtaaagctacctcttcgtcacttaaccccagcttcaatgaagttgttcagatggttggtgtttctgagatttggtttattactcattatccaataaacctgtgaatttatagtcaaaaaaaagctgatggtgggcagacattgcttaatgatcagctagtatctgcatacctgcttaataccctgtaacatgattttgtctgaaaacacctagtttcccagactagcgtctcttctaatgtcaactttcccactgcactgccaacgcaggcccattcattcaaaatttaagagacatttgtagcattccttttctgtatcgggtttgctcaatctcactgagaggagtcgagatctctacacaattatctcttataatgaaacatgcattgatgagattagatacagtttattccatagaaaaaaaacctaaagttgctgtaaaatgtgtttagttattgtgaatcctttctagttggttataattacgtgattggatgtaatagaaaaagtgtgtattccaggaaacctggtttttttgtttgtttgtttgttttgagacggagtctcgctctgtcgcccaggctggagtgcagtggcgcgatctccgctcgctgcaagttctgcctcccgggttcacgccattctcctgcctcagcctcccgagtagctgggatggaaacctgtatttttgtcttatcttgaactatacctaacaggttaaccttggaaagtcatctagctctggaggaccaaagtttctttgtctataacatgagcttgaacaaaatctccaaattccactacctttggttcatgaatagactacaaagatgtgattcaaatgtgttggaactgaatgcaaaaatttgtgagcctgtgcatttttctgcgagagggaacatagttttaatcaaattctcagactgttatttgaaacattttaagaaatgctgaattgtactaccttgaagatcttactttttctgaaatactttgattcataattctatgactcattacctctttggcaatttcgaatagccatttctaggaaataaacttcttccttaaataaatatcaaagttacactgatcttaaaataatggtttatctagccatgaagtatttcacatctaaaagaaccgtttacgtttttggccaattaaaattgatacatcaaatgttagaaaaaactgaaactgtgggctgaattacacaataaaatttcaagaaatgtagaattttgaaacagtaatagtgactaaagtgaaacaaaatatttttttaaaatatctcataaaagtcaagtctgaaacgtaaaatttctcaggtcctgcataatgtaaaacggcttaataaaagcagcaaatataaaatgactatgataaaatactcaaaaaatggatgttgtcttttgtgagtgtactgcctcaattcatatgtatatgcctgatttaaaataatatatatttggattttattggtgtgatggttttatttggtttgcttttcttgtataatccttagggttaattttttaaaaaaagtaaagaaaaataaagaaaattggagtaataaaaaccctttaggaagtagtttgttagatattcatcattccttgaatcttcaaattcactgctcagcgtggggtagacatcctgcctcactgaacgttcaattactttatgggctacagctcagaaggcgaatcacctttttcataagctgcttgttgagagaagcttgaaaaggatgatattgtgtggaggttcaatacctttgaatctcatagtaaaattacaaaattattgttgatttacataagcatgttatttatctcaaactactcaccagttaagttgagactcattaattgtacattttagggtattatttcatgagattaatgaaattagcgattacaatacgttttatttttaggatgctttcaaattatttacaacctatctgtattacactacaatcatgtctaagagaggaatattgccataattttggggaagactgttcctatgatgatgaatgagtgtatttttcaaaatccaaaggacaattgactgatttctaaaattcaatcctagggtaacaaagaaactctgcacttataagcattgcatatttgttttaaattataagagcagaatgttagttcatttaatgagtatatatatttgactttaatcttgttttgttgaaaataatgcataaacgttaatggaaaataactgaaaccaaagaagggaaaggtagttgtgtcaaacaccatataaaaagataaatatggctgggcatggtggctcacgcctgtaatcccagcactttgggaggccgagacaggcggataacctgaggtcaggagttcaagaccagcctggccaacatggtgaaaccctgtccctactaaagatacaaaaattagccgggcgtggtggtgggggcctataatcccagctactcgggaggctgaggtaggagaatcgcttgaacccaggagggaggcagaggttgcagtgagccaagattgtgacattgcactccagcctggaggacaagagtgagacttcatctcaaaaaaaaaaaaaagtgaaatttctaaaataataaaaaagtcactttaaaaaatcttaaaatatgaaaatgacatgaaatttatagaagtgttgttcatttttatatgtaagcagagaatagtgtgtaatatttaaattctttccctaattttttaatattctttacaacatttgttaaatataaggtatattaaacccaaatggtgaattaaactcaaactcaagacactacatgaagaaaaatattccatcttcattatcactatccattttctgtaacattcagagtagttgaaaacttactttactaaagagaggtgggagagggttaaaatttgttattaatattaactgcctatatgagttttgtgttcctttaactttgttgaatttaattattcaagtaaaagtagtctattcaatcattaattgtatgcaattctattatgttataaactagagtatttgaattcctaattcttccctctgaaaatagtaatataagaattttatatgacataatttgataaggatctgtgactataataaattataaatccaggtgtctattcagttttagacttctgacctcaagcgtgtgaaacaagtgggtatgtaaggagagatcacatcattcacggcatttgcattttatatgtcctcaaaagttttcttctaaaactgactgttttgctaattttgtagtaattttattctagatttgttcagttttgataggttttctccattcactgccaacatccatttgagtattcgaatactatgtagatgtatttttagtaaaatatgtttcatttttataattggatccacacagtgctggagaattctacgtgttaaagatgtataaaaataaaacttatttaaaaattaaatgtaaacttacgttctcacaacagagtaactagtatttcaaaaatgttcatatagccttgcaaatagttgaaaatatatatttagaatttagacatttttattcatcttaacagttctgttcactgggatgcttttccacaatactcttaagtcattgttgtaactgaaaatgatcaagagtaatcatttagcgaagactttgagttgtctccataaaagaacttaagcagggagaatgatactccctgcatttttcctgcagatgacattgcatataaatgacacctgccgaatcatgccaagacatacaatctcatcgtgaccatggaagctcatggctaacggtgctgcctgctagttgatccaaaaagttgggttcctgccagagatgtagagcaatgcagtacattgataattactagctagctctttcacctctcttcccataaatgttaatgatagccttgaaatcccaaagcatttctttaacatttctattctttttgtgcaaaattgtgactgagggaggttaatcagtattgccaaggagactaatggtggaagtttctgctatgactcttatctccagttcataaaatacagagaatgttttttagatatataacacctttagccttttttaagtccttaaagttggatcccttatatcccacatgtattatgcaacatttagctgtgaatatgcaggagatattagacttgacataacagaaaacaatgtttgatgatccagtgagagtacatatgagagaattttgaaaatggtaggactgttcattattattaatgttgttgctatgtgtgctcaccccctccaagtcctttctgcttttttactttctttcttgtaattaaattgaataattttaaaaatattttgaaaccaagtaattctaaatatcatgtggcaagagaagaggaaataaagtgaccttttaacaattgggaattataaaatttgtaatatttatcttctccattaattatatcatcttatggttttctttcttatagagctttcctcatttagctacattgaaccgggacatatccatatatcgatctcaactttagccgaattttcttagcaaatgccgagctagagcgaaatttaagaaggcatagtgataaggaaccgtatccctacccccattttgttatatgctaacataaggtcttgctgcctcatttttaaataaacatttttattttagaatacatttagatttacagaaaagttggggagagaatatagagttcacattcccgttatcaccgacaaccagtttcccctattaactttttaccttaatgtgctaacatttgtcataattagtgagccaatatgcatatattaagcctaatgttcattgagattttcttaggttttacctttagtccttggctttcttttttggttccagaatccaatctagctcaccatattacatttggtcattatgcctccttaggattctcttggctatgactgtttctcagactttacttacttataatgactttgacagttttgaggagtactagtcaggtattttgcagaatgttcatcaactgggattgacctaatgtttttctcatgattagactggcattataggttttagagaagaagatcacagatgtgtcattctcaccacattctatctaggatacacactagcaacacgacttgtcactgttgatgttgatcttgattacctggctaaagtaggatttgttagttttctctactgcagtgcagactctttccatactgtagtattgggaaggaagtccctatgtgcagttcacatgtaaggctattatgtctgcctctttgagggcacagtgttgacataaattattctacatgggccatgtataaaattttattattcctccccatttattcaatcatttacattattatggacacatgaaatttgattttatcataatttggattatattctaatagtaccttgtttctctttttaatcaaataatttcagctctggccactggaaactctttcagttgccctgtgtcctttgacacacctgcatcactacagagtttttgaaaagcatttctttattttctggcattacaacttgcatcactgttatgtatgtgtatatatatatatacacacacgtatatatatatacacacacgtatatatatacacatatatacatatatatacacacatatacacgtgtgtgtgtatatatatatgtgtgtgtatatctatctatctatctatctatctatctatctatctatatatatatatgttttagcttgtatattttttgctccagtcttagaatcaaccttctaaggaatcctggtttttgttgttgttgggtaatggtacttaccagaaaccagtatctggatgctatgtatgctcattgatagtggaatataattgtgcaaggggatatatgtgtttctactaagccatgtatatatgcatatctataaatttctatatctgtgtcttcatatctgtttgtatgtatattcatctgtatgtatatttaacttaatgtgtgttcatattgatgtatccaactataatcaactataatcaattaccatgtcaatcattctaaccttctccccttgctatttgtaacttcccaccccaatagtaataaacgtggatcccaggctgggcgcagtggctcatgcctgtaatcctagcactttgggaggccgaggcaggcggatcacctgaggtcaggagttcgagaccagcctgaccaatatggtgaaaccctgtctctactaaaattacaaaaattagccgggcatggtggcctgtacctgtagtcccagctactcaggaggctgagacaggagaattgcttgaactcggccagcggaggttgcagtgagctgagatcatgccattgcactctagcctggacaacagagcgagactccatctcaaaaaaaaaaaagaaaaaagaaaaaagaaaaaaaaaaacctgtatcctaccattgccatcaatttaattacttgttaaattcttgttatcatgtatgggagtttcagaattgttagtggtagccccctggagaataactttgtcaaacagagaacaggatttatgtgcaatgactctagtcttgcaaactctatttccaaagttgcctaggttagcatcacccctctcccctgccaccacataagtgaggttttgttacattttcatatggttagattatttttttcacattctgccttctgacatgtgatcctgacttcctgcatacgttttaaagcgtttttcatatattaaggttttctcttctgtatagttctatgggttttgacaattgcataatatatattcaccattatggtatcatatagaatagttccaatgccctaaaaaaatgccctgtgctttgcccactcaactctctctacagaaaaccctgcaactaataggtgtaccctctctgtagttttgtctgttccagaatgtcatataaatataatgataaaatacttaactttcacagataggcttctttcacttagtaatatgtatttaacattcattcttgtctttgcatggcttttagcttatatttttaagttcattatatagttgtatcacagtttatccattcacctactgacattttggttgtttccagtttttgcaaattacaaatgaagctgttattaatgttcatgggctgtgtgtgtgtacataagttttcaattcagttgagtaaatacctagcattttaattgtgggtcttatagtgagaccatatttaactttttaagaaactgctaaattgtcttgcaaggtggttgtgggaatgcaaaacggcacagctactttataagacaaattgaatgtaagttcttgttactttgtgttctcactgagaataatattcttagttttgtggatgttcgccattctagtagttccgtagtgccaccacatagttgttttaatgtgctctaacttaatggcaaatatgttgtgtattgttaatatatgtttacttgtcatctctatatcatttttgataccgtgtctttttgattatttaataaatagcccaatttagtaattgggctattttcttaaggctgggtttcaagagttctttatttaatttggatatatgtaccttatagaatatgtcttgcaaatattttctcccaggccatgctttgtctgttaattcttttaagtgtcttttgaagagcaaatattttaaactttaataacgtccaagatcaattttttatggataaaggcttgtgtgtacctaaaaacttttctctaaatccaagagaaaatccattttattctaagtatagttttttaaattttacatttagaactatgatccattttgagttaattcttgcacaagacatatagttggtgtctgttatttttattttaatatgtgaatgctcagcattattactttttttatcaacatttcaacaaagcagaaagattatcctctcttcatttcaaatgcctttgttaaatattaattttgtttgtgtgggtttattttactggttttctactctcttccattttctattcctctgccaatccctcatagttttgatgactgtagctttatttgtcttggaatacagtagcatgagtccttcagtttgttcttttttcagtattgtagctatttcatgtctctttccttgccatataagttttagacatggtttgttaatatcagtaagatagcttgctgagagtttgattgggattgtgttgaatctataggtcagtgtagaaagaattgacatttagaagtattgagtcttccaagtcataaacctggaagatatttccaacaccctcttctttttaccctgagaaataacaaaatagtgatatttttaacatgttttcctcattaaatatgtcttataaattatgtaggtccagaagacaaaaaagaaaaataatctccatccaacaaacagcatagattaagattaaatagatatacaagtatctgggtcttgccaattaggttttcaagtgcattcatacaagaaatttactggaacacattttgatatatattaattataaggctgctttaatattatagatggcatagaaattaaaattcattgtgcagaagattgacacatatggtcagagaggaaaggagactcagggagcagcacattattaattagaagatgggggaggataaacataagactctctggagaaaaaattaaggacatgagacaagaaataacctgaatctgttttgaagggatagagatgcataaaaggactggggtattagaaaagactactttgaaaaaaatgagagttttgagttatgagaccagaaatgaatggcttagaaaggcatcctcttctacccacaaattatacttgaaaaataataatcaaaatatcatatgttttaaaaataaaacacaggcttattatttgaatctcaaaatttattttcaaattaacaaactagtatttgtctgtgagttacaaattctatacatttgaccaagttccatttacagagtgaaggcagattttcttcttaataaaagacgcattttaagaattctgaaatgtaattgaaagaaaagactggcaaagacatatgaggacacaaatattccaaacaattatttggttgttaacatgccaacaaaaggttggttttcaaaagaccatgtttttttaatttcagaaaaatacggtttcagtaattctcataagtaattcagcgatgagctatcagctaccggtaatgaattctcctacaaaggaataatttattcccagtgtactcacacaagctgggatgttaccaggaacttgaagctgtaaaagaaccctatcttattagctacaatgcctcactcataatacatacctcatgagttacatattaaatgatcagaggttatttatcttcatacactagtttggaaatggatgaatcatttctcatttcttctgaaagacatacattgtgcttttgctcaaatttcaatttcagagcttcaaacttgtgatacttatctaaatgaaggattagactcacatttgcacacacacaaagcacaaaacaagtgaactaccatatctaaaggcaatagatattacaatgaaacacattaacaataatgtttacttttctaaaaatgttcagttatatattaaagcaaaatggtatttcaccctaattctatgcaaatgtttttgttaaggcattcagttgcttaattaatggtattgaattttaaaaaatctattggtttgcaaatcaggttcttacgcttgtatctatcattctgttctgagagggttgatttatgggtacctataaataaaacagaaatctaaaaaatttagtgagtggagcccagcatgcttcaaaatggaagttgaaacaccaccgtatactatgatcaaatatgttgacttagagttactaattttactttaggcttgataagaaaggattgtgtgtaatctgaatacttactggtagtgagcatatgattgtgtgcctgtaaatacagaatatcattgataatggaaactcaatgtatccaatgcttagttatttacacaaaatacatcaactcatcatgaattaaagactagatcaaagtcataaaaagtaaaaagatacaaaagaaaaatgcatttttcttagataatatcttcattaaaataatagttaaaaattagtggggcttaaatttattgctgtgtattggggcttgtggtgttctttatgtgtacttcaccccatttaacctgaataacaacatgctagttataacctcatagctttaaaatggaggccattctgaaggcctaacttcattgggtcatctctaatataacattgcttcttttgtaattccagcctcatttttctttatttctgtattagcccattttcacatttctgataaagacatacccaagactgggaagaaaaagaggtttaatggatttacagttccagatggctggggaggcctcacaatcatgacagaaggccaggaggagcaagtcacatcttacatggatggcagcaggcaaagggagagcttgtacagggaaactcccatgttttaaaccatcagatcttgtgagactcattcactctcatgagaacagtacaggagagaccagccccataattcagtcacctcccaccatcttccttccacgacatgtgagaattgtgggagttaaaattcaagatgagatttgggtggggacacagccaaaccatatgactttcctaaactgactgcttgatatttgtatgcattatgtatgaaaatacgtattacttcatgtaaaatgaaagctgtttgattatgctaaagaaaacaattttgtactgtatctagaaaagaaaatgtttaattggtcagcattaaaagaatgagtaaaatcccaaatcaaagtttagaatatactaaatgtaataattacctccttatatcattctcttgtaatgtctagttcttcaaaaagctttataggaaatggacgtaggtactattgagagtagaattttaattttaactcagggaacttaaaacttttatgtaatgaccttcacagtatacattttgcaacctgttattttagggcattatcaatttctcagatcaaagtttgaattacagttataatattctgttcaccaacttccttatttaggtacaaaaggtttaaaagatctaaaatataaatgcatgaaaatttagaaaactgtttttctcctcaaggaagcaccaaaatggaaaaaataatgacactggttactactttcttcttttatataactcagttggttttaagtttcagcttcaattcctcagttttgttctatttggtttgggaaagtggtacattatgtatatacaaatttatgtgtgtttgccaatgagtgtgtggtcacgtatatctttgtgatttattatagtataattttacccagtttttccaaagatatatttaatagtactaaatagaaaatctatgatatccatacttgttcatatgggatatctttttccacttcctttaagcaggaagtaatttcttagactgaaatgagctttagaccattcctatcacctcagcatgcagacaatattggtccctcaagggaagataagttgctgataaatctgtagtataacattagagaactcaagagccacagtatcagattgtcccaacaaaattttagagcaccttgtttatcatatgcggaatctatgaaagctaatctaagagtagatagtagaatagtggttaccaggagctagagtagttgatcaaatgatataatattttaattaaatagagatgtttaagagatctattatacaccatggtgactatagttaacaatacattattgacaaatgctgagagtggatgtaaagtattgtcaatacaaaaataattatgtcaggtaatgcatatgttaaatagctgaatttagtcattcagaatgtttatatacttcaaaatataatgtggcatatagtaaatacatacaattttatgtcaattttaaaaaataaaaaaatgaaaaaagaaaactatgaacccttgagcactttagagagagtagaactttcctgttacattcataggatagtatttagagactgtacttcgatcaagtatatgagcacagaaggacctagtattaagagccccggagcaaaatagtcatctcacagaaactagatcaaagtgttaagaatcatttaagcagctacaaatacttcctgaaccatattttgcccacattacttgacggttattctttatgaattaatatggaaacttaaataacctactgcacactctatataacttattgtaaagaagtaagcatgtaaagtcatacgggctcaaactttcacgtacctgtgagatagtgttccactttatctaccaaaataatctttatttatgataatggttgatttcccttatcttttaggtcacaatacatgcttttgactaatgttatctgcttccatactcaacataattcagaaatgttcttcctaaaaaataacatgctgaatgtcatatgctccaaattgtgtgtaactttaaacaagttggcagagggctgcctcctacaagtctgtcccctggcagttacccctctcactcctcatcagccacacacatagaattacatactatttagaaacgggctaatgtaggcatgagaaatgtaatgtctttgtcataatatttgtcactacttttaataataacccttctaaaacttgtgcaggaagttaatacttttctttaaataaggtttattaaaatccattaaaaatgctataactttatcaaaaatatatcattttttaaaaatgtagaacagagcagttgaatagtttctctaggtgtcaaatttcaacaatatttgttattgccactatataaaatcttctaaataacagaatattttataccaaggaattatggcatatgatttcctgaaaatgaaattttccttgatgatttaacatttccaacaaccctgataatcatcatcaaatatatatttgttaggttattactagttactagaactataaactaggccgtatatttaaaaaacaattttcttcttgcagattatatgttacatggaaaatcccaaaactttatggcacactgtgcatgagtaataacaacaagaagaaactggaggcttatgttttgagactggttcacacagaaactgcaaataatagttaacatagggaatacggtgatgatgagttcattagggagaaataaatattgtattgcattagccttcatattttaggatggggtatacactggatagttaagaaattttattttataaaataaatttgaccatataatgcatagaatatggtgttcttttttttttaagttctggggtacatgtgcagaatgtgcagctttgttacctaggtggtttgctgcacctatcaacccgtcatctaggttttaagccctgtgtgcattaggtatttgtcctaatgctctccctcccctagcccctcattcctagacaggccccagcatatgatgttcccctacctgtgtccatgtgttctcattgttcaactcccactaatgagtgagaacatgtggtgtttggttttctgttcctgtgttagttttctgagaatgatggcttccagcttcatccatgtccctgcaaaggacatgaactcatccttttttacggctgcatagtattccatggtgcatatgtgccaccttttctttatccagtctatcattgatgggaatttgggttggttccaagtctttgctattgcaaatagcgctgtgataaacatgtgtgtgcatgtgtctttatagtagaatgatttataatcctttgggtatatacccagttatgatgctggaacaaatggtatttctggttttagattttgaggaatcaccacactgtcttccacaatggttgaactgatttacacccccactaacatggtaaaagcgttcctgtttctccacagcctcaacaacatctgttttttcctgactttttaataattgccattctgactggcatgagatcgtatctcactgtggtattaattttcatttctctaatgaccagtgatgatgagcaaaaatcacaagcattcccatgtaccaacaatagacaagcagagagccaaatcatgagtgatcacaattgctacaaagagaataaaatacctaggaatacaacttaaaagggatgtgaaagacctcttcaaggagtattacaaaccactgctcaaggaaataagagagaacacaaacaaatggaaaaaaaatccatgctcatagataggaagaatcaatattgtgaaaatggccatactgcccaaagtaatttacaggttcaatgttattcccatcaagctaccattgacttttttcacagaattagaaaaaaaactactttaaatttcatatggacaaaaaaagagcccatgtacccaagacaatcctaagcaaaaagaacaaagctggaggcatcatgctacctgacttcaaactacactacaaggctacagcaaccaatacagcatggtactggtaccaaaacagaaatatagaccaatggaacaggactgtgttcttaaaatatgaatttttcgactgcatttgaaaggaaaacaaatatttgaaatggtcaattgaaatcgaccacattgaaataatttaaagagggtgaaattaatatattcaaaaataaattctgccagaatcatagatgtttgggacccatttcatgtctgggcacctgttattatgggcatgcctcctacactgaactaaaatttacatccctgaaactccaaggctttcggttctgtcccaaggtaaatctacatcctcttccatgtgagagccttctgagtatttgatgaataccagtaagacaaatgaccccaggttcttcacttgttctttacaagagaagttttctggtctcttctgaattctggttagtcttctctaggttgcaaagatctttcgtaaagcaagagttctgaaaagatcaaattttatgtgtgataaaatggcacgctattggaccatactgagtctgctgtttaattttcaaccaattcttaaattatttccacagtgaactacatactggctggtatttttttaagaatctctcacttacatacaaactcactttaccaatctccaagttttaatgtcagtcaatactctcttttgttgttgttctcccaaatacaaatgttcaaaatcttactaatgtaactttcttcagtgcctgctcaaaggctcagaaatcactttttaaaatttactttttaagataaaaattgattaaaagtatatcatttactccaaccattcatatgatgtaattactatgtgttagagactttattagcaagagcatattctgcaaacaaggtagtctgggctttggtctcacaggagtgatgatggacatgtcactatgcgtctgtatgctttagtttcatcaaatgaaaatttagagagtttggttgtgtgaggaggaatgggtttgactgaatcaggaaaccttagtggattcttagtgattgtatttttcattggtaaattcccatgacctattcccaaagctattccagggattttaggatttgatataaaaaactacaattttcatttcatgtgaatatatttttgttattttacagtaagaaaatgttcatgttaaaactatatgagcaacataggacagcaaatgaatttttagtactaaatataaaatgcctcaaatatactggcatccaataataagattttaaaatatcagattttaaaatcgatttagacttaagtaacattggccatgtgttcaaaagatgggattttaatatacagactattgagatctaatacactatgaatatccaatgaatattttcaagttaattattcaaaaatcaacattttctgaacaaaaaaatgaaaaagataagttcttaaccataacgtagagtaacatttacaatccaaaaccttttgatctgaaatatcaaagattataaaaaatattagcctatatttgtagaggacataaactttttaaatataatttaagaatataaatttataaacaatcatgtagtcataaggaatttaaaattataatctatgaatactcatcaaaaatcacattagaatttataaagatcctgaatttatagtaaaagatttattgcttccatgaattagcaatttggctgagctaatttgtaaatgatgtggtcgcttgaaagactatacacaaaagaaaattggtaagcaaaaaaaaaaatacaaaatatcggaagaattactgaattgagagaatgaatgctctccacaatcaatgtcattaaaaaagcaactttctgaaataaaagagaactgtctacttttttctttgtcccttttttagtaagcagtttgcctctggtttaacaatatgaacatacttcctttcccagctggaggcatccgatcctgggaatattgatgtatgtacaccccgtagattatacttttcagactagatggatttctaaattcaagatctaccaaatacttccacaattctaattaaaataagaagtttgggagtcagaaaccttttgccctagaggcttgccccaccatgtattaattttcaccattattccatttaactggggttactcatttttatttcctaaaaaattctatatctggaaagaggtaccattctacagcatttctggcaaatcataaattaacctacagtaaatgacattaaggagatagctttgttctgtaaatggataggataccatatggctttgatgttagtgtgaagttaatcacaagctccataacaggccatgacatcatttcataataaattgcatgaacaaatgctgccgttatctgaacagcatgtgaattttggtacctataatctttagggaaaaatgaatataaaatattgagttaaaaaatagatataaggatggtaccatagcgtctccactaaaaatacaaaaaactagccgggcatgatggtgggcgcctgtagtcccagctacctcgggaggctgaggcaggagaatggcgtgaacccgggagacggagtctgcagtgagcttagatcgtgccactgcactccagcctgggcaacagagcgagactgcatctagagaaaaaaaaaaaaaaaaaaaaaaaacagaaacgtctaagttgcaggaagtcagtaggtgtacttttggagtcatcttaaaaagagacgatagacatttcttccatttctccctttgctgccatctggcaggcagcctacaatgtgattgatccagtaggaagagtaccctatgggccaatctatgagccctgctagctaccctggaaagaggctgaggtgccttttttcaagaccccaacactagctccacaccacccaaccacatcgtttaaatttcagttattttctggtacacactggtacacatttgccaattatgtacaaagactgtcaatgaaatcagctgttcactatgagattacagtgtggctattcttttgtaacaaagtacttgattatctagagtattttacttcaaaatatttctgaaaaccatacttccctgtgccgaatcctcagtcagaagagagctgacaatcaatacagaagtaacatattgttggaaagaataattagaacattaatgaaaactgatctcattcatttttcttaaaaatggaggaaataatgttttctgatttctctccatcattccaagtgcaaggtaccacgtaatttatatgtaattcaaacatcaatagagagattttttttatattgattgctcccactttagtagtgctctataaacaaataaagaaattaactgattttacccctgatcagatgatctttctttggagatgtgacatttaatctgattattcatgaatatgttaatgagagagttatcacatgccagtcattagacactgaatattaaaatgcaaccagtcatgcagtgttgatgacaagcttccttttccaatttgcaaggaaagaataagcaaacaagatgagtctaatctctgggttttgttactttttgtaaaatcttcagtggcacttatatgtgtcaagaaaaaaataatttcttaaaatcgcaaactcagggactgcaatgttttttgtcactcattccaattaaaccaatggcacttaaatttaacaggaatgagactttaataattaatagagtacagttgtgtgtttctaatatgcaagcaattccaagttgataaacagctttggattaccaaagtttactggtaaagctactgttaggaacttaaactagtcatgtattttctgtaagaaattactttgcaaagaatggtaggaaatcagagatttaatctcactccaccaagaccctctgagggcaaagaaaatgtgcgtccaggaataagcacaaggcctcaaacatagcacacacaaaataaagattagatgaaggaagaaaggaatgaaaaatacctggatgtgctatactagtagtgtataaaaatctaatcattatttaaactttgtttctatgtgaaaacttaatggaagattccatattggctctaagaaacacagcagctctcttcctacctgtctgccttagtaaccagcagtgagtgacacttttctcttacaaccagccagtggcctcaggatgctatgctagtaacaggagagcatgaaactcctgaagtgtcaggggctgtcatggctttgtgtggacattcttaggtgaggtacagcgatgacacatcgtagagaagaggaggtggggtagtcaatcgcctcagacactaaaccataaaacatctctgaaagtgtaaagcaaagaagaaaattgtattcatcagaattcttcttaaaagagaatactgggtgtattacaaggacctcttggttaagctgcatggggtagactgtaagaggcttttgtctgttccactcacagcaaagcccgtatgctccaggaattgttagtaattgctgtgtttgtttggtgaagtggatgatataagaagcagggagtgctgccttccggagtcctccttttctgcctttgttctcatccaggtgccaggactcatctctaaaaaaaaaaacagttgagaaaatatttagagtatcagtttgaaggggtttcaaattactctgctaagagcaccgaaatgcctgtctctagccaggagtcaataaatggggcaggaaaaaggagggactgttccagtggcaagtgaatggagccgcctaaagtattgcttgctcactttagcaaactgccttatagtattaaacagtacattatgagactgttttcaccaaacatcttgaacaacagacaggtgcatttttcctgttattaaaatgtgggtcataaaggcaaagctacagagacggaaaacagatcagtgaattccaggacacaaaagtaggggagaggtggactacagcggtgcccacaggaattctgggcagggcaggggggcggggggtgatgggattgtgctttatcttgaatgtgctggtgattaccaaacatatgcatttgtcaaaacttatggaactgtatgctaatcacagtgaattttatggcatgtaagttatattttaacttacgaatttttaaaaggcattatattattactctgaagattcagataaacatacacacacatatgaaattcaggaggtgttactagaaaaaaagcccagtttctccttatctaaaaaaattgccgaaatgggctatgattttttcaatatcttttccaatttttgcctcttataattctgtgtttaaataactaaagaaatctgaaattacttagcaactttgtactagcaatggtcattattttacaacctatgctcagatactaattaccttctcataattgtccagtatgcaactgagaaggtcaaccactaaaatcattttaatttcccttcagcttcactgattatttgtagagagcatttcgtttctaggtcaaatcgtcttaatacacacagatcactctggttgagccaaaccagattttcttcaaaagctctgacattgagaccctgctctggcatttcatttgtttgtatagaaaatgttaggcgtctctttgccaagtctaagctgtgattccaaaatcccctcataaccttgcttttcaactgtattccaaacatatataaaactgaaattgaccctacagtcattgccagaggcatacatagagagaaatgtacaatcacagtgtcattggacacacgcatataaattgcgtatctctaaacttcgcaaatctaatatggtattcacaatttgggcaataatgtcagcaacaaatttaattaaataaaaaccttgagagaaatagtggtttatttctgaaaaccaaatattgaaattttgctgagtggcttactttaaatgatcagaggaatgcttcataaattcttgcagtagcatcgtaagactttatgaccatagattctctgatacatttattgggacaccttgtaaaatagtgaagttgcagaaacacaaaggcatagtttttaatttcacatttttcaatacatattacacatgaaaactaaagttttaattaaacaaaggaagtcttaagtttgcattttatacattgattgacaagatatctcttaacataacatgcatagccaagttccttgtgtcacttgctttgcttttttcattcttccttaatttttactaggattttattttctatttctttttcaacaggaagctctgaagccaccacctagttcacttcaatagttatgtgcttttctacgtttcaccacaattttctcagtagttcagacgtatcactcttgctcgatattgattgagttatataatcactattagcaaatgctctttgatttgatcctttctaatgtgtattttctcagggacaggaccagttttgaagttgaacacacactggtgtgtaatgtgcatgtacagagtgcctctgaactatgcagagtaggaattgattcctaaaccccacataaatgtaactcagactggtttagaaaggctattggatttgaaatggcaaaatactaagatatgggaaaaaataagataccagtttaattttaaaatcagtattaatcatgtttaccttattcttgattttttaaaggaacaaaaaccaacatatatgttatttgatttgtacaaatttgtattattctatataacatccatatatattgtccataaccatgtgatcacatagtgtgtctataaggaccttgtatctagtcatatgtgcacctgttgcagtaacccatgctgtgtaggcaggttctatgacaattcaaatcagttctagtgataaatcaaacctgttggttgcttttattgaatgttgttctatttctgtctgtaagcgtatagccaggttaagagaaactgactgaactaaaggggcgcttatgactattccctaatgatatcacatccaaaacaatgaactgacagtgacttaaattattaagcattaggagaaatccctgtatccctgcagtgttcagttccttgaggctctgacaaatgacctccagtttgttggacaaagtaggcgggatatgaaggcagctcttatacacatactttattttggctggggcaagtatcactggatatctcatttggtagcatattaaaatatgcagatcttcatggatcagacaatattattaaaacagtttaatacagtcaggtgtttcttttttttttttttttttttttctttgagatggagtctcactctgttgcccaggctggagtacagtggttcgatttcggctcactgcaagttcctcctcccgggttcacgccattctcctgcctcagcctcccgagtagctgggactacaggcacccgccaccacacctggctaatttttttgtatttttagtagagacggggtttcaccgtgttagccaggatggtcttgatctcctgacctcgtgatccacccgcctcggcctcccaaagtgttgggattacaggcttgagccaccgcgcccggccaggtgtttcttaacgatgggaatgttgtgagaaatgtgattctaggtgattttgtcattgtacaaaaatcacagagtgtaattccaaaacctagatggcggatcctactatacacctaaggctgtatggtataacctatggttccaaggctacaaacctatataacatacagctgtactaatgctgtaggcaattgtaacactatggtaagtatttgtgtgtcaaaacttatctaaaatagaaaaggtacagtaaaaatatggtaggattatcttatgaaaccaccattgcatatgtgaagcatagttgactgaaacatcattaggcagcgtaggctgtatgcctcaggtgccaattatgtgattccatctgatagcaactatatgaatattatatatttgagactaaaaggctaacataccaatttattttgtatgcagcttttaaaattcatgctatttttacttgtaaaagttctgttcactactttaaaagctgaagcacattaccggaaaaagcatgatgtgacatcgttctctactataaagaaaacacctgataaccaataactttcaaggaacacacaccccatgccacatcctatgcattctaaccattttacaagcattatctcatctcatggaatccccacaagtatcatgtaagatagattctctgattattcccattttatgggggaggaaaccgtacttcagaaggttaaataaaacttgcttgagtgtaaaatatattttcttacctctcactaccatttactatgatacatttactaaggatttattaccctctgaacaggagccttgtgatctcacatttcccaacccctcctccagggagtggagttgatctgagtattcagaagtaaaaatgacagtagttagcaattgctgagaattgtccatgtgccaggcactgtggtcaacacttacaggtattatctcatataataatcagaatctatcaaagacataggtcaattattatcacagttttagtagacaaggacactgaaacttataaaggttaaaagtctttgtccacatcacagctaagaagtggcagagtccgaagaagagggaaggcagtctgactgcatggcctgttctagtaactattatgaaatagccaacggcacccaagacttagtagcttttgaagcttcaccattgaggatgtgcatttttaaagatggggtcagagtataaggaagtcttcctggtcctccttaagttccacggcagggtgcctgcctgtgtactctacctacctgttctaattctggggattatcaggagaagaaacaagaaagctataaaagccttagcttctcatgaaatatcttagcaaaacatttttatgtgaaaaatgtatgccaccttttatgtttatggccttgttttattattttcttcttttggaatatttctttctggagtttacaaaggaattatactgaacgctgatgtgaatcccaaaggaaagatacgtttcttctctaatgttctcaaatgtcaggaaatcatttagagagtgaatgtctttggtggctggttctaatttgcactgttgtttgataatgtgcacactggagatcaattgtctgaagatctccttagggctagaaggtcatctttggtgaattagcctgatgcctcattaaagatatgtcaattctcctttttccttgcaatgtgtagagtatgctctctaagtggagtggcaaaatgtacatgaggagggaaatttagcaaattagtttaatgagaattattgtgtttatttggagacttcgatttgattgaaagaggattttactattgggcttcctttttggcgaaggttatccgtagcacctactgtaattgcttcctgtaaaagagtcagtatccatgcagttgcactaatgtgctcttgtttggtgcatttttctcttctttaatataaagcatcttgactgcgaaaattttaaactccagtgtttgaaggatgaattgatgttgattttctgcaaaggaaaataataaatagacttggagaaaggaaaaggaaacaaatctcactgttagaggtaatgtggaaagaataataaacaaatgtaaggaagacaacatctgcgaacagggtctatctattaatgcttgttagggagaaaatgcctaaaatgtgaataagtaaaagcctaacaagaaataaggtatagcagccttccaatagtttgcaattgaaaagagacaaacttgtccaggcacggtggctcgtgcctataatcccagcactttgggaggctgaggtgggcggatcacaaggtcaggagatcgaggccatcctggctaacactgtgaaaccccgtctttactaaaaatacaaaaaaattagccaggcatggtggcgggggcctgtagtcccagctacttgggaggctgaggcaggagaatggcgtgaacccagaggcggagcttgcagtgagccgagatcgcaccactgcactccagcctgaggaacagagcgagactccgtctcaaaaaaataaataaaaatacataaataaattaaaaagagacgaacttcttccagaagcagaaaatcaaatacttgggcaggtttctaataatttataagagaagaacatattttatgttaattataatgtaggccatattttataagaagtagctggacagttaattctgtttcagttctttttcctctttggatttctttgcttctaatttatttttctgtttctatgattatttctctcagcttcaatctttagctctttctactctttaatctctggttatgtggggtaatggaaggcaggtgctggtgtgacagtggcccagtatcatgacattctgatagattgtattccctttgatctctacttaagagtttcatgcaggtgtttcggaggagagagaaaaaaatgtttttcctgacatttttgtcactgcagagagaattacagttttacaactatcatagagattcagaacagatgaatatatgtctatcagtgagcatattaaaacctaatattttgtgggtttgttgttattatttgcaaacttggcacagtaattgtgaagacaaaaattgttcttcaggctttgtgagtcagattaaaaaaagttttaaaattagcactagtttgtaaatgagaacattcaagaaaagaacatgaaacaaaatatatgaccttaaattatgtataattgaagagaacttttaggttggtgaagctatacttactgttttttaaagaaaaaagcttatcataacttatttaaaagacaaattttgttttgttttgttttggttttttatttttttattttttatttttattttttaattttattattatactttaagttttagggtacatgtgcacaatgtgcaggttagttacatatgtatacatgtgccatgctggtgcactgcacccattaactcatcatttagcattaggtatatctcctaaagctatccctcccccctccccccaccccacaacagtccacagagtgtgatgttccccttcctgtgtccatgtgttctcattcttcaattcccacctatgagtgagaatatgcagtgtttggttttttgttcttgcgatagtttactgagaatgatgatttccaatttcatccatgtccctacaaaggacatgaactcatcatttcttatggctgcatggtattccatggtgtatacgtgccacattttcttcatccagtctatcattgttggacatttgggttggttccaagtctttgctattgtgaatagtgccgcaataaacatacgtgtgcatgtgtctttataacagcatgatttatagtcctttgggtatatacccagtaatgggatggctgggtcaaatggtatttctagttctagatctctgaggaattgccacactgacttccacaatggttgaactagtttgcagtcccaccaacagtgtaaaagtgttcctatttctccacatcctctccagcacctgttgtttcctgactttttaatgattgccattctaactggtgtgagatggtatctcgttgtggttttgatttgcatttctctgatggccagtgatgaagagcattgtttcatgtgttttttggctgcataaatgtcttcttttgagaagtgtctgttcatgtcctttgcccactttttgatggggttttttgtttttttcttgtaaatttgtttgagttcattgtagattctggatattagccctttgtcagatgagtaggttgggaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggttttaggtctaacgtttaagtcttgaatccatcttgaattaatttttgtataaggtgtaaggaagggatccagtttcagctttctacatatggctagccagttttcccagcaccatttattaaatagggaatcctttccccattgtttgtttttctcaggtttgtcaaagatcagatagttgtagatatgcagcgttatttctgagggctgtgttctgttccattgatctatatctctgttttggtaccagtaccatgctgttttggttactgtagccttgtagtatagtttgaagtcaggtagcgtgatgcctccagctttgttcttttggcttagggttgacttggcgatgcaggctctttttttggttccatatgaactttaaaatagttttttccaattctgtgaagaaagtcattggtagcttgatggggatggcattgaatctataaattaccttgggcagtatggccattttcatgatattgattcttcctacccatgagtatggaatgttcttccatttgtttgtatcctcttttatttccttgagcagtggtttgtagttctccttgaagaggtccttcacgtctcttgtaagttggattcctaggtattttattctctttgaagcaattgtgaatgggagttcactcatgatttagctctctgttggtctgttattggtgtataagaaagcttgtgatttttgtagattgattttgtatcctgagactttgctgaagttgcttatcagtttaaggagattttgggctgaaacaatggggttttctagatatacaatcatgtcgtctgcaaacagggacaattcgacttcctcttttcctaattgaataccctttatttccttctcctgcctaattgccctggccagaacactatgttgaataggagtggtgagagagggcatccctgtcttgtgcccgttttcaaagggaatgcttccagtttttgcccattcagtatgatattggctgtgggtttgtcatagacagctcttattattttgagatatgtcccatcaatacctaatttatggagagtttttagcatgaagggttgttgaattttgtcaaaggcctgttctgcatctattgagataatcatgtggtttttgtctttggttctgtttatatgctggattacatttattgatttgcgtatgttgaaccagccttgcatcccagggatgaagccctcttgatcatggtggataaggtttttgatgtgctgctggattcggtttgccagtattttattgaggatttttgcatcaatattcatcaaggatattggtctaaaattcgcaaatagacgcaataaaaaatgataaaggagatatcaccaccgatcccacagaaatacaaactaccatcagagaatactacaaacacctctacacaaataaactagaaaatctagaagaaatggataaattcctcgacacatacaccctcccaagactaaaccaggaagaagttgactctctgaatagaccaagaacaggctctgaaattgtggcaataatcagtagcttaccaaccaaaacgagtccaggaccagatggattcacagccgaattctaccagaggtacaaggaggaactggtaccattccttctgaaactattccagtcagtagaaaaagagggaatcctccctcagtcattttatgaggccagcatcatcctgataccaaagccgggcagagacacaaccaaaaaagagaattttagagcagaaatttttttaaaaagaaattcaaaaaaatcatttattaaaataggcaagtacttctaaaagcagggcttgaaggatgcactgatatgtactttgataatgtaagccccaaagatcaggacaggtgtctgtcttatttgctcttctatctcatttacaattccctgaatgaataatgaatgaatgtgtgtatcacaagaaaaaaatcatggctatggttgccattcgaaagaggcacagagttataacactagtcataggtagtgcagatagaagcaagatcattgcatgggggctggagggaacttaaataactagtagattacatataataacctcgattctcatccctcattctatgtcaggcttagagggtctgcataccccctggccacagtgccagtggagaagggtttctatcccgtcatgttctataatatgtatctacgaaaaatgagatcagggaacatccctgtgggtatgaaacaacaaaaactttttgaggaagtgaggaggtatcttgttggagatgggggtgaggggcacttggcatctaatgactgcataactgtattctttttaacagcttgactgagatatatttattcacataccatataggtgacccattgaaactgtgaaattcaatggcttttagtgtatccacagagttatatgttcttaagtcagatctgtggagtcaggtctcaactaagctacccagtgtgtgtgtgtgtgtatgtgtgtgaatttgtatatgtttatgtgggtgtttgtggttagggtggggaactcaagctgcactgacttccagatctgtctgtcttcaatagtgttggtaatatacttcaaaatgagcaatttcttttttcctgtgagctctctgaactatattttatctaaagatactgtctgaaatttcatattaagctatgggaaaagtcacatatgtcactgttacaggtgacgaattactatgttaaaacttctagtgaaaaggtttccaacattaaattcacattaatgatttatagtcttgtattcacactttacaagtgctttgccatggttaagtaagtctcacccattcttgtaaaagtgaaaacatatctgcttaaaagcctggcaaaatgaagcttagaaaaatcctccttttagaaaatcacataatgtagttcatgaacatgttcgagaagggagcttgaacatgttcattgtctgtttctgtgcttaaataccatagctttgtgaaatatatgtgaatgctcactagtttgtgtgtgtgtgcacgtgcacatgtgtatttatgtgtatataaattagaacaagccattatttttaattatttacattaaaattttcagagggttcaggtataaataaatctgtataagtagtataatatatagtaacagtaatgtataacatataagctgtaaattacataacataaatatacattataggtaaaagtatatatacacacagtagttaaatatgtgtattttaaaattataattgaggaagctaattcatccttaagtacatttccggaagttcctctgttggtggacatattctcaaattttctggcataaataatgtttcagtttctgattaaaaccattcttgttatccacactaaatagacttgcctggccagtatctaattttatggtggagtcttgagtcatcagttctacaaagatatttaacctgttcatgataatcacatgcaagagaagctggtcttctgtgacctgcagccagtgtgccagaaagaaggtgtcaagacaagagtcgcctagtgaaacagtgctggtgaatggggaaaaagagcaaaaattaaatggaatccaagccagtttgacacaggacaaattataaagaaaatcctagaacaccctggagagaaacaatgggcaatgattcttcaaccaaaaaggctctgaggcagggcacaatatcaatggtcacaagaggacagggactcccggccatatgccctatgcccttgtctcatcggaggcttgactgagggcagagtctgtagtgccaatgggtgaagggataacaagaggcaggtaaatcccaggagctgtttctacctccagagaaggaggaatccagcaatgctacagcatctcagtccaaattggctccctcgctgtttgacagcaacctttagggctccattctggactttatctcgagctcctttcctcaccccatttcctttaaagaatggccagaaaatctgagcatgatatccttctgttaagaaggagaagaaaaaaataatcttatattagtccatgatgtacactgaaagaaagaaaagttcagtatctttataagaaccttgtctgagggattatgttaaaaaaacaaataactgaaaacataatataatattcaaacttctcttgtttgtttcttggttgttactaggccattaaaaatcttataaaacattaattgtttaatcttggaacaaaatgtatttaaaaaggtttaaaattctgccttattcctcatgagcagtgataaagagaaatcactgggaagcaacaagtgttggcagactggttcagcatggtggctgcgaaaagaaaaacataaggtcttacttgataaacagtgcagcacaggaaatccaaggctcaaactccgttttgaccttcttgatcccaacagttagaagcaatcattctctcctgtcagctttcatatctctttacctattcttttgattagagatttttaaaagaaatcttttactctactaatctatagtcatcctaagaagggttcccgtgtataaagaacatgttttatatttacatgccacagttacattagcagttccatgaatttatggagacttaagtgcagctttgactcttcagcctcagctcccaacctttccaactcatcacccaatgtaccacaattcttatcccatcagaccctggatctggctatagtcatttcctcacctgacctggagccaggactgcacatgaaaatgaggcttccgtatcacaggttggacaaacctctctcataaaatgcttttgtatttctctacttcatgggtacacagaccacttcagggacttaaatgtaacccttaataccttttataaggtagatgttgtgttttaaataagttattttcaagtgatcctttggaacaaactttatgcctttacatttctattttccaagcatatagggggtgagaaaacatgaatattttccccatgggaaagaagtgaacgttttcaaactttataaggaaatgacttttctctttgtagttataatcaggaaaaaaataataaagcccatagcttggggtcatttttaattagaaaaactttttacctgcaaagcaaaaagtctacaaaccagatttttatgctgtgaaaattttttattatgcaatacttctttaaatgttttttaaaaaactaatattttcttatcttataaatgtatgaagattttgagtctaagagaccaaatagatttatgttaaaacttctctgggcctagatgaaattctcagatattttgtaagcaatgaaaaattaattttaaagtgtttttccccaatgtgtaatgcatatttataacctacagaacaaaaaacacaatcatattttggatctttaagacctgacatagcaaaaagataatttgctttgaggccctttgatgcatttaatttaatttattggaagcaaattaatgtgaaatgataaaattattattaaaatggaaatagaagaataggaatgactcaaatcaacagaggagagaagtggctgattaccatacttcataggataattcccaatttaatcatattaaatctaattgttggcggacagatgatgggaaataccgctcttgctttgtagtagacagaagaagacagaaaaaaattttaaaaagcaattcagaatgtcactaggataaaccaaaaagtaaactgaaaatgaagaccaaagtggatttcttaaggaaacattgcctctttacattgccaaatgaaaatttggtagatgaatattctatggttttagataatcatttgtaacttgaaagggatttatatacaacttaataaatatatattgaatgactgctattttcaagatattgtgctgctgatctgtcttctagctgataaatttagctgaatacctggagcaataatagaaccaagttttattgatcaacagcaatctctattaaaatggtaatgaacagcttctgcagtatatcttgatatattttctttttactgggtgtgatgaatgtgtaaagtagtagaacttatgatacatgtgacatgatgtaagttcatgataaatgctagaggattaatttcatatagctacatattgtcattatttcaaacttcagtgaaatgaaaacatgagtttttcactgctgtttttaaatttttgtgatttttcccctcagtggcaattccaaaataaatggaggaaactggaaattattctgaatattgtgtatgaataaccatcttattaaatagactcatttaaaacattttcaaaaatttacatctttctcaataggaaatgggtcctttaattctgctcatttctctccatttttagtgatgttattttagtctaaatttccataatctttattctgggctattatagtaatattccaacaggctttttctcttcctatttcttgggatattcctatttatttcccaaaccatagtcttaaacatcttaaagagaaatatacagaatctgaaaagacacttctcaaaagaagacgtttatgcggccaataaacatatgaaaaaaaagtcaccatcagtggtcattagagaaatgcaaatcaaaaccacagtggggtaccatctcatgccagttagaatggtgatcatcaaaatgtcaggaaacaaaagatgctggagaggatgtggagaaataggaacacttttacactgctggtgggagtgttatttagttacaccattgttggtgggagtgtaatttgtcttacaccattgtggaagacagtgtggtgattcctcaaggatctagaaccagaaataccatttgacccagcaatcccattactgggtatatacccaaaggattataaatcattctactataaagacacatgtacacatatgtttattgcagcactattcacaatagcaaagacttggaccaacccaaattcctatcaatgatagactggataaagaaaatgtggcatatataccctatggaatactatacagccataaaaaatatgagttcatgtcctttgcagggacacgggtgaagctggaaagcatcattctcagcaaactaatacaagaacagaaaaccaaacaccacatgttctcacttataagtgggagttgaacaatgagaacacatggacacagggagggggacatcacacactggggcctgttgcggggtggggggctaggaggaatagcattaggagaaatacctaatgtagatgacgagttgatgggtgcagcaaaccaccacgcagttgtatacctatgtaacaaacctacaggttctgcacatgtatcctagaacttaaagtataataaagaaatatataaaatctgattatttcaccccctcgatataatggaaagagtacattgtaagtcatacatctgaattaaatggaaaaataaaatgatatagtgctaataatcagatatacagaattgtagctttacaaagtataggagataagttactctgaagattcctttcattagaaaacagccagatggactggtaggcacctgtatcgcaactattcaggaggctgaggtgtgagaattgcttgagcccaggagttcaaagctgcagtgagatatgatcacgctggtggatagtgactgcactccagcctgggcaacatagtgaatttttttttttttaaagaacaactagattctccataaaacagactatcacactctaatacataactgagatcacaggaaatcagggagaattctaaaccctcttaactcattctctgagctcatgacagagtgggtagtaagtgaaaaactgaaaaattgcgtatttttttagagcagcttagtggacagacagtattttagaataccagaaagcacaagaaatgtgtgtgttgttatgcagaattcataaacaactcttttgactcaaggaggaaaaacataggatcataataaacaaacccttaacaggttggaaacaagaatagcctgtaacatatgaagggtcactcaaccttgttagtaattaggacaacctaactaaaatgtataaatgctatttcacataacaagactgaccaagggttgtgatgatacgcaataataggaacttacgtactttgttattgatagtataaactggtatggacatgtggggaaaaaacttgctcttgtcttacaatgttgaacattgaattactaacaactcagaaatttcacattttatgaagttcttcttagtgttgtttatattatgagatagaaactgttatctgtatagtacaccaagataagaataaggcagttcctgagtggaaacaacattatgatattctcttattgctgtcactcccttccttagacactggctacaaaaaccaatgaactaattcatctgggcataaattgcaaggttgagatagtgtgtcaccaatgctatatattattctgaaatttgtatgtgggttttcatgcaaaaccattgtctgtcacagtaaagtatcttttgtcatcactaagtaaaaaccttttcaagtaacagactcagaccacgtgcacacaatggatgggcttatattatgataggctggctatcctaataaaatattttaaaaagcataaatggtgggaagagcaatagaaataaagtatgtgaagaaggatactttaaaggtgaaaaagtataacaattagaaataacgataaattgaacaacaatgcaaaaggaaattcccaaaatgcttccaaaacaaggacagaaaagaaaaaagttaaattcagttattaaaaaattaaccccattttaaagccacttgcatttattagtgttaattacttgtgttaattttaacacaagaaaatggcaaactggtaatgccttcctactgtaatataaagttacttcaaagaggaacattttctgaatgacacaatgaatttatcaaggacatggggcttttgggaaatagacctacgactgttggttctctgattatctcactgtgggctacttctgttttcattatttatttgcgatgtgggcacattaccaaactgctttcagaattgcttaatgtgtaaattcctctgaaactttgaacaagagatttttgacaggtatgattagtaagtaggatttcaagacatttgacttcactgaaaaattttactgtcatgacccctttaacaatctttttacttctggagatgtgtttccaatttgggttattattaatgactgatgtattcttaaaggaagagaaatagaatattatagacttatttcacagtaagacaagtcattaaaaataactttgaacttcaagaagtagtagaaatgggaatttgaattttcagaccaaatagatcatgacagaaatcaaagtgtagaattacaataaagtaaagagactggatcatttcagtctattttgatttgacattataattttgtggttgggaggaaaaagaaggcaactgtatttcatcagctttgaagacttcgttgtcgtgaagaaggctggataacttccttatgttgtcactatcttgcttccatccagagactgtggagtctttctggaaccaatatggttgaaaaagcctttcctttttagtcagcagggcttagtattcacagcctctgttttaaatacaatgtaacttgctttattacaaggcatactgtgacttataaagctagaaattctgttcaggtgattacagatgaaaaaaatgatgaaaattgagaggttgccagctcacgttcttttctttctcactaaagagtctgcttctattttggtccattttaaagtttccttaactcctcgagtcacagagaaagtagtcattcttcagtgttgccagctcctgattccagatgagctaatgattccacagagctatctctttggttcttaactctgcacctttactgatagtcattgtagtttaatttttattatcaatgtttatagggcctttgcggtgtgtcaaattttaggcaccccaaaatataatagcgaacaagacattcatggtcactgccttcatggagcttctcggctagactgtgtataaattttcaatctacagagaatgtctctatgtttaataacaatagaacatttgtattgactcttaccaatacatgtaaactactctttgaaaagtacactaaatcccaaagtgtcttttggaaaaggaatgttacatttttaaaattagacctgatagtccatagttgaatgctaatatgatggtcaatgactaggaaaaatgttccaattcaaaacaatttcaaagttttcttcagtacccttgtatcatcatgacttgggaaaatcatcttaggaagtattggatgttatcttggaagttaatttatagaaacatgggtggggcattgtagatcatttagtccttaaatacatttttggctgaaaggaaatctctcattaaaagggaaagaaacagaagaagagaaggaagaagcaaggtaaggtatttgctaggatcacataactggttagtggcagaagtagaaatcatttccttggactctttagtgctttattactgccctcttgtaagtttgttgcttttccactgactgttgggtaagaaattataatcccagaacagttctttgtatattaaaaaaaaatcctttacatattccatagaaactgggcttggtttgtaaagctgaggcccaggagaagctctttttcttacccatttggtctttaatgttgcttgcgaatgcatgggggtagaactctaataacaatgatggacacgatgtccttgcacataaacatttggctcctcacagcatgagatgtctggtcagccacagaggataaaataatggcgtaaagatttactgtcagggagctgggccagtctcagcaggacagcggctccaagcagatagatggcctggtatgcgtaggtcacctgtgtttacactgatgaatgtgtgtggtttccctagtctgcatcattatattgagttgtgtggtgttggtagcacttgttactcaccctagaatgtgcctttctattgaaagacaagtagactaatagcttggcttcccagaaataaatgagacaattcacatgaaagcaattgcagttagacaaaatgacataaatattaaagattaagaataatattatttgtatctgtaatatacagaaatagtcaaaaaatacttggggctgcataatttgtggttgtagcagttgctgaatttagtcccatatagtgatttggttgcataatttaatgtttatgttgtatttgtttaatacatcactttcctgaatgaaatgattgtggtatgaagttataagaaataatgtctttggcttgttatagaaacagttattttagggattttttgtacttttgaagcagtttcaattacaagtcatttttcatgagttctgaagtaagttttaggcatttgttatgagatcatattattagcagcttagatgaaaatccaaaatgcatttatggatattttaattggaaaattaagtggatcttttataaaattaaatactctgctataatctcttagaaaaaataaatcccttttacctaataggcaagttcatgagaaatctgtaatgatatctctcaacatagcatgttaacttatagattatataattataaatttataagcctagtttatactaagtatattcaagttataagtcacaatacgtgaaatgaacataattctctgaatatgtcacattttttaaagatatctgtaatcccagcactttgggaggctgaggcaggtggatcacctgaggtcaggagttcaagaccagcccaaccaacatggcaaaaccctgtctctactaaaaatacaaaaaattagccaggtatggtggtgcacacctgtagtcccagctactcagaaggctgaggcaagacaatcacttgaactcgggagacagaggttgcagtgagtcgcgatggcaccactgcactccagccttggagacagagtgagactctgtctcaaaaaaaaaaaaaaaaaaaaagaaagaaaaatatatctttattttcaatattactgtcagtgcctgaaatcatgccttgttttgctttgtctacaaatatattctttcaaaaatcatccataatgaatatattttccattctaaggtgtacttcatttttggaaacagaaaaatgccaattatcatccatgcttgtgaatacagtaaataattgatctccctacatgttacctttttaaaataaattgaacatgaataatgagtctaatatagtacaacaggtgtttctgacaaatagtattggaaaatgtattgctatttgattttctatttatctgtgaagtccttttaaagatatccatgaaaactctctcttatgaatgtatggctaattgtaaagtagaatcctcataagaccagtattctatgatttcctcttgattaaataaaataaaatttaatgtgacaatggtttgtgtacttttctttccttgtcttctctgagcatctctctagaaataggaaaaaaaaatgggataggttttgtttgggtgatttccactgaagcatagcaaggtcatgcttttgtattgtctattatcagttataatttctcaaaaacagacagcaaacaggcagtgttcaaaaatttgtaatttactatcccgtgctaaagacaaaccacagagtaaaaccgcaacccggttaaccaccaaaacaaccttcaatcattctgactggttctgcatgtttcaacgtttatggtcttttggctgaaggccaaagttcatctcttattaccctttcttttccatctgtgaagatcattgcacacacactcgttctgcattccaaacaatttcacctggcaaaggaactaagtaaaactgtctctcatcttcattactattcatttcatctttcaaatcactgaatcgtgaaaattagaagtaacaaaaaaaagaaatcaggtgtattaaaaacaaaaatttgaaacagtatatctgtgaaaccgctcagtgttagaaattgtcactgatccatgtcaaattcagcaaacaaaactgaggcaatttactttcacattttactaaatggccacttgtaagcatacggatgagattttgtctttccccaggctggatcagtctgttggtttcccaaacagacaggggctgagtggcttaacaggtgtgccaatgtgagaaagaaacacaaaagcagctgttgttaaaggcgttaggtaggctttgccaagactttacctctcagatctcttctgtgaattgatgactaaagtatgtcaactttggaaaaatattcttgaaatattttccttgatttctgacttcaaaaggcaaattataaacaccttaatcaattaatatttactactagaatgattgcccaaaagactgaactaatcaagatagaaaacaaaagtattatggcttattatgtcaatctcctatttaaaaagcctcaacattttctcatagcctttagaagaaacaattttttgtacattgagatcccaattcaatgcctctttttgtccatatctcattgcaactttgactcatatgatatcactttgctgcaaacagattaagctactaatgaagacatgcaattatctttttgtcatctctctctctctgtagctctctctgtgtgtgtgaatacatgtatacttgctcaactaaaatgatcctcacagcctcacatattaagatctcatttattctcaatttgggcttgacttctaacaaaaactgttccttaactaatccaccaatagatggcatattcttctcctgagctttcatcctgtttatcatttacttggtattccaacctacctctatggcattgctttacagatctttaatgtggtctcgcattgatatggaaagtttgcttttgtagatttaacttatcatgtgagtcaatcaaagatttccaaatagttgatgaactttatgagagaaaaggcctgggttttctttctttgcctcccttcaggtacctggtggaggatgctatttctagtagctacttcaaaaaacaagttttctgagttgctctcttatttctttaaccacattgtctctgtcgttctctgtctctctgtttctctctttctctctctattcttttgcatggacaccaaattttgtctcttagattttgaccctcttatctttgaatactggttttgttctctaaactactagttttttgccataactgttttttctttgggattttggactgtatttcttagatctaaggtacagacctcctgcagggacttccatgaaccatatatccattgtagcaatgatcttcattgtcaaaaagagtctaattttaaaagcaaagatttgtcaaagaaaccttttagaatgcaaaatagctaggaattttaattctattaaatatcaacaataacaaaaaagtggtaactatgattattttctttttgacaaaataagttcatcattaaaaaaaccaataatgccaaatcctaaaaataaatttcagcctgtaaaacatacattcaagcatgtataaatatatgcatgtacaataaatatatttaaaataatttttaaatttctagactgttgactagtgagaaactagtgaaactatcgagagttgggaacattccgtgtaagggggtaatgaagttgagagtgataatggtacctctaacttatggctcagactgaggctagattcaccaactttgcatagcgtcctctgcatttagattttctattcaacattcttgcaatatcttgaatgaaggcatagaatggcagcacattaaatttacaaacggtaaagatcaaagaaggaataactgaaattattttgagagtgtggaattctgagctaagttatagtgctggtgtttgaacggagttttaatatgagttttgcctgttaggtgatttctgccaaaaaaaaaaaaaatacgaagtttgcattaatgaaagcagagtattcagctaaaaggaatattcatccttttcattttgaagtttgttattataccatatctggaatgttttgtttacttctgcatggacattttaaaaaaacattgaaacaggagacaatggcatgaaaaggatgatcagaaagatgaaacatttggaattgatgctttatgagggacattgaatatactggaagtatgtagtctaaagcagagaaggctaaagggagatatgatgcaaattcatgagaaatgttcatacctaatatttatgagtcaaatgctaagtataattctcatgactgatccagtgatgaggtaagtgtgtggacacagaaaactgtcacaatgcacagtgtgaaaagaataacagtagttcttacgtcagggtacaagtcgagaaaacgaatgcctctatggattacaggtggagagaaatgtgatctagggaaaaggggaaaggtggtattaggcagagattagaaggtgctgtagtttttgagctggagcctagaaccccacactctctcagcctctgagctgcagccacctcccctgcagctactggagacaccgcagccactaaggctgcaggacctcctgctactgaccgtgggtacttctggtggctgctgccagaaacccaatcccttgtttattctctgggtttcaattttacccccaaacctgatgaaataccgttggcaagggagtcttagaaattttagttttcttattctcagtgattaaagaaaagggcgcagagaagattatgggaatgttagaaggttagttagttaccatctagcacaaatgggattaagtgttagaggtctaggcaggatatatagagataaccaatttaaatggtcaaggaaggttaatatctataagtactttcaggcctgcctttggaaaggcagagtggagttctgtgttgctccagagagcaatagatgatagaagttattaggagatgaaatttaggtatttgtgaaaaataacttcctcataactagagctcatggcaaaaatgtcctgctattttaatatgttgggtgtttgagcaaaagtttaattctatttttttcagggattctctagaagagcttctcatagtaggcagtagatggtttagttggcagctaatgttccttaaaaatttacaattttatgattcccaaaccactcatctaaaaataacaaaatgtgtttaaagagtagattagttaatcacaaaacataaaaggtaactagccaaaagaattaaatatattcatcacgtcttaataactttgaggaaaatgagtacatgaggtgggaaacgaacattaaaggagtttcttatcagcccttttcaggattccaaacttttcttataaatatccatcagtgctccaattaagcctttggagtgatatgcaagaactccatagtggggagggaaaagtgcctccttccacacagatgttggcacagtgctgaaggatggcggctggccagcctgctttacaagtgagggccaggagcagcatctgcatatgagagcagattatcccattggcaaactccattaacactgccaagggcacggttatgctgttagtgactaagaagtcatccctttcacctgaacatacctctggtaatttagggtaataaagaggatgcctttcttttatatgcaagagaaataaagacttgaatggtaataagggagggcaatacatattcatttattatgtaagtaagaaaattcactggtaaataatctcataatatctaatgattggatgatatctaagcagtatgtcgatgatatctagtttatccaccattgaatcccttataaaacagaccagtcagctggtacccagtggtcttacatacagtcaaagatgggaagctcaggatccccacatgcagccaactggaagatgggatagcaaagtcagaaagacctgagttcaaatcttcactatgttggtcattaactatataaacttaagtattttatatcatcgagctaaatttcagtgtgtatacctttaagatagtaatgtgtacttcaaattgttgttacaaaattaaaagaggtaatgtgtataacagctatctcaataaatagcagatgttttaattccaatgtgcctacttcacactgttgttacaaaattaaaagagataatgcgtataacactatctcaataaatgggaggtgttattctatctttcagatgtctctaatggttagaaacgctttatattaaactgatttttttctctataatttaagcctgctaatcctcattatgacttaagggcttcttaaaacaaatgttatatcttttatcttttactgaaagtctttcacatatttgaaaataagaatcgttaacttcactcatcatttcttttatggactgaacacacccagtccctcaacctttccttgtattccgtggctcttagccacctcaccatagcaagaagtgaggcggggaatgtggaaggattgtgattaagtggttgaagtgcagagataaggatgggaaatgcagggtaaaaagcactggaacaggcccagctttgttttttggccaaaagattcagcagctctgatcggcttactgatattcacacggtgctgaggttggcatttttccagaggcattaagcatcattccactcacggttgacagtttccagaaaggtttctcccaaaaacacactctcctttgatttcttcctgaaaatcatgtatctggtactttatcattttagctcatatatccacaggcagccctgggtgaaaccacactttcactaattttaatcatctatacttaagggcttttaggttttttttttaattgggttcattaaatcatactttaatgcattgaaattcaccattttcatgtgtacggttctacgaattttggcaaaggtatgcagtcatgtaaccactgcccccaaaaggacccccatgctccgatgtaatcaatattctcccccaatccttaacccctggtcaccactgttttgctttctgtctctgtagttggaccttttctagaatgtcacataaatgaaactatatagtttgtacccatgctatttctgcttctttcatttaatatgatgctcttgagactgtaagttgtatagcatgtatcagtagttcccttttttgcagagaatttttccattgtatcataatttatgtatgtgccagagttgtttgcttatccactcactaggggatgaacattggagagtttttctttttctttctttctttctttcttttttttttttaaataaagctgcaataagcttccatgtacagatcattgtgtaggcacatgtattcattattgttgggtaacaatgttggagtaaatggctgggtaggatggtatatgttcatttttgtatgtttaattttatgagaaaataacaaacatggttataccattttgcatttctagccaaaaaatataaaagttttagctgctttgcatatttgtcagcaattggtattgtctcttttaaatacagccattttcataggtgtagtgtttttttaatgtagttttaaactgtaattcactcatggtcaatgatgccgaacatttttcatgtgtgtgtttgccatccttatctgccatccttatcttttctttggggaagacagttcagttcgttttctctccttttttttttttagacggagtcttgctctttgtcacccgggctggagtgcaatggcacgacctgggctcattgaaacctccacctcccgggttcaagcgattctcttgccttcgccacccgagtagctggaattataggcgcccgccaccacgcctggctagtttttctatttttagcagagatgaggttttaccatattggccaggctggcctccactccggacctcagttgatccgcccacctcggcctcccaaagtgttcagattgcaggcgtcagccactgcacccagcccagtttgttttgttttgttttgtttattggtttgttttctattattgagttcattatattcattatacataatttgcacaccagtccttaattatataggtttttttgcaaatattttccccacactgtggtttattttttatattttaacagggtctttcaaatagaatgttttaatttttatttatcagtgtttttcctgaccagtttgtattttttatgccatataaaatatctttgtgtaaaagatgtcacaaatattttctcctccattttctttgataatttttgtagttacatattttacatttaggtctatgattcattttaagttggttgagtctttttctgcatatgcatatgtaattgaacatttttttaaataccatattttctccttttaattgccttagtgccttcatgagaaatcaactgaccttatatttgcgagtctgtatccagacactctagtctattatttcctttgtctatatttatgtccttttgcaaacaccaaattgtcttcattgcataacattagaataactacagaaatcagagccgggtgcagtggcttatgcctggaattccagcactttggaaggctaaggcgggcggatcacctgaggtcaggagttcgagaccagcctggccaatatggtgaaatcccatctttaataaaaatacaaataatagccggctgtggtggtgcatgcctgtaaccacagctacttgggtggctgaggcaggagaatcacttaaacccgggaggcagaggttgcagtgagccaagatcagccattgcacctcagcctgggcaacaagagtgaaactccatctcaaaaaaaaaaaaaaaaaaaaagaaagaaagaaaaagaaaggaaaaaaaaagaaatcagttaatgtgagtcctccttagttgtttcactttctcattttttttttaattccattctagatcccttgcttttccatataacctttagaatagctggatcatatttgagattgcattgaatgtataattcagtttggaggataattgacaatctaacaatattgagtcttcccaaatatcggtctattatatagctccatttatttaggccttttaaatttatctcttttatgttttgcatttttaagcccacatattttgtatatattttcttcgctttaatttttgtttgtattttaaactgtactttttccctcatttgatcatgaattgttatttctaatataaagaaacataatggaatactttttgtatcctatgaccttggtatactcactagttttagcagcttttctgtaaagtgtttgggattttctatatacgccaccatgtctactgtgaataaagaaaattttatgtttgctcctttccaatctatatgccccaattttttatttattcatttatttatttatttttgtagagttattacattgattaggacctctaggtgaatgtggtaaaagcaagcctccctgctttcttcccagtcttaggggaaaaacgttcagtcttttcccagtaagtatgttacctgcaggcttttgtagatactgtttatcaggttgaagaagttcttttctattaccagtttgctagggtttttattataagtgactattgaattctgttaaatcatttttatcatgcgtaaagatgagcatatactttctcttcttagtttgttgttacaataaattccttttttttttttttttttttttttggcacagtctcactctgtcgcccaggttggtgtgcagtggcatgatctcgggtcactgcaacctccgcctccggagttcaagtgattctcgtgcctcatcttcccgagcagctaggactacaggcacgtgccaccatgccgggctaattttgtattttcagtagggatgggtttttgccatgttggccagactggtctcaatctcctgaccttaaacaatctgcccatctcagcctcccaaagtgctgggattaccggcgtgacccaccatgcccagccccatggattggtttttgaatataaaatcaacactgcattccggacaaaactccacttggtatgatacactaaatgttttatatattgctggatgtgatatgtaaggatttttgtattcatattcatgaaatatattgatctgtagttttctttaacataatttctccacaaggttttctatgtactaatggtggctcataaaatgaattggaaattctttttctttattgttagcaagattgtttagaggtagtaatatttcttccttcagtgttggaaaaaattcactattgaagtcatttgaacctcaagtttacttttttgcaagaagttaaaccaataatttatttttttaaatagatataggactatttaggctgtttcttcttcagtaaatattagtttgtatctttgcatgtgtcgacttcatccaagttgttgaatttggggagcataaattggttaatagtactctcttgttatcctttttgttttgttttgttttgtttgagatggagtcttgctctcgcccagctggagtgcagtggtcagatgttggctcactgcaacttctacctcccaggttcaagcgcttctcgtgccttagccttccgagtagctgggattacaggcacccaccacaatacccggctgatttttggatttttagtagcgacggggtttcaccatgtgggccaggctggtcttgaactcctgacctcaggtgatctgcccatcttggcctcccaaaatgttgggattacaggcgtgagccaccgcgcccggcgtcttgctatcctgacatttatcattcctttctctctctttctgtcagtaatctggataacgatttattactattattgattgttacaaagaatcagctttaagtttcacttattttctctattattttaatctgttttcaagttataatttccctgtgactatgtctttgacccttgggtaatttagaagtctgttctgtaattttttgttttgtttgtttttcatgtttggggtttttaagatacatttcggctgggtgcagtggctcatgcctgtaatcccagcactttgggaggctgaggcgggtggatcacctgaggtctggagttcaggaccagtctggccaacatggtgaaaccccatctctactaaaaatacaaaattagccaaatgtggtggcgcatgcctgtagtcccagctactcgggaggctgagacaggagaatcgcttaaacccaggaggcggaggtggcagtgagccgagactgtgccattgcactccagcctgggctatggagtgagactctgtctcattaaaaaaaaaaaaaaatacattttgtaactgatttctatttttaattttataacacttttaaaattatattgtcttaaactgacataaaaatatttatgtataatatgtaaattattacaaagtgatgcttcagtacatatactgtatattaatcagaatgggataattagcatacccatcatctcaaacctttgtcattacattatgttgggaacattcaatatcccccttttagctatttgaaactataaagtatatgattattaactataatcatcctaaagtggtatagaacactagaacttattcttctcatctagcagtaatattgtatcctttgataaatctctccctctctctccctgttccctaccctttccagcctctagtgtcttctattatactttttacttttatgaggtcggctatttttagcatccatatttgagtgagaatatgtagtgtttaaggatcctgttcctggcttatgtcacttaacatagtatctattagttctatatacgttgccacaaatgacagaatttcactgtttgtttatggctaaatagtattctgttgtgtatatacaccacattttctttatccattcttctcttattggacgcctaagttgattccgtatcttggccattgtgaatagtgctgcaatagacatagagatgcagatgtctttttgatatactcatttcatctcctttgggtaaatgccaagtagtgggattgctggatcatattatagttctatttgtaatttttgaggaacctctatactcttctccactttggctgaactagtttacattcccaccaacagtgtatatgagttctgttttctccacatcctttcaagcattggttacgttttgtctttttgataatagccatcctaactggggtcagatgctatcacattgtggttttaatttgtatttccctgaggactagtggtgttgagcatttttcatttgttgcatatacatgtcttcttttgagaaacatcagttcagatcatttgcccattttttaatcaagttgttttgctgtttagatgtttgagttttttgtgtattctagatgtgaatcccttgtcagatgtagagtttgcaaatattttatctcattctgtaggttgtctttcagtctgattgtttcttttgctgtgcagaagctttttagtttgatatgataccatttgtttatttttgcttttgttgttgtacttttgaggaactttttgttactcataaaatattttccagaccagtgtcttgaagaatttatgctctttgcctccagagatcttataatttcaggtcttatatcttggtctttgttctattttgagttgagctttgtatgtggtgagaggtgggggattagttactttctgcaggagatactcagttatcccagtaccatttattgaagagcctgtcctttcctcaattagtgttttcagtacatttgtcaaaaaatcaattggctgtagatacacagattagtttttgcattctgtattttgttccattagcctatagatgtttctatgccagtaccatgctgttttggttactatggctttgtagtatatttttaaatctggtaatatgatgcttccatatttattttgttcaggatttatttggctatttgggtcttttgtggtttcatacaaattttaggattttttttctatttctgtggagtgtcgtttgtatttttatagagaaggcattcactccacagattcttttcgatagtatggccattttaacaatgttaattcttctgatacatgagtatgatgtatctttctgttcatttgtatcctcttcagttttttcatcagtgttttgcagttttccttttaaaggttttgtacctccttggataaattcacttttaggtttcctctttttttttttgtacactattataaattggactgtcttcttgatctcttttttttagtttgttgcttgtgtatagaaatgctatggattttcgtgtgtcgattttttattctgcaattttactgaattggtttatcagctctaagagtttttcagtagaatctttaggtttttctatatataggatcatgtcatctgcagacaggaacaatttcacttcattcatttgaatgtggatgccctttaattttcatttcccaattgctctggctgggacttctagttctatattgagtgcaagtggtgagtgttagcatctttgtcttttttccagttctgagaggaaaagattttagcttttgcttctttggtgtgatgttaattgtgtgtttgtaatatgtgccttttattattttgaggtaatttccttctacacctattttattgagatttttaatataatggcatattacattgtattaaatgttttttctgaatctatcaaaatgattgtatttttgtctttaattatattgatttaatgtatgatgtttattgatttgtgtatattaaaccatcctcacattcctggcataaatgccacttgattatgttgtattatctttgtgatctgtgctggatttagcttgctagtattttcttgaagattttgcatctgtatttgtcagaggtattggcctgtaattttcctgtgtgtgtgtgtgtgtgtgtgtgtgtgtgtgtgtgtgtgtgtgtccttatctggttttgttattagatttagactgggcttgcagaatgagtttggaagaattccctcggcttcaattttttgaaatagtttgagaatgatttgtattaattctccttcatagattgaatagaatccagtgatgaagccatccagttaagtacttttcttttttgtgagactttttattactgattcaatcatgttacttattattggtctattcaggttttctccttcttcctggtccaatcttggtaagttatgtgtctaagaatttatccacatcctctaggttttcaactaggttttcagttggtgtatagttgttcatagtagtctctagtgatcctttgtattatgtggtatttgttatgatgcctcctttttcatttatgatttttatttgggttttctttctcactttattgctagttagcccatattgtatgatttcaatcattttaattcttttcaaattcattttttgtctcagaatatggtctatgttgttaaatatttcatgtgtacctgaaagtatatttttctgttcctgcatattctataaatatcaaataaatggatacaataatactttcctgataatatattttgaatgattcaggaaaacttaagaaacgtaagggttaattatgccactaattaaaaaattcagaaactttatgacaactttcatctctcatagccactttgactgcacagtggctttgttctcaaagccttgaaattgagttattgggatgtagtagaagcagtttgaagaacaggcagtaagcccaccttctccattagtatgttctatttactttgacatggagattttgcagtagtttgacacaaatctgaatagaaacctatttaatttcagacttctttacccactcttagaatttttcttttgatagcagataaggattaagtaatatacacaggagacagtctaagaagcatatttatttaaatataactttgttataacatcaattgcgtgtaaccaatctcatgccaaaaacaaatgcaaaaattctgttgcttaggattttactttatgtgttttaagtatatattgaaatgtacttcagaacatgtgctttttaaaatttatccaactttggtaattttggtttttgaacatcccgtagatacctaaaggactcctttggagcagcagtgctatatggatcacacttcaaaagtgtaattctggggcagcaatatgaaggtcaaaacatctccctccaactaggaactggatatttaaaagaggttaaggaaatttgatgcactgtattaaaaattgtttcaacctttttttaaactttagtgtaagtactacaacattttactaagcaaatttggagttctaatttaaccgttttttcatgttctttatcttagattctgaggacaaaaagcaatgaacacagctttttagtagctatttcctttcaaactctctggagagcaatcaaattttgtaatctgtaaaagaacatacattaatgttttgttcaaagagaattcaatctataataggccttttaaagaaatatgtataaaggcccgctgtctgtcctttttgatattttagtgtatgtatttgttcagtgtagttttgtttctttttaagaagctaatattttaggaagaaccagatactactaggccaagtacattctttttgtgtaactagaaatttcaggtcttttagttttccccaggcaacatctgctaagaacatagcattagttacatactgcttggaccaaccccatctttgaatatcacttgtagacatagtcacctaaagaagcaactaaacgttgacctaggggtccactttggcaattttgcctgcacctcattccagcgtatgccatggactttttttctgtttatgaagaacgtagccagagatagtcctaaaatagaagctaagggaaaaaaacaaaactctcacttctagatgtgcgaactctagcaaaaaaaaagttttaaaattctgccctgtttatagtcttatagacagactcggattaaaaaatatactttaactgctttatttcataataaaacagagacttttccacaaacttgggaagtgaatagaagcaatccactttaatgtattcctcagaatgagtatattctcacgtctcaacttaacaggatattccacatgtctatgttgatcccatcactctcaattacacaaggagaccagtactgccacaattccaagccagagggagcagtccatctttcacagccaagggaaggactggagtgagaggaccattctcactatagtcatagctagccactcccacactggcaactgaggctttgctccgcccagtctggtagactacacttttctattcctaagatccctgtcttattcatgtacaagagttttgagagaaggcaaccccattcccttaatattaagtttaattatacagtttccacctgttcacttcaatagtggtaattcttaggacctagcactcccagtttataaacacaacgaacttcaaaggtgccatccagctcctcaaattcttgaccaggacagcttatctcagagttagaaaactcccaacccttctctctagaaatgtcttcattacattaagagacttttcttcttaaactgtaaaaacaaaacaaaagtaactgattagtatcctctttctctagacagtgaagtcattagtctactcctggaggccaccatgagttacataggaggtttcccaagacccatcacctgtgtgaaggtctatatacctagactttggaaaggaatgaaaataagaggcaagctacttttagtctctgtctttgctatcatactcttcctttaaactatttctctctatcccacctctgtctctttctttttctgtctccctgtttctctctttttttgtcactcacacacacacacacacacacacggacacacatatacaaaagcaaccctgtaaaaatcactgcttgtgtaaagcctaaaccataattggggttagaatttggagctccactagttacgcagagaatgatttctgtgggttcttaactttctaagcttcaaatttcccatacataaaagtgatagtctaataattgtgaactcaaaaattttgtgataaataagttaaataattcctatacagccttcaggacaatgcctaaaccagaataaaaataaagataatgataatttagccttatatttctccttccattttagtcaaaatatttttaccaatccacagatacagtattctctttcttttcttttcttttttttattttgtttttatttttatttttttttgatggagtctaactctgtcacccagactgaagtgcaatgttgtgatctcagatcactgcaacctccgccgcctgggttcaagcgattctcctgcttcagcctcccgagtagttgggattacaggtgcctgccactgcacccaaataatttttgtatttttagtagagacggggtttcaccatcttggccaggctggtcttgaactcctgacctcatgatctacccacctcggcctcccaaagtgctgggattacaggcatgagccactacacccggctagtagtattctcattttatctgaggttatctccacattgcacacacccatcagagatgctctctctcatcctggtgaaacataaccattccaaaacgcagtgaccgttcactcttcagcaaatctttcttagttgaaatagccctcactgcttccctttttctcttattcttacacacatctcaaaatcagttctctattagttccaggagttgtttccttgtccttcgagtaattctacatagacaatcatgttatctgtgaacaaagacacagctccaagggtgagaacgggagctttaaaatttcttaaagctcatgcctatagaagtcattcagtgccatctctgcatctgcatgcattctcttggccaaaacaagtcataggaccagtgtagattaaagatgtgagactgcgggagaggagaaacacggcaaagtcacatcacaaaaaaccacttggaatgggaacacgggttatcctcctttttgaaaacaaactgtgtcactaatattgtcagtcttattattacactcaaatggattacaagatccctaagagtaaaaagccatagttttagtatttctcaaataggtacaatgcactgtaatgttggaatgtgtctttagaaagataaaataaccaaacaatcataacacattattctcaaaacttattttatatttttgttttaatgtgtacaattgcaatctcatatttgtgttagaatcatttgtttttgtgtcttcatgtttctataagataggaccaatattctttattgggctttgattttattttgtaacttaaatgtattaaggcaataaatgtaattttccacttaaaactatcattatagatttggttactacctactgctcagcaattttttttcttatcaaaattcttcctggttggtttacttctcattttttttccattaaatgatataaattttaagatagtagtttttcttgttacattagttcagaatcatagattcatgcataatagctttgatattcaaataaccttcattggtcttgatacttttataattttcatttcagaatcccttattgccttccattgaattcttctggtttgtgttataacatttcctgtaatttgtaagcaatccattctgttttcaaaatcacttgtgtgtaaatttttctcattaccatgttcatttcagttttaactaaagttcactcataatatgtcatacataaagaaacacttaaaatatattagaactatttacattctatatataatagttatgccagaaacgaaacagaaatgttgaattaagtttagcctaaagatgctgtcttatgtgttttaagtttggcctaaaggtttttccatacatagtgaactgtaacctaactggatgtgtaaacagagtatagcctactcttgtaacaagtagccaagtctcatcccattacgacaaccatacttcaatcacacacagggtccacctgttcaaactgtgtttgaataagccagacaccagctgtaaccaatctggctgtttctgtgcctcacttccgttttctctatgtagctttcctttgtccatacatcctttccaaacctgcagtggagcaccatgctcagctaattcttaatttttttttctagagatagaggtcttgctgatttgcccaggctggtctcaaagtagtggcttcaagagatcttcccaccccagcctcccaaagtgctggggttataggcatgagccattgcacctgctggagcactaatttctaaacaaacaaacccaagatcaaattagccagtcagagtgtgtcctacttacattctgtacataaccctactaaaacctttatgtacttactgttatgaatacttttagttcgtccctggcagaggtgctaaatttcattccctgatatttagcatgatgtcaccaaatcgtagttgtttaataaacatttgcgtaatgaaagactgactgaatgaatgcatgaagtaactatcagctacaactactaaactaacatgaccaagattcaaaggaaactttctaaaatcttcaaaaatctaagttctagtgctctttcaagacctcagaactgccttagagagtttaatggaaataacatacataggagtatggggaaaagtgctatttacttagcaactatgtgtcagacattttataagtagtgtcttacgtactttcttagtaatattttgaagtattagtagatagcatttatctaattttagaaataagaaaatggaggtgggctaataagttgtttaagattccaaacattctgtagtaaaaccagtattgatcctaatttgatggactttaaacctgctgagcctctgtctggtggaggaaaaaaaaaattaaaaaaaaaagcatttttcttccttcttaggttcagtggctgaggcctgtgaattatactgacaaaagagagattatcaagaataaatatttatttgatgtgtaggggctggggaggaacaggggcagctcacataaaagcaaggaataccccaaagaggcagttggacccgggccctgtatcccattttaacaaagtgtgataaagtgtggggaagagactagataaagaaaaggagggtttaatccctgggtggccggagtaggttgtgggaaaatgactaggaaatgtgtagtaaataagggctatttagtaaggtttgttatgcaaccttaaggcatctcaggtggtgacttattcacttctccctgatataagaaagtaggacacctttacaggtataagtttcctttacaaccagaaaattcatgccttgctgaagacagttcatcttgtgtttgctatttctaattgccttcagcttaaaatactccttatgctaaagtggcatattttggggtagcatattctgatctctttcaccccaaccaacaagactgtggctgttggcaggcaaacattacatcttatttatttacacttctctgatgtctgtaacagtgcatagcacagagtaggtatccagtagatgtttgagaaaaaaaaaataataaatgggataattaacatttttggcttctaggagattattttcattccaaattggccttctcccgctgttttttcccctcatactggtgacataccctcctgtttggtcagaaagaattctgatcttggatcatctgaaatacatttactaaaaaaacctgatatgtatttacatattgaaagcacatctgacttaacatttaggagcatgggctagcaatcttactagtttcaagccttggctccaccaagtgacttgctctatgaccttaggtttcatagcctcttaagtctcagctattttattttaaatgatgggcaaggctttttgctgtttggtttacttataagtcctgagtgcctgaaacaaaataagtattcagtatgtttggttgaataagtgaatgccatgtagtacctattttggttgtcattggctttaaagaggtgaatatactttaagtggttcaagagctcccacaccataggagcttaataaatgttagccattttattatgtaagtataacccttcacacactttcactagtcatttgttataacattgactttttcaaaagttctgtggaaatgagttataagactatccattgttgaaggcaatgttcttagttgtattcattgttatcaatttagtcattaaaaaacatttgctttccttatcaatacatatgcttcattttattagtaagtagaatttcataacccatcctgttttccatttctcttgcatactaggaaacacaaagtgaaatttggttctcgagctagttcagtcacataatgttgttggtaaaattatctataacatttggattcttttggatataaatttgcccttgataggctaagctatattatattttctataatcttgtgttctataatattctaaaatatcgttctgtaattattttatgagaaacattcttcataaatatgaaatgtatatcataaatcagtttgtttatgatatacatgtttttcatgtaatttaatgatttaattgtaattatcaataaatatgcgaaatctaaacattcattggcaaatatagtagaaactataatgaattggctatagtgtttctcatgttagacattgttgacctaaaaagaagaaactgaggtgaaattaatggagtgtttatctgggcaaagcttgaagattacaacctgggagcattgattcaagttttcctaaatgtacactccaatttgtggcagctacaagtgtttgtgttcttttttttaataatttcaactttcattttagataccgggagtatatgtgcgggtttgtaaacatgtgtatattaagtgatgtggaggtttggggtacagatcccatcacacaggtagtaagcatagcacctgtagtagtctgttttcatgctgctaataaagacgtacctgagaatgggtatttataaagaaaaagagatttaatggactctcagttctacatggctagggaagcctcacaataatggaagaaagcaaaaggctcatcttacatggtggcaggcaagagagaatgagagccaagcaaaagaggaaatcctttataaaaccatcagatctcatgagactttttcactaccatgagaacagtatgggggaaactgcccccatgattcaattatctcctactgggtccctcccacaacacatgggaattatgggagctacagttcaagatgagatttgggtgggtcacagccaaaccatattggcacttctacactaaaaagtatccaagacaagtctcaatcaatttagaggtttattttgcaaggttaaggacatgcccatcacacaacctcaggaggtcctgagaacatgtgcccaaggtggttgggctacaacttggttttatacatttagggagacatgagacatcaatcaatatgtattaggtatatagtggttcagtctgaaaaggtgaagtgagggacttccatgttatacgtggaactggaagtgggggaagtgggaggcttccaaactggaagtggggttcttccaggttataggtggatacaaaggttttctgattggcaattggttattatctaaagacctggaatgcatagaaaggaatatcttgtttgtgataaggggttatagagaccaaggtttgatcatgcagacaaaacctcaaggtagcaggattcagagagaatagattgtaaatgtttcttatggaacttaaagagtcacttctattggtcttgaggtctgcattggtggtaacaaggcatattttcaggttaccttcggaatgcccttggctgagaagaggggtctattcagatgactgggggccttagaattttatttttggtttacatatccaataggtagcctttcagcccacagtgccctccctctctctgtcctctagcagttcacagtgtctgttgttccgaggagtgcccaatgtttagctccttgttataagtgagaacatgctatagttggtgattttttttttttaggagaaagaggcagttcctgaattgtttactaagaatttacataaaaatagcttaagctattgattagctatacgttgttctctatatcagaaattccagaaacaagaggataaggggtgaagcagctaatcaggaacaaaatgaattgaaataattgcccccagacgtgggtgcaggggttgggatgtggagtgttggagggtgaaggcatgactgatgtcccacgctcatatctctctgggcctgcatacctcgcatagttcatgctattctgagctattttacttttctcaacatttagatatttgactatagaaatgcttataaatataatttatacacatataaatggcatgtttgttatttatttagtttgagctggagacttgctctgtcacccaggctggagtaggagtacagtggcacaaatcttggctcactgcaacctctgcctcccaggttcaagcaattctcctgcctcagcctcctgagtagctgggattttaggcgaccaccgccacacctagctaatttttgtatttttagtaaatatggggtctcaccacgttggccgggctggtttagtctcaagctcctgccctcaagtgatccaccaacctcagcctccaaaagtgctggaattacaggcatcagctaccacacccagccataatgtcatatttattaccttaattatgatatttataattttcaaatgcagtcttttaaagcaaaatcaagagatattcaaggacctttgaaaatgcaaaacaattatttatatttttaatgtgccttagaaatagctcaatttacactgtcgaaaatttgcatatataatttagtaaggaataattccacagtactcagtaggacctattaggtttcactagaataatttatattagtaagtcacaaattaatgcttatggacttttcaaaagtttatgtgtttcaagagaaagctaactttgcaaaaagggtttatgaaatcatctaattaattcatacattataaaaaccacattaacaatctctcaattttctttcctccttttgtatagacaattaatatagaacattttaaaatagactatttgaatattgaaaatccaattacaggtaaagtaggtggagtaatttgaaattgcattctaatacttataataaataatttgttttcagatcataaattgcttactataaagcttttctaacacttataaaatttatggcaacttgagtatttgactcatcatgtcacttttcaggattgtctttctttttcaggaatattaggtgttctttgttttaacttttaagttcaggagtacaagtgcaactttgttacataggtaaacttgtgtcttggaggcctgttgtatagattatttcatcacctaaatattaagcctagtacccattagttattatttctgatcctcttcctcctcccaccctcagccttctgataggccctagtgtgtattgttccctttatgtgcccatgtgttcccatcatttagcttccacttacaagtgagaacagaggcagtgtttggttttctgttcttgtattagtttgctaaggattatggcctctagctccatccatatccatgcaaaggacatgatcttgtttcttttttttttttttttttttggagacagagtctcacattgtcctgttgccaaggctggagtgcagtggctcgatctcggctcactgcaacttccacctcccaggttcaagcaattctcctgcctcagcctcctgagtggctgggattacaggcgcccgccaacacgcccagctaattttttgtatttttagtagagatggggtttcactatgttggccaggctggtctcgaacgcctgacctcatgatccgcctgccttggcctcccaaagtgctaggattacaggcgtgagccaccgtgcccggctgatcttgtttctttctctcccttccttcctcctttcctttctctgtcttcattctgcatttatctttccctcttttctctgttaatctctttcccttcgtttcttctttcttttctcttttgcctgtattcccaattatagcggtaacattacttgacttcaattgatgggacttttacagtttaaatctttatacttatttatattccaaattaattataagacattcttttttttaagacattctaaactactttttgccttgaaatgtcagtaagaataatatctaagaaatgtgtcctattttagtcatataaaacaaatgtatcaatttacatttatattttcatttaaaaatacatatgtagaacatgttatgtgtcagaaaccatccttagaagcacttctaaaatgtagcggatttaattgtcatcattaaattattaaataagcataccttattcatttcagttaggtattattattatgaccactttatacatgaggacttaaggctcaatgaattaggtgattttgtcaagggcagttcgtttgtgagcaatagaatcaagattcaaacctagacttttggattatgtaaccacatgttatgtgtggagggaaatttaaaaaacaaaacaaaaactccagacaccaaaaagcaaacaaaacccctaaacaaaagctaaaagctgaattctgttctttagactatgtctaaatattatctgtcagtttttacacctcttttttcttaacagatgactggagggagtgttgtattatagtataatggaaaaccttcataaccttgattacagcagctgaagaactcttgagagagaaaaaaggaagatagagttttgcctcattctctccttatttagtgttctcagaagtcattcttaatcttttacctcaattatccttagttcatttatgaaaaaatacaaaccattcaaaccctctgtcatatcatagcgtatgtgtgacttgactttatgagtgaaggctttctgtacgtgtgttctgaaataaaagcttaatgaaaacatctatttccttttctgcagtgtgcagatgataataacgaagcatgtggcaatgctacagcagttatagtcacatggatccgggacatactagaaagaaacatgtcactgatccatgggcctgtaagtgacacaagcaaaggcattcttacataggttcactgcatctattatttatctgatagaacatgtgtgaaggtgttacaagagtgctggacttaatatggattactgtggaacttcctatcaaagctgatgagatgaatactaaaaaaaggttaatcaaagtttgacactggcccttacagaagccagagctactaatttccaaatgctacaacttttgaatactctaaaataatcctagtggcagtgtcaacagagtgctatgggaaaagaaagtgcggaggatcagtgttggcttaggggcctcagaaagcgtcacagaaaaaatgattgtttattgcagagaaaggagagaaatcaaacagggtgcaacaagtgctaagtcatggcttgtccagaatactttagaacttcctgtatagttgagtcttgccttttgggagacaggaggggttgggaaagctaggattacaaataaaattggtgatattcagattatagttgctttgagaatatgcagttatttgggggtgtttagaaatggtgttattcatggacacatagagggaaacaagacacacagggtcctgtgggtggggggtggagggtggagggtggcagggtggcggggggagagggtagagggtggaaggtggcagggagaagggtggggagtgggagggtgggaggggtgggagggtggtgggggagggagatgggagggtggggggaggtggagagtgaaagggtggtgggggatgggagggggtgggaaaggggagagtgggagggtggagattgggagaaaagagaggaatgggaaaaataactaaaagtaattgggtactaggcttaatacctggatgatgatataatctgtacaacaaacctccatggcacaagtttacctatgtaagaaacctgtacccctgaacataaaataaaggtttgaaagattaagtgccttgctaaaagttagagaatatgttaatgtgttatattcagaaagtaagagcttctaatgctttctactcccttccccacaataattatgctagttttctattcatcatctctatctaagtattccacatagtatttcaggttaatgaatatttttatatctcctatttccagataaaaccatataaagttctctcaggtcagacgcacagaaacacatgtataagctacatcatcatatatcatcactttggtgttttaagtcatagaaccattgctcactgtagaacaagacagcaaaaatgatgctttatgaaaacagaaagtaaatttcacatctatcattcatcttataaattctttgtatcaaaattttaattaattagagtgacctagtttcctcactgtggaagaacaatatatgtatatacgtatgtatatgtatatatatatatttttaatgtaagtactctctcatccaggaaatgttccctgttgagtgataagcctagtgtgagaacataacgttcagccagcaaaggttatattacattaatctttgtacactgctcaatagttaagaggtttggaaccgtttatagtaaggaccatgctatcaggttttatcagtggcttattacataggtgacaatcaaaacattattgccaaacttcatgttagttcacagatttaatatctaatatacattttacagttatttgaggcaagttaccttcatttctgggttgcacacgtatcactgggagaaaatgcaaagtacataccagagaagaggtgagttccctttttcaagcagtgcaaaccacagaaaaacatcaagcaaaagatctaatgtaactctgttgtgaaaagagttgtacaagttgtactagtaactaaaatacacctagaagaaaaaagatttttggtcaacagacatttcagggcaaagatatttgcattgctaagcagaaatacattatgcataatcggttaatagataaggaagaaaaattcaatattaaagaccttcttttgtacccaatgtattataatctgagctagatgtgttccatgcactggattgtttcatcctggtagtaatttataggtgggcattatcgtctcagttattatgaatacatactactgacatggcagaactgctattctgtcaccctcacattaatctctctctacttcctgtgtttgtatacatatataacattgtatataaagtctttttcttttttttgagacagagtctctctctgacactgaggctggagtgcagtggcaggatctcagctcactgcaacccccgcctcccaggttcaaatgattctcttgcctcagctttgccagtagctgggattacaggcacctgccaccatgccagctgatttttgtatttttaatacagatggggttacaccatgttggccaggctggtctcaacctcctgacctcaggtgatatgcctgcctcggtctcccaaagtgctgggattacaggcatgagccaccatgcacggccaagtcgttacctaaaatatttcagtgatttggcggggagtgggaatccttgttgcttaatattttcctcaataaaagtgtcaaatggttaatctctttatagattatcttccttttgatatttataataattatatttgaaactctcagaagaccagatgaactcaaactacagtgccacaagagacattggaaattctgtgtgtcataccggacattaattatatttcaaataacaggaattcctttaaacaggctgaaacaataaacatacaaagagtttactcagcatttattgtgtgttgtgcatttgtatgtttgttcaatgagtcacttaccccataggagaagtttagtcacaggatttttcagaaagcctaagagggtcatgaatgaaaatatcctcctattaagatattaagcctatcacatgtggcatataagtgatgtgaaattcatgctcttaagtgatgtatttcaaaggacagcctgtttcaaggtatggtaaaatgatatatgtacaaatattgccctgtgggtgtgtagaactgaggctcttaatgacactttgacgatttgtgagactcttgccatcctgtaaatagtcatagcagctacacctttcactggaaacagggaattttcccaagatctgtctctcaccttctggttcaaaaattcttgctctcctttgacaagcccgtctcttgggttacggctctctctctagcaaatcctccagaggataacaggagagtctgtgcactgactttcagaggttcccttgatccattgcttttgagctgaatctaatgccatagtgcagaaccttacactggacctgttgccccatgattttgattcccagaagtggagatgttggctaccataccatattccaaaatataagatgagttcacaaaccagctgaagaactcacgaggaagtgtcagggcaaaggcaactttaagaactgctgttttcgatgagctaagtgagaataaaacaaaaattcccctatttatgtatcaatagctatgcactgacagtttttacaagtgtaattatacacaagcaaatggaggtaaaaaatcaaaatatcctccagaaccagatattcttgaatttaaagacttatttgactactctaaatctctgaaaacacttctagtattcaaaaatgtggcataacttatgtgggccaactaaactagaaaatggtgagttttaatatttatatgatgacaagatcaccatgacagaatagaatgttcccaaaacagcttcgagcaataatagatccagcgcaaaaaaaaaaaaaaaaaaaagctggaggatttagctctgccagttattgactatgtgacctggtgcaattactattattacctatttgacattttcaaatcacatgacttacttcacaagtaagaacaccaatgtccctaccgaggtttgttttcaaagaatcaggaaacccaactccagaaagtgctattcatactgttttcatgaatggtgctccgtgaccttgataacatatgtccctagagctgtaagccatggatttggctttcagatggtgtcaattaaataatgtaagctaaagagccacagattttaaaatgttacataaatcttactgagaaagtgattaaaaataatcatcttcaagctcacaccaaatgacagttaatacagagtattttagtcctcataaataataaaaacaagaatgatgcacaggtaccattattttcaacattgttctaaagatgaagaaattaaggtatagggattacacatctagatagtggaggagtgaattttgaaacccaaacgagttgacataaaagaatgacaaccttttaactgccaagctgtatccactatcatgccgatttcaaaggatagcatggtattgtgccgctttattttttgtaaaagaaccaacaatacatgcaacttgaaacattcctatagatagatgattttatgattgccagggtgtttgagatgacacacaaacaacatgcatctcagattactgaatagaacagagaattgcatggacatatatgaacattatgtatcattagggttttggttcatctttcaagtcaagctggtacaggctggttgacatttcctggtaaaagggtgggagaaccaaaaaaatacatcctttctcagatatgacttttgtgactatcttgagaagaagaatccatgcccgatttatctctgcatttctgttttcacacagaacaaataagtgctgaataaagtttatttgaatgaaaaacaagcctacgtagtaataacaatgtggaaaggagtaattattctgtcctgaggtgcaaaagatggtttaaaaaggtttctaggtgaattagaaaaaaaaaatgcttttgacatctaagacatgtgtatatccattttccttactgatatattttctattaaacttagaaataattatctgcctaatggaaagaactgtttataattgatgtatgtgaaaatgagctgaaagaggaaaacattcagtctatatctctacagttatgtgttcaatggtagtattgatactagcaaatgtatttggttcttctactttgtttaatctatttaataacacttagtgtaatattgaccttgggattcagaaaaaaatattccaggtgaggcatgatggctcacacctgtaatcccagcactttgggaggctgacactggaggatctgttgagttcaggagtttaagatcatcctgggcaacatactgagacactgtctttacaaaataattttttaaaaaattacccaggagtggtggcatgtacctgtattaccttgggaagctgaggcaggaagatcccttgaacccaggaggtgaaggctgttgtgagctgtgattgcacactgcactccagcctgagtgacagagtgagaccctgtctcaagggaaaaaaaaaatcaaacaatttttgaagtcagaatagagtagcagtgcgattgtacgtagcctgtatgtgttgcgtgtgcagaatgcaacatatttccatggctacttccgaaatttcaatcatcctcttccagaatttccttctccagttaccaacaaatatttattagggaataaatatgtgctagccactgagatacaaatacagacttatgtactcctctcctagggactgtattctaccatggaactagatcttctgtaagatcgaggcacagatcatcggcaagtctaaaaggaaattaaaagataatttttaaggagttctaattttccttcattgttgatgacttttcacagtattacttccttgttggtatatgagaacaaaatgctggcttgtcacatggttcttagaaagactgtctagtcataagaaacattacttgacttacttaattctctggcagttttataatggcatatacaatttctatacactactttaaaatggagtcaatgtaattttcagcaaagctttggaacagattcagccaatgtttgtcgtaacatagggatgcatgctggaaatggttctctctgcttctgtggctgggtgctcctggagccaatgctatactgcaaaaatgaagcactatgttgatgatatttctttaatcaattattctgccaataaggtgcgttagtttatatgcctaactagcattcttcttctgagcgaggtgcatgaggtacctgagagatcactattattgtgtcattgaatcatagttctattattttcagagaaaattttcatttctcaacggttaaatgtctctacaattcagtatgtctcatgcctagctctctaaagccacagaacttatcaaaactagtcttaatatctgtaaatactgactgttggttaaaagtctaggccctgtggttaaactgcctggaatgaaatcttggcttagatactaactaaatatgtgatcttgagcaacataatttctctctgactgagtttcctaatacacagaaagagaaaagtcacaccagctatatagggtcattgtgaggtttaaatgagatagtacatggacaaaaatgtcttgccaaagtaagcacgtaacggatattagctacagtcctcatcattgtctgtgcccctttttgtcgtgtatcaccatagaaaagaagggaacgactcgacttaaaagttttctggtagttcttatctaaatgatgcaaatagatgaatttttaatacatggatgtggatttgtgatatttttaggcttttgtgtttgcacagataattatggctttttaaagaatcaagttatcagatcatttcattttcagatattaaaaaataatgaaaatggaaaagtacattgaaaatgtgatcattgagggaatatatttagcaataaggagatgacaatgcaaccaggaggggcgaagagagagacagagatataaatgagcaaaactttctttgcttttgcaagatctgttgtttataggataagcccagttgttttgcagtctagcactgatgctttccatgggaagagcacaggctgtgtatgtgcatgtgtgtgtgagttcaagtggttttacattactaatgaaacacagacttttcccaagataatcaactggggattataatttacagcaaagaaggtgtaggtgcagaaacttaatttctgtggctaaaaacagctggaagtaaagatgtcgctgaaaagacattgttggtccctaagctagtattgaccccacatggagagggaatcccacagcattaaataggcgtctgtagacacaaactgccatgaagtgattcatttataaggaaggtactaattttaaataatactcaaatcattgttaatttctgtactatttaatagtattaatcagagtgaactcatctgatacagcaataatcataagaactgttctataagtttcatttcaaattctgcaataatcattgtgtcatcatgttatcacatactgttatgcgcatccatgtgaagcgaccaccacacaggctttgtgtgagcaataaagctttttaatcacctgggtgcaggccaactgactctgaaaaaggagtcagcaaagggagataggggtggggcagttttatagaatttgggtaggtagtagaaaattattacagttaaagggggttgttctcttgtgggcaggggcaggggtcacaaggtgctcctgagattcattgtccaggagaaggagtgtcacaaggtaaattgatcagttgaggtgggacacgagcaaatcacaatggtggaatgtcatcagttaagacaggaactggctatttttcacttttgtcgttcttcagttgcttcaggccatctggatgtatacgtgcaggtcacgggatatgatggcttagcttgggctcagaggcctgacacataccaattggagaatgttgccatgaaatgacataaaaacaaagactattaatgactatcctaattatactaggaagtaaatcaaaactcttcatcagttagctaccattcttgttagctgattacagcatgcatgtaaaaaatgtctggtaaaaattatagtatgtaaaactaagatatttagctatgaaaactttctatgttcatcttttattatacagcttacatgatgcttcaaaaaataattataaatgttggcatttttaaaacactttttcacgaatgtatttgaaaagtctcttcatatcagaatttaggaggcatacacatatgctgttatatacagttatatatactttactaaaaattgtttccttttgacttgccctctgatgagtaacatttcacaaggttactcgggtaaccttgagtaaattactccatttggctaatccttagtttcttctctatgagtggtgatcaaaatgcctaccctgtcttttgaaagccaaattaagataggggttatcaagcagtgaattgccataaaatgtattatgcatattttatcacatttgtattgttattataaatatgtgtttatatgtatatcctccttagtgaccatgagatcatccagggtaggagctctctggaaatttagaaaacaaaggaaaaaaaaaattgaggaagtggaaaatacaaaggaattttctcagtggtgtttgttctataagctctaaacagtaggccaccaacgtccttgagaatctttcatttatctgtctgtacctcataattatatctgtcactctcgttttattatcagaagatttgcacagttcattttaaagtctaacttgtcctttgtgctgactgccacgcatgtctgatgaaatataacaaattgaacagaggtgccattattaaagcaatctgataaaaagctgcagttgtgaggtacactgaagaatatatttggtttcttcagggaatcaaaagcatttcacatttaagttattttctggaaacttttatgtgaatatactacattttatcatgcagaaatactgtgtatcttttctttcttttgtaaaagagagcaaacaggatggatatatcaatgagttactactaaggtttcagtttttctcatatgacagaccccctgtaggaagaggaatggtgtttccatcaaaatttgattatttttatattaatatttttattaatttttttcaaatttatatatatctatttaaatcttaagataattttgcaaatagccacacacacaatttttctaaatttgatgagtcttccatttcacataattacaggaaattttctcttcatgtgattcctatctgcaagaattccatttactggaatcgatttaaataataccagtcttccaacaacagttcaatttcaatccacagcgtactaaccataattgcataaattacaaactttgctgctaggccttcagtccacaattcactacataaagaggagacatacgtcatgatcagtaaccaatcatgacacttctttcaaagtctccagtgattggtcactgcacatgtataatttgtataattcagtttatgcagagacagggacttcattcccctgtgttctgaccagttggagctcccaaaatgcctgtggctacagtttgctcacagtggtcacaagtctattgaaacatgaatcttattaataggtttttgtttctccagattaaagtcacaattaccaaagatttaaataaatgttttgtatatgtgaaaactctttaatggcctcatttgcaagttgttttatgcgtatgatagctagaatctgctctcgaccagtagaaggtagtagcatttgccagaaattttgtaatggttcacagacaattctatgcaaacaaggtaatatttcctatgtttttatgtataaattatttaggaaaggggaaaatacatcatgataatttttgaaagaaaaaagcctttaaaatttttctgtttctctttttctaatttctaatacagtttattttgagtgaaaaggaggaaagggaacttaatttgtgaagcaactgtttcattttgtcagtcctctgggctaaaaatatatagaatgattggaaagaacatgaaaaactgtcatctggaacagttcctaaagtgaatgtgcagtcacacctttactattctctgattatgctgtgattctggaaaataaacaaggtgtgcatttctcattgaaatatgtcttggaatcttctccaaattaatacctgcatgttatatgatgcatatccatatgtgtacctatagctgtttatgtgcaaatgataactactttaaccaaacaatttccgccattttcttaatatttccattgggtaatcaccttctttaggaaaatgctgagtcataatgataaatataaagccactaatttggatctgtttcttttctctaagcaatatgttcaatgagaaaaacatgtaaagatgctcctcgatttacaatggagtcacaactcaataaacccattgtatgttgaaagcaatgtaagttgaaaatgcgtttaatacctagcatgcatcacagcttagccaagcttactgtaaacattctcagaacacttacattagtctacagttgagcaaaattatctaacacaagttctattatataataaagcattgagtagctcaggtaattcattgaacactgtactaaaagtaaaacgcagagttgtatgggcactcaaagtatgattctactcaatactcatttgcttttgcaccatcataaagctgaaaatttgtaaggcaaataatcgtaagtcagggagggtttgtagtttcctttttaacaaaatggcagaggattctttatgtgtttccaatgtttctttactgaatgttagagccaggttcgtaattctacccatactaccaaccccgaaactctcctcccccttttgcattcactctcatctcaaatctctatgtcttgcaatggtcaagttggcatgaattaaattgtttaacctgtaaattcaacagtgttcagagatgtataaaatgggcaaattcagtgactactttgaacaatggaaacatggcttttcaatggtaacgtcttggattggattcaaatcaggcccctaaaaatttaaggtcctaaaacccattacgaatgttctgagacatccaatgatgcacaagggtccttctagaactgctagctttaaaatgtgtaaaattggtcagagatgacagtctaactagcaaaaaaggaatgtgtctttcaggttcctggaaataatgggcacatttatgtttttcatctctagttactgtcatctctgcagtcttacgtagtcttctacatttccttttgtcttgtaaaaatgcttttctgttagagtttatgctttcatacaataaacatttacatagagacctgtcacagtggtgagcatgtaaaatgcatttaggaaatgccgtttgatgttgtatttgaattgacattttccctacataaaaacctttaaaacttataccagtaaaggccaactttttaaaaggtagtctccttttatgcatactaagagttatcctgttggaaactgcataagcatctaatcagtgcttgctaattgtgggtgctttcagccagagcatgaaattgggcacacaattagcaaactgaagaaatgtttaattgcaagtgcaattttaacctattgtcaagagggaaaatagaaaggatgaaaatgaccattttgattgtggttaacaaagaattaaaatagataaagagtttggacccttgaggagcaaatctcagttccaatatttatttgtctaactttggacaatcccttgatcactgtaagcatcagtttttgttgttttttcatgtgtaaatggggatcataatgttttaattgcaaagtttctgtagctatctgagatagaagcttgaaaccacctaacatggtgtaaattatgtatgtgatagccactcaggaagtgattgctattatgactattattttgaatattaatactactgatgctacaataaagcaaaccaaaatgtcatccattttttccctgcagttcgtcagccaccatggtatgaaactgccatgaaatacactatccattatgctcttaagtattccttaccttgaactatagtatacggtaaaagggcactggacttgagatgaaggaagtgagttttaattctgattgtgtcatttacttgagtaatcttgaagaaatcacttgatatctctgaaattcaggcttgttagctataaaatggagacgatacctacttcaaaagatccaagagagaatagtaacaaagatagcattgtgcttgacatattagctgtgtaataatcttccattaagtttaataaaatggctctgcatatagtgagtgcttctagaaatttatgctaagaattaagtttattttcactttcatgtattttcttatgctgatgttatgaattagatgtcttattttttgacattatgtaccaaaaaaaaatctgcaagcagaaacaaataatttattcaatcaaaattttataactccattaactttgtttcttcttactctctatatgtgttttgaggttttttctttgattttcttattgtacatgtgttgttattattgaaaatttttgagacattaatagtaaaataagctaggctccaggatacttagaatagggaaaaatattataagatataagtttaattcttattctgccagaatattataccttgacaagtaatctcccctccctgggttctgtttcctcatctattaaattgcaatgttactgacattagtatttttatcagtgccaaatgaaatactgagcaacaaagtatattttaagattgaaaagcagtgtaattattgatttttattttaagttctggggtacatgtacaggatgtgcaggtttgttgcgtatgtaaacgtgtgccatggtggtttgtagcacctatcaacccaacacctaggtattaagcatagcatgcattagctatttttcctaatgctctccctccccatgaccccatcccccgaccagccccagtgtgtgttgttcccctccctgtgcccatgcgttttcattgttcagctcctaattttaagtgagaacaaaaaagcagtgtaattattttaaaattccagattaaaaaaaatcatttcacataaagtatgaatatttgcttcctggttttatgaagctaaaaataatatttttgttcagagaaaaatcatacattgtttaagaatataattggaaaataagaaaggtaagtgatgaactgagagaagcaaggaatataattaaaactcagcatctagagagctaaggaagagagctgctgttgtaaagaatagacaaagggctaaatagaaaataatttggggttatgtgtaaacaatacttttcattttgtgaaaggtgtaagttccatttatagatttacacttttccacgtggatatccacttgttccagcatcatttgttgaaaagactactttttccattgacttgcctttgctcctttgtcaaagaactattgattatatttgtgtgggtctatttctggactgtctattctgttacattgatgtatttgcctattctttcaatgatgctacccagtcttgatcactatggcctaatataaggtcttgaaattgggtagggtaggtcctctttctcatccttcagtattgtttggccatgctgggtcttttgcctttccagataaactttagaatcagtgtgtcaatatttacaaaataatttactggaattttcgttgagattgcattcagtctatagattaatttgggaagaattcaggttttaacaatattgagtctttctattcatgatcatatctttacatttattcaaatcatctttgatttaatgtagttaacattttgcaacttttctcatgtagatcttatacatattttgtcggccttatatctaagtgtttgataatttttgtgctaatgtgaatgattttatatttttaattttaaattctgagtgttcattgctggtatataggaaaacaacttttgcacattaaccttgaatcctacaacattactataattagttaattgttcctggaacttctttgttgattctttggaattttctacataggtaatcatgacatttgcatactaaggtagttttaattctttctccccagcctgtataaattgatttccttttctaattgcataagctagtactttcatgacaatgttgaataggagtggtgagaccagacacccttgtcttgttctctctcttagggggaaagcatccagtttcacactgtttgctatgatattaactacaaaaactacgtttttgtagatatctattatcaagtagaagttgttcccctttatgcctaatttgttcagagtttttatgagaaatgtgtgttggattttgtcaaatgccttttcagcattatagatatgattgtatgatatttcttccttagcctattgtgataaattacattgatttttaaattacattgatttttaaattaattaattattttttttgagacagggtctcactctgtcacccaggctggaatgcagtggcatggccacagctcactgcagcctctacctccctggctcaggtgattctcccacctcagcctcccatgcagaactataggcccacactaccatgcccaactatttgtttttgattgtttttcatattttttttgtagagaaggggtttcctcgtgttgcctagtctggtcttgaactcatgagctcaagcaattcacctgcctcagcctcccaaagtgctaagattacaggcgtgaaccattatgccaggccaattaatgtttaatttacaaataagcatatatttagcatgtacaacatgatgttttaaatatgcatattttgttgaatggctaaatagctaattaacatatatattacctcacatggttatttatcaggttttgaatttgaaccaaccattgtatctggaataaagcccacttagtcatggtgtataattctttttatacattggatttgatttgctaaaattgtcttgaagatttttgcatttatgttcatgagagatattagtaattttcatttcttaacagatcttagtctggatgtggtgttggagtattgctggcctcctagaatgagttaggaagtattccctgtgtttatattttctgtaaaagtttgaaaaaaattgacttaaattcttccttgggagtttggtagattcaccagtggaaacatctgggactgatgctttctcttttgaaaagtaactaattgtcaattaaatttattaaacctattcaggttatttatttctccctgtgtgcaatttttatattgcgccttctgtggaatcagtccgtttcatctaggttatcaaatctgtaagcatgaaattgtttaaaatgcttacgcctaatttcttaatgtctatgaagtcaatgttaattactctttttcatttctgatcttagtgatttgtatgttttctctgttttctggttagcttggttagaggattaacaattttattgaacttttcaaagaacactagcttttggtttcattgatttactctactaatttcctgttttcaatttcatttctttctgccctaatttgtattatagatttgcttctgcttacttcagatttattttgctgttatttttctcactttctaaagcagaaacttttatttattttagatctttcttttctaatacatgcattcagtgctacaaatttctctctcatcactggttttgtcgcatcccacacattttgaaaagttgtattttaattttcacttcaaactatttttattttttcttcagacttcttctttgactcatgtaatccttaaaatttattgtattctgcaaatattttggaattttcagcttctttttatttttgactttgactttaatttcattctggtgtaacagtatactttaaataacttcaatagtttaaattcattaagctgtgttttgtgacctagaatgtggtatatcctggtgaatgtgccaggtaggcttaagaagaatatatattttgtgttgtcagatggtgtaattaaaaccagttaattgttggtgctgttctgattaactatgtcttatttggtgtgtgttgactctgtcaattgctaatagaggggtatcatagtcttcaaccataatagtgggtttacttatttccctttgcagttatatcagtttttatctcatgtattttgacactccattaggcacagacacaataaggattattctgtttcatcagagagttaatacctttttaaatttatttatttatttatttattttgagacagggtcttgctctgttgcccaggctggagtgctgtggcgcaatcttggctcactgcaacctctgtctcctgggctcaaacaattctccctgctcagcctcctgagtagctggaactacaggcatgtgccaccacaccgggttaatttttgtgttttttgctagagacagggcttcatcatgttggccaggctggtctcaaactcttgacctcaagtgatcttcccttctcagcctcccaaagtgcggggatcataggcgtgagccaccacgcttggcccttattttaaatgcctcataattttccttactcacaagtctgctttgtctgaaatttatatatttactctagatgtttttggttaatgttagcattgctgtatctttctccatcccttcatcttaatttatatgtgtctttatatttaaagtgaatttcttgtagccaacccatagtaggttcttgtttttaatccaccgtgataagctcttttgattggtatattcagatcattcacatttaaagtgattaatgatatatttatattaatgcctaccataatttataactgctttctagccattgtccttgtttttgtttttacattttgttttgttttacatactttcctgccttcttcagtttgaagtgcgcatttgatattttctactttctcttatctcttttttacttctattttacctgtttttagagattaccttagcgtttgcaatatacatttgcaatatacatttgcaataatccaagtccactttcaaataactctaccttacttcacaggcgtcacaggtacattaacgtattcccaattccccctatgtcatcacatgtaacattgctcattcatttctcatttatctgtaagctagaaccatccaaaatattgctgctattattaattagaacaaattttatgttgtatcctctaagaaccaaaaaaaattattttaccttcatttattttttcttaaatactctttctttatgtagatccaattttctaatctgagtcatttttttctctgagtaatttcttttaatattttttaaaagggaggcttgctaccgaaaatattacttcaagtttcatttttctgagaaagtcattatttcccttcaaagaatttcacttgatacagagttctaggctgtacttttatttgtttttatttaaatatttaaaattttataccactctcttcttgcttacatgattctatacagtgttggcttcctccaccccttcttggcttctttgaagattttcttcttgtttgattttctgcagttggaatattatgccaggaaggagatttttaactgtttatcagagagtttggcactctctgagtttcctagaactgtgatttgttgtctgtctttgaattcgaaaaagcatcagcattatttcttgggctcttccttctgttcctttctctctctctttctctctctcctccatatattatttgcgttatgcacattacacatttcgtaacactcatacatgtgtagaatgtgctcttccatatttttcatttttttactctttacattgtaatttagaaagttcctattgacatatcttcaaacacattatttccttgactgtgtccagcctactaatgaacccatccaaagcagtctttatttttatcttttttttctttctttctagcacttcctttcaattctttcttggagttctcatctctatgcctgcattacctatgtattctttcatgttgtttgtttttatcatttgaggttttaatatactcatgatagttattttaaattcccagttcaataattgcaaagtttctgctgtatctaagtaggttatgatgtttgttttgtctctttaatctgtgttctctgactttaacttgccttgtaaaatatgatgcatgagggaaaataaaacacatagtgccttagcctgaggttttatgttagtctgcccaggatttaagctgtgtctactatttgctgtagctatatgtgacagagactaaaatgtttttgtctcccctgttgttattgggttgccacagagaacttatcttaaataagatctgagacatgaaggcttttcacttgtattccctcattattatgcaggagttctgctgatgtggtgatagggtgtgagggaggataggcattctacagtctcataattaggtctcagtgttttagtgagcctgggcccctgggttgtgaccatcacaagggtttctcggctttttatccacttatgtgatacaagaaggctagagggagctggggttaggtatttctcttctttaagattaattcagctctggtaaaacctcagtccattgggctgtagtaaactagttttctttgagggtaggcctttgttaagaacaggatttctaggctgggcatgttgacccatgcctgtaatcccagcactttgggaggccgaggtgggaggatcatctgaaatcaggaattcgagaccagcctggccaacacagcgaaaccccgtctctactaaaaatacaaaaattagctgggtgtgatgatacatattcataatttcagcgactcggaaggctgaggcacaagaatctcttgaacctgggaagcggaggctgcagtgagcagagattgtgccactacactccagcctcagtgacagagtgagactttgtctcaagaaaaaagaaaaagaaggaaatattcagggggtatttcacaatctgggctttcccctttccctgataaaagaacaaggggatttttctcccacctttaactgaagaacttggtagacctcttggatgtaaaatgaataagagtgtagccccttccaagactggacctcaaagggttttcatccctcaaactagtcaacacccggtgtccagtcattagtcaattatcccttcagttttctggttgttggatctagtgttgacttcttttggtgtgctgtgactcattctgtgtgttcacctgtccttctggttttcaaagggggcagtggtttgccctgtgatcctgattatctgaaggatctaagaaaaattactaattttcagtttagtcagcatttttcttattgtgaggaccagagtgatgatttctaaactctttaaaagtcagataagactaatcttgttttttaaattaaaaaaataagtatgtagtaactagataacttcagtaatctgaaagtctgaccttcaggaagctcaattatacctaaaggcattgtacatgtatgtttataaaaactacctgtgacaatgaaaaagtaggctctaggcagtgaaaatatactgtgtgggggcattcaaaggaagttatatcagaataagaaatcaaaaatatttgcatctttgtattattttactatgtatttgattatgccagtatgtttctagagaagagaagagaaacaataaaatcccagtcattgtttatttcaaaatgtccttagttagctctgcgtgcaggcaggccaccataaatgtgcatccacaaatccaagtccacggtccagggggagtttcctgtaacacaatgcaaaactgagatataatccatcaaatactgcagactcaatatatatttgcaagccaacaaaggataagaatcccaaggtcctctgagtaaaagttgaaagagcacataaaattatgctagccttaggaaagaaattggagaacaggacaaatgtttaggttctatttaatattatttgcctgaataatatggagtcaaggctctgaaaaaaaaaagtagatcaaacaaggatgatttttccaagtgattttatcaccattttttcctttagtagaaaaaataaataaaaccaactgcttatctgttggcgggaaagatatttttcagttaaacaattgcacaaggccgatgttctgctggcctgcttcagtaaggctctaaacattattaaaatatttcttttcagcttgttggtaaagccactgcccttagacctccagatgcccctcatcatgaaacccttcccgagagtcttagagcacctggcctttgtgcaacacggtggatagtatttgcagtagcagaggtccagcagaatcctattagcatgtttgttctgggccaatgcccatactctactggttgctaaatatttggaatagcatcctttaaatcatgaacaaagcaaactatgatgtctggttgtattttaaaaatatatattcttccagtctttcaaaattactttttgatgtaacttatagacaggggtattatttagagtttaatacttgatagaggagatatcatcaataatttcaatcctacaggcatttaaatacaaagttatatcattcaatgtgattgttaaatttttgtatatacacacacacacacacatagaattgtatctgaagaattaatagtatgacatctactttgacatcatccttgaaaatatattatactctgatattgagaaatttgcagattttgaagtaagcccttctcaaaatattcttaccaagaagtctttcagcataaaagagacagtctttcatattcaatcaatacacaatgcaataaacttctgtggacaaaacataggctatgcttgtgattcaattagaaaagtaatatttctgttgaattttgtgtcaaaacaaaaggaagttacaacaatgaggaaggagaggggtgtgcttcgctggagagtgaaataattaattttgaagacatgcagctatattgtactttatttgaaagcaagcaaatgcaaatctttttcttcatcattgtgagaaaagaacagatgtttctatttgacatcaaatattttttcctgaaagcaagtcttagggacagcactaaagttggtatccatttaatcctacatctatgtacttaactatagctgaagcactgtataaaataggtgaacagaaattagaaaaaattaagtagttttattctattaaacgggtatagaattgtgaaattctttagaaaagcattctatagaaaaaaattaagtattctattaaaagggcagagaattgtgaaattatttagaaaagcgttctatagaaaaaattaagtatttttattctattaaaagggcagagaattgtgaaatactttagaaaagcattctatctagaaatgtttttaaatactctgagtcagagctgtctaatcgaacattttgtgatggtggaaatggtctgtgcctgcattgttgagtacagttgccattagccacatgtggccagtgaggactagaaatgtggccaatgtaagatataacctgattttttaaatttcattcatttttaattatcttaaattgaggtttcagtagccatgtgtgcctaatatactttattagatggcacagcccaaaatatttaaacttcaattatctggaaactcatttaggtggaatgtctcaattctgaatgattattaatagtggcataatttctgtatttgtgtttttaatcaaaaattaatgttgtgtgctttcagatgcttgctctaacgacctttaacatgttaaagatcatatataaacaatactgaaaactgcaaaattaagacaagttcatttccaaccaaatcatatatgcattgacaacaatggtagcaaacatcaggaaagctttgttgttgatcttatatgcatattgagagtttctctttttacgtgagacaaatccccaagggatccttaaaaacaaatatttttttcttctcacaaagcaagttatccttccaataaattcttaacccattaaagttacaaaagaaaaagccaagtcagcagatgtatctatgcttgtaaggtattcttgacctattgtgtactcacattcaatcaactagtaggagctttggtaacactattattttcagctctactgacaaatcagtatcctaaactgaaataaaccatgtggtctcagcatggtgaaatagctacaatagccatttctctggaggggtctctatgagggttggtcaagtgtatgtctcatgatatgacttttctatttggtaatgtgtacgaaaaaatgcagaaatcaaactgtggaaaatatttttagagataaataactctgtcatgcttaatgttgaacaaaatcaaacatcagaatattaattagtctccaaactcattttttaagtattttttctagcatttactttatgtcttagtctgtttgggctgctataacaacatatcataaactgggtggcttataaacaacaaacgtgtttctcatggttctggaggccaggaagtccaagatcaaggtttaagcagatctggggcctggtgagggcttgttccctataagaagcaatttcttgccatgttctcatgtggtagaagaggaaaacgagctccctcaggtctcttttataagggcactaatcccattcatgaaggttccgttctcatgacctgatcacctcccaaaggtcccaccttttaataacatcacattggggattaggcttcaacctgtgcattctgcaggggacacaaacttttgaaccatagcacttcattcctgaaatttgttccatttgtctttccatttctctctcccttctttgttccaagtcttctttattttaatttttttctctgacaaactcctttcatctgtgctttctcttatttcctcttcaaatattttaagtgggagacttttataggtcatatgtctactttgattgttacctgtgttgtatttttaaatagactctgaacaaattaatataaaaaatgcagctctaagagaaaagaacaaaatgtcaaatagtaaatacattttgtaaattgcaatcatggagagacaaccttttttgcattgacacacatggtcagttttcaagtatgtcattgccactcattgtaaaaattacttaatgatgccacacagcacacagtctccagtatgctacatgcgttataagctcagcctcattgcccagtcccagcaattttactaaattatagtctagtagtgagatacagagaaggagaataagagaaagttttagttagtatgacctggaagccagaacagacaaaatagatactaatttgttacataagtctatagaatttttgcagttagaggcaatcttagaaaccatcattagacagatgaagctaatctaaagatgggccaagtgactcacgcgaagtcaggaaatagttaatggcaaagtttgactacttaaatttcaggtcctgtgtctatgttcccatcacactcttacaaatgatatacacttaaatgtaatctgggccctatgtttgccaataagattagaaaatactcactagcctaatgtgaggtcaattggttaaccaaatagtttaggaaacactagcctcatagaagggtaaatattctccatatcctacataggtcaggttggcttaaaaactgaacacgtgaaaaaattctaattctatattaggatgttaggataaaaatagtctcaaacctcatctagtcatcttcttctattgactatatctgcattgtgggcaagacccaagcatacctatgggctctaaaaatggtggttagaggacatcacctaaattttctttcctgtcaactttccttgaagagaatatttcttttagctagatggtcagatccctgaaatttctggcacatcaaatgatgacagtgtctctcagctgagagaagcggcctctttgctaaaaggatttgactacctgtttgggaggcacccttgtcccctaggtcatttaatgattttcagatgctcagacaaatatttcccttgctaatgccgtgatgagagcttttggctaaaaagtgtttaggatgagatgttgaccagtgcctcagtatattaacttgcatcatcagtttgaatagggcagactcttagtccttccaggctgtgatcacaaaacccgtaaactgggtggcttataaacaacgaatatgtatttctcacaatcctgataggtgagaagtccaagatcaagatgcaggaagattcagtgtggtaagtatttgtttcctggttcatagatggtaacttttttctgtgttctcgcatggtggggagggcaagacagctctctggggtatcttttaaaaaggcactaatgacactgatgagaagtctctacccttatgacctatcaccccgcaaaatgctccacctcctaatacaatcttcttggtacaacgtattagtctgttctcacgctgctaataaaaatatacctgagactggataatttataacgaaaagaggcttaatggactcacagtccacatggctgggagacctcacaatcatggcggaagacaaaggaagagcaaagagacgtcttacatggtggcaggcaagagagctgtgcaggggaactcctatttataaaaccatcagatctcatgagacttatttaccaccatgaggaaagtatgggggaagctgccctaatgattcaattatctccacctggcctcgcacttgacacatagggattattacaattcaaggtgatatttgggtggggacacagccaagctatatcatatggtatccaactcattcttaggattaggattttaggttaggatttccacgtatgcattttgaagagacacaaacattcaaaccatagcagacagagtttctcaagagataccttatggacatcttgggccaaataactttgttgtggtggatgtcttgtgcattgtaggaagattgcccacatgcgtggactctagatgccagtaacacccctaccagtcatgacaataaaaaatgtctccagacatagccaaatgttccctgagagtcagaatctttctagttgggaaccactgtggtagggaaatggagatgaagtaacctttttctctaccattgtgtttcgtgtgttctcatggattctcattggttctagcgatatttgagcaaactgaacagaaatgggtcccaccctcagcaactttatagcccaatgagacagttaggcattaagaaagtaagtgaatataattctagattgtgataagaaaatgctatgaagaaaaattaaaaaagaaagagattcatggagatcttctcagcctggatagccagggaagagctatctgtcaaagtgttacaatctgaataatgaatgtgatttatctaaatgaatagtataccatgctaataaattattccaagtgaacaggcggccgctgaatgtccaaagtttggatgtttaatactctgcagccataaaaaaggatgagattatatcctttgcagggacatagatggacctggaggccattatccttagcaaactaacacagaaacagaaaaccaaataccgcatgttctcacttataagtgggagctcaatgatgagaacacatggacacataaaggggaacaacacctactgggtcctttcagagagtggacggtgggagcagggagaggatcaggaaaaataactaataggtactaggtttaatacctgggcaatgaaatctgtacaacaatccccatgacacaagtttacctatgtaaaaaacctgcacatgtacccctgaacttaaaagttaaaaaaaaaaaaaaaaagattcaaaggcactggactctactatttgaagtacagacttgcaaaaattctacattagtgcttggcaatagcccagcaaaatgcactttggcagtgaaaattagccacgtcgtaaaatctgcaattcgaatgtatttacattcacaacattcaatcattattctgtactatctattggggcagaggcaacacttttcatgaccattctgggtggccattgctgctttttctatcacagccatttcaagaggctgggacctgaagccccagtgtgtgcctgaagtctttggaagtgtttctaagtcaccacaatactagcacagactcccacttctattcacggccacctcttatgcctggcccagatcctcttcatttgtgatgggcatggggcctcactccattgtcttcagtataaccttcattataatacagtgccttactggaaggaggccttcaatgactacatgttgaacacattatttaacatataaaaatgatctcaacagaatcaataaggtaaccacttgttagaaatttctttctttttgttgggattttttttgtggttctctcttagaaactcttgccacagctcttcttcattcatgattctccaggcctgggctgcactccactgccagagtcaggttgaccctgtgactctgacaccatctccatctctcagaagggccttgctctttaaatttttagttcaacatgacctttgaaatggtcaagctttcctctgtctatttcctattccttatttccttttaagtctgttaataggttccatgttcaactaatggaaactctagaaaagaaagttttaagcattatacatttgtgtcattatcaaaataagaatgtgcatctgtaatccttcaaaggttaactctttggtttcagccataaaatgcaacttgagtcttgataactgatggagaagtatgtagggtaggcatagcacttttttttaatgcatggagtaggaaattcaaagcgacatttttgattatgtatgcatcagcaactgtgatttatggtacctgtttgtgtctgttacatgagtgatgggttcttacgccaaaaataaagttactatattcacacctgaggcctgagaagtaacagttcagtaaaagaagacaagactctataaaaaataccaaagaaataaatacaatgaacacttatagcctgtcttcttacctaagaacttattactttctaccttgtattattaattttgacaactgtgcttctgctcacaaacctgtaaattgctgggctctgcttgcagtgaagctactaccttcattataatacaggaccttaccggaaggaggccttcaatgatacatgtttaacaaattacttagtatatataaatgatctcaacataatcaataaggtaaccacttgttagaaatttctttctttttgttggcatttttttgtggttctctcttaggagacttttgctgaagcttaaatgctttaaaataatttttaaataattaattactacaaataaatgagctatttagcctgaaatattaaagtgctatttccagaacttatatttctgtaattaaaatgccagttttgttctctccgggctctgtttaagaaaaaaaaaaaaagtgattttttttttttttttttttttttttgagatggagtctcactgtgttgccctggctggagtgtggtggcgtgatctcatctcactgcaacctctgcctcctgggttcaagtattctcctgccccagcctcctgagtagctggaactacaagtgtgcaccaccacacatggctaatttttgtattttttgtggttttgccttgttagccaggctggtctcgaactcctgacttcaggtgatccacctgccttggcctcccaaagtgctgggattacaggcgtgaaccactgcgcctggccaaaaaaaagtgattcttaaatgcagatgccttggtcaatttatgtatgtttgagatataaattataattcagaagtatgaaggtgccaagatcactatgggaattaaatatgatattttaagagattttgagaggcttattttctatatatgaatggataaagtcaaccacagttagaaacatcatttatctgggtaacataattgtgatttcatctgtaaagtcaaatacaaggcagcattatgtggattaacatttttttccatattatagaaacagtgttaaggaggaatcttagtcaaattccatttttttaagagacaaaacaaaataaaactgtgattgagagttcaaagtccttaactcactagtagcagaactgggtcgtgtttatgaacttttctcttcactgtactcaccaccatgcattctaaccatgaaagcaattgtagttctacagcaccacaatccatgctagtgctgatacgagaaacctaaaatgaaagggaaatcatatgtaacattgtgttgattgattgaaatgtgtgactagattcagaagtacaagccagaagtttggggaaccttacttctgagaatgggccagttctgactctcagtcaagcctaaagtttgttgctcagttggaaacaaaagcatggatatgattgtccggagaaccctgttgctgaataacaaagaggcataagcagaaaggagaattcagaagcacaacataatctaaatttgatttatggcagtgtgcagtctggatgtctccagcttgtggtttcagcttctacttctcaagtagagaagctggatggtggtaaaatacagcaggctgaggagggccagactggagttgagattttctggactatgaactctgggtgtggggtgtatcttgagaggcatactggccacaaagggcggccggagggaaaaacaagttttgcatgcccatgctctgttcagagtccaagaactaacatctgtttagttttggaaacacaggctggctctgagtatggggatttagaacagcagaaaggtcaacattgtataggagagactcaatgttttcacaatcgattaggagcttagaagaattggggtggcaagactaagaagtgagctgcaaggatctgaatgaaaagggctgtcaggccaaggcccatcagcgaaggcagagaggaactggccagagaccagggcaggaagtgtggctcacaattggaaagcagtgtcagaggagtaagagatgaatgaaacatggattaggattaggattaggagctaacgggtacagaaccaggacacaaacacaaaatctaagaactaccagtcaatcctggaatatgaaaacaaatgtcatggggatcagaattttgtctcaagggaactgtagtgttgctgcttagaagtgcaactgatcccataagtggggaaaatgagacacacacagaaaagtataggacaagaggcctgactgtttcctattctcatcccttcattcttgttgacacagattttgattgaggtttgaagtttaccatcagaaccatatctttcctagaaacagagaaactacccaataagtaaaatcaactacagtatcctccttgtagttttgtcattatttctcattagttttatttcacttatttaagtagcaatgaagggataggcagtagatgacaaagttactactataggagcactctgaggcattatccttcctcaccactaatgcacttctgatttttttcctctgttctcctctcttatttagtcttttacatataatttgggttttacaggcaatgtctcacagagtcagtggccactgtgactgcttcttatcctcattagagcaatcactaatttaaaatcagtcaccatttgaaaacttttaaaattatgtcacaagactgtaggatatttcaagataaggggctagtactcctcactcatatatatccggtcttggcattgggaatcattagccaagttaggagctctccagctggcccattgcaaagcaatgcagacagagggaaagttgaggcacctgcctggttcactgggtttgattgcttactaatccttcacttaacttggaacctccttgctcaacctcttggctcaggtgctggggagaacacaggttggcaagatgcaagttctgccttgcaagcatttttctcctgtatatgcacacacacacacagacacacacacacatatatgtgtgtatatacaggagaaaatgcttgcaaggcagaatttgcacacatatgtatgtatacatacacacacatacacatatattttatatatacatatacatatatattttatatatacatataaatatataatatataatagaaaacataaacatacatatatgtatatattatatgtgtataatatatgtacatatatgtaaaatatatatgtataatatacatatatatccatgagaatgccagaaacaatatatgtataatatatactatgtaatatataatatatactatataggtatatatgttcatatttataatatatatgaacatatttattcactgcttaaatttccactgttaccatgtgcctggaacagcttagacataactatttgcttttgagtagactgaccctagaaacaccatactgtattcaaaacaactagtttctaatcatggaattaagacactaaggtggaaccatttcagactggaagtcattttgaggttcacactgaagctatttcgtatatatctcattatatatacatatcttatgtatacatatatagtatacacatcttatgtatacatatatagtatacacatcttatgtatacatatatagtatacacatcttatgtatacatatatagtatacacatcttatgtatacaatatagtatacacatcttatgtatacaatatagtatacacatcttatgtatacaatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacacatcttatgtatactatatagtatacatatcttatgtatacatatatgtatacatatcttatgtatactatatagtatacatatcttatgtatacaaatatgtatacatatcttatgtatacaaatatgtatacatatcttatgtatacaaatatgtatacatatcttatgtatacaaatatgtatacatatcttatgtatacatatatgtatacatatcttatgtatactatatagtatacatatcttatgtatactatatagtatacatatcttatgtatactatatagtatacatatcttatgtatactatatatataaataaaataaaaaacaggaaattgcttggtgccaaagcacagaagaggaagataataattttgaggtatttgaactggactttgaagaatagaaagtttttttttttccctaaagcagtgaaaacagttgaaaggccagaatgatttatttcaagtgttacctttaaaagaatattaatacttgacagtctcttcacatatatgcctgtttcttttctttcaaaaaaactaaccccatgactagaattttgatctacttttgcctttttttttcttttttagtttaagataaaataaatagtctaacatctgtaacatatcatggctgaatttggttatacacaacatgcttcattttcatatcatatcttacttgagtttaaacctgcttttcatattttactcctttctgttactcaattcaaaagtatttgccatgaatgacttcataaccatacattttagatggtctgcttgggatttttttttgccttatatttttctattggcttattttcctttattttaatatacacacattcccttaatgttgatttcttcacgctgacctgtacccctcccttaaaatttattgccagagatgaaatgcccttgataatcttcaccttaagattcactcccctctctgaattacttcatttggttttcaaaactaaaacttataagaaatctcagactcgcaggaccctaaatataacattagtaatgcaagagagataaaacatataaaagcaggcatactcaaaaagatacagtacaaaatactgaaagaattaacagaatgagaaaaggaagcattaaattcacatcaaagaaagctttgaacattaaagcaaatgaaagtgaggggaagaaatctatatggaagccaaacaatcactgcttcctgacagctgcagttattaattagtgttccatcatttgcactaaatggtcaatcaatacttttgcttctctggaaggccatttgctttgtagcttgcttcttaatgggaaatgattcagcttgtccccttctttgtcattctgtccataactaccagcttggcagagagttcgtaagctgtgctggctctagataagggtaagaattttgtctccagatttcagttctctcctgcccaaccacctcacctgcaatctattgtttatattgttgctatgtatctctattctttctgcatcaaataatgaatagctcattttgtgttgccttcaagtatgacaaattcctttccaaatgtgattccagacagtatatccaaacatgtctttcttttcccattcctgatcatcctacatgtcaagcactgccaacgtttactcaagaaagcttggttagaacccagcctctagaagcagtagattcctactcattcctgactcttttagccacttgtcgtatggcatgagcaggtgtcttaacttctctatttatgtcatcacctcctgtttcctatccacagagctaatacctagctcagagcattattgtaaaaataaaatgaactagcatatgtatataaaaagtaaggtggttacctggggattggaagacacttccatcatatttgttaagtgaatggcatagagcaaataaaaaaaaattgactcattattcttattattcttttatatgattactgctctctcctggagtgcacttctctgcctgactcaccctttaagatacatctcatatagaaactccacatgaaagccttccgtgacgcatgatcatggctattcactcctctattctgtcacagtcctttgtgcatttctcttcatagctctcacacttcatttcaccatactgcacatctgattgctttactagactctgagaatcactgttgctagaacgtatttgttcactgcttacatttccactgttaccatgtgcctggaacagcttagacataactatttgcctttgagtagaccaaccctagaaacaccatactatatttaaaacaactagtttctaatcatggaagtaagacactaaggtggaaccatttcagactgggagtcattttgaggttcacagtgaagctatttcatatctaaacctcaggtgagatgatatttttttgtaaacttagggttaacaaacctatttataattattgtgttaacacaatgcttcatgtactactgatttttcttgaagtgtatacctataggaaatagaaatgtccatggtcataggaacatagaatcagacaaaagttttcgagttaagataactaattggaaatcatatggacataagaattaaataaaaatgggttatttctagagatatatatgtaactaagaaaaaacaaagataaacagatacttgatggcacattactgaatttcaacaatattccttcaaaataagtgacaagagatagtatagtcactgtgatatatggtcctgtccagtgacgttctgggccctaggtctagacccattatttgggttaccagaggttaggcgcttaacctctttctttgctagttttttcatctgcaaaacaggattgaataacactcttacctactcaggtaattcctaccctatgagaagggaaagagataaagcaagtacaagtatttttatactctaaaactctatagaggccgggcgtgatggctcacacctgtaatcccagcactttgggagactgaggcgggcagttcacctgaggtcacgagttcgagagtagcttggccaacatggtgaaaccccgtctctactaaaaatacaaaaattacccggttgtggtggtgggcacctataattcccaactactcaggagactgaggctggagtattgcttgaacccaggagggggacattgcagtgagcagagatcgtgccattgcgctctagcctgagcaacaagagcgaaactccatctcaagaaaacaaacaaacaaaactctatggagtcaaagatactgtgaaatacagcaagtccctgggcctttggtgactctgtatattaacagagggctctcattcaagaccttatctattgtccagcattatttgtctactatgatattcatcttttcaggacctaatccagctggacctctacttttttaatggttctagttttgatttgtatacagtttcagcagcaaactccctacaggccatacactagattcacgtccatttggcactgaggaacaaaagaaaatcaccctacctaaagtgatggggagcaaaatattgcttttgatgaatcactaatatagttttatctagctacagttttgtcaaaaagagactattgttgcaaaccaagttaaatagttttttaaaatattttttattgtagcctaatgaagattacttaattgcctgtttaaaggacttggtggaaaaatatgtgaaccacagctttagaggcccatgagctttgggcagtctatgtcatgttcatctccttatccccattgttggctccaaaactctgttagagtgttcagcaagtgttaaactgctcctaataatgcctaagtcacagtgttggatctcaggtggtgcagacttacctatcccaacttgagagaagaatgagcagccgccataggtcattaacatgccgcctgcatcattcacttacccactaaattgaggtacaaccagatggaaagaacatgggtttttggcacatgggactggatacctgaagtatggaactcattcctaaacaatggctggaagctttgggtagattccctgacctgagaattgtatggcgcattgttaggaaagctaagtctgcaggaaaaaaaaaaaaaaaaaaaggcatgttttggggtcctggctgtgctgtaagcaggacaaattcttaggatttctggtgctaattgagtgaccttatacataccatttcccctcctggggctaaaagaagatcagagaggatcaaagaaatcagtggtttaaaaaaactcaaaacaaaacaacttgagaccctaaaacagtatttggcctttggaggtttttgtttaataagtttaaattgtccccaaagtgtttctaaaaggcaggttgtgctttgctgcaatacaaacacctttgtttctgatgccacacagcaggcttgagagaagcattggtgttgtatttgccctttgtacccatctatgtttgacactcattgaccaaataggttaacattttaggagtctatcattctataaaccacctgagtgacctagaacaagtaactgaatgtctccaagccccagatttctcatttctcccttggagatggccattataatatctgcctacctatgtcagtggttattatgatcaaaggagatcaatatgtgagcatgctttgcaatctttaagcaggaagaaatgttcattagtgaggaaggataaagcttaagcgggagcttggactagataactgctagacaaggtcatacctctattatgcagttacagtatttgataataaaatgtctttaataatcaggaaaattaaaataaatgggggcctcaattatatctagaaagatattcaagaagacagactctcattagaggagaagtctgtggcaagaggcaaacaactccaagattggtttcttaactggttgtgaaattgcctccgtttatcccataagcagacctccccctgagtggatttccttaagagaggttatataggtgaaagatccttatgcctggcagcatattatttagaaatagtccactttaaattgccatggagagaaccaccaaaagatgcagagagctgtttgtgtcacaaatgttaagctataatctcactttcagatttaacctagttttctttgggaggccgaggcgggtggatcacctgaggtcaggagttcaagaccagcctggccaacatggcaaaactctgtctctactaaaaaattaaaaaaaaaaaaaaaaaagccatgtgtggtggtgggtgcctgtaatcccagctgctcaggaggctgaggcatggagaattgcttgaacctgggaggtggaggttgcagtgagccaagatcacgccactgcactccagcttgggcaacagagtgagactctatcataatgttattaaacatgtaaaagaagcatctgacaataatttcaaataagctgcttaattttacaaaggcattccattcctgttttggcactgccattggtcatccatgtgactttgagaaaactactaacacaaataaaaaataacaaatttaacttagttttatttaactcaccttggttttattcattgagtagtgatgatgatggcaagactggggaaatggtagaaacttatattaattgaggtttttttttgtgccagggacgccacacagctctttagcatttcataaagtatcccaatgatcctggaagttgagtaatgcattatccctaccttacagatgattcatccgaggcacatttgtgttagcattttgttcaaagtcacacggatgaccaatggcagtgccaaaacaggaatgggatgcctttataaaattaagcagcttatttgaaattattgtcagatgcttcttttacacctttaataacattatgatggtatgaaaacacattttaggcagcagccaataaacttcaatataataacaattaccatcctgatttgatacagaagcctccaacttcaggtgttcttttaatattctatatgctagtcgattttgtttaccatacgcatagttataaacagtcagtgcacatgttgttgactgacctaaatatttacactgtcacatattattaaaatctcagtgcttttctccaattctgtaagattaattgtctactaaccaatgaaataatttgaatttctacttttcttcttataagcttaggctaatttctatcaaagagaagtttctcaaaaatgaggactggaataaaagcttctgtggcttgttcacagcctcattgactggaagaattgtgtctcttggtgggtaactgtgcatggggtgctaaggactgcttggagtctaagtgggaaaatggcattctgtgactgggaacctctgttccttaaaccttttctgtttaattagaaggaaggatgtcccattttatcctcacttaaagagcaatgaaatgattaaaaatagtgttttaatttcacaacttaggagcaataaataattttgagtctctggctgtcactatcagttatcgctcaacttaatattgttgaagtttagataaggacagatggttctctcttctcagtattagttctgttgcttggcagttaattacctgctactgtgactccctctcccatcaccaagaaatcataaaaacagaaaaagtaacggtatctttctccaagaagtttgctttgtctcatggattggttcctttgacagttttttatttgagagggctcctcttcgtgttcctaatatgccaaagttaagcatgcaacctcggtcttcatgttcacaagttgaaatgggcgtgtgcttcttttacaattatgtccaatacgctaactgaaagtagaacatgcctttctcctaggggttttcaaattcataggatggtttacatttattagcttctgaagtaaggaagatttctcttacaaaaataaatcactctattttttgttaaattgaatctactttgttccccacccaatgttgatgcaataaggagaattttatttgttctatgacttttcaattcttgcacctgatttggaatatcacatcattctgtctgccccttcggtcttgttttatttgaatctttcagcccaacagtcagctttgctgaggctacaaagaaatgcagtgccaccaaaatatgagagaataactaagctggacatttcacaaggctgctgatgtgagaaaatacaattttagcaagttttaatctatgtccctaaacaatcttaagttgaaaatattgagagaagtataacagtaggagacaatgttttgcctaattttttcagacttcaaattagtgaatcgaaatcatgttaaaaatttgcaatttcagttcacaggcagatttctagattttaatatataacagacaaaccacttcagcaattacttttgcttgcactgtggtttttgagaacattggagttttttccatattttccattatctctgagtttttcactgaattttgctatctttacatattctttctaattgaaaagggataatttgttcgtccttgaattcagttttcaaagacatctgaatatttgaaattcacttctctttctccattttttttttgatgttatcctctctgtgttttctttttaaggaaaggtaaccttttgattttgttgtttattttttgaaaactattgtttcaattatgaaacagagataggaaataataatccgataaatgtccaaaactatcattatatagcatgacattcagtaaatacccagtaggagtgctggcttacattgcagaaagacctgcagagacccaaatgttgaagcattgaaagagctgaatacattggactgaatacatagaattcttccctaaaaaacaagggaggcaagtactgtttttttggtttgtttgttttttctcagttttcaccactaatttgcttataaaggaaagaaaatttgagtttctgtggactcttgttttattacattcatacaaaacttttttttttccagttatttcacaagaaagaaggtgtttagttgtccacaaaggactatgcctctggtttggtgcaatttctggttttagtagttcttatccctattgtctactccaaaatgctgtcagcacagtttctccagccccatttatcatcctgtagagtagtacctctttactggctcactttcaaatacctgagtttgctaatgttgcagctttccacgttacaaaagaccctggtagcctccctagagaaggcaattatctattatgcttaggggacacaaaagtagctcacggagggaagtgcctacatactctgctcatgctgaggctgacctaaatcaatttcagatgcctataagtaaaaattgagctctgtatataaggttaaagctgccacatttttattaaagaattatccttctaggataactgcaaatgttgaataattttcatggtgattacaatgttcaaaggaactccaaaataaaaaatagaaatgacacctattttggagtatcttacttccatttccattcactgtctgttacgttttcactctttattatagattgtatgtctgtctttggtttggttctttcagtcttatgatgtgttaataaactattatagactatgtagaggatgtaatcattaaatacagaatacaaacaaaactaatcttttgaaagctattatttagagaaagagctagaacctatgtaaacatatatatattctatatatatactctctatatatattctatatatatactctctatatattctatatatatactttctctatatattctatatatatacagtatatatatagactatatatactgtatatatatagtctatatatatactctatatattatatatactctatatattctatatatatactctatattctatatatatactctatatatatactgtctatatatattctctatatatattctctctatatatcctatatatattctctttatatattctatatatatattctctctatatattccatatatatattctctatatatattctctgtatatattctctatatatattctctatatactctctctatattctctatatactctctatatattctatatatattctatatatattctatatatgtattctatatatattctatatatacattctatatacattctatatatacattctatatacattctatatatacattctatatacattctatatacattctatatatattctatatatacattctatatatattctatatatacattctatatacattttatatacattctatatatattctatatacattctatatatattctatatatacattctatatatattctatatacattctatatatattctatatacattctatatatattctatatacattctatatatatattctatatacattctatatatatattctatatacattctatatatattctatatatattctatatacattctatatatatactatatacattctatatatatattctatatacattctatatatattctaaatacattatatattctatatatatattctatatatagtctacatatatattctatatatagtctacatatatagactatatatagtctatatatgtagactatatatagtctatatatatattctacatttatatgtgtgtgtgtgtgtgtatatatatatatatttttttttttttttttgagatggaacctggctctgtagcccaggctggagtgcagtggcacgacttcagctcactgcaacctccacctcctaggttcaagcaattctcctgtctcagcctctgagaagctgggattacaggtgccggctaccatgcctggctagtttttttgtatttttagtagagacaggttttcaccatgttggccaggctggttttgaactcctgatgtcaggtgatccacctaccttggcctcccaaagtgctgggattacaggtgtgagccagcatgcccagccctcctgtgtaaacatattaaacgataaggtgctcactattttctgagctgtacaacaggaacaattgctgaaaagaatggtacctgaaccctgtattgggtgaccattggccttttgtgtcctgtgatgggtagggcttggcctaggacttccagacactaataccctggggtagaatgcaggcaattagtaattaattgcactgatgtgtctaacatgttgtagtagtggcgattattgctccatttaattcgatgagtaatttagacattaatgcaaagttttagaagtagcagcaatcatttatattatcctttctcaatacattaatagtttaggaattttcattctgtggctggttggtgagatgagatgaggccaatgaaaactccttggcccaggggattggagatttgaaatatttactatgtaagtgacattgttagaaaacactaggcattatgccaaaattacaattatgggttagtgttatggactgaattgcgtccacacacacacaaaatatatatatatatatacacgttggcgaggtgcagtcgctcacgcctgtaatcccagcactttgggaggccgaggcggatggattacgaggtcaggagttcgagaccagcttgtccaacatgatgaaacactatctctactaaaaatacaaaaattagctgggcatagtggtgggcatctctaagcccagctacttgggaggctgaggaaggagaattgcttgaacctgggaggcagagtttgcagtgagccaagattgtgccactgcactccagcctgggtgacataacaagactccatctcaaaaaaattttcttaataaacatatatgttgaagtcctaaaccctactccctgtgaatgtaaggttatttgcagatagggtcctagcagatgtaatcaaggcaagatgggtgttggggtaggcactaatttaagttgactggtgtccttacaagaacagaaaacaccatctggcaatggagatacagtgagaagatggcaatgggaagatagaggcagaggtgggagtgctgcagccacgagacaagaaacaactggggccaccagaagctagaaggggacaggaaggatctgagagctcatggtccagccaacatcttgagttagattttagacttctaaactccacaattctgaaccagtaaacttctactgttctaactcacccgatttgtggtacattactatagcagccctagggaactaaaggagttagaaaccttttcatacttatttagacttactaaaattatacctatcacaaaatattcacaaattggttcaaagaagttgatcagaatgatgatatatatagccaacggttacattcaattaataaactacaaatgagaattattgttactaatgactcacctgggaagaactattaaggtaatttaaagaacacactttatatttagagaaattagctaaatggtcaatgcagttcaatcagtagttttcttatatttactatttcccaggaactgtagcaaaaacaaggatacaaagataaataagagaagacattatgaaagttggttctctatgaaataataaccaggtattttcttttagaattcttgtgtgaaacttcagaattctctataggctattgcattttgttcccaatgctcaggtcttatagtagtgtgcttgccagataaaatatggaggtccccgctgaatttaatttattgaggcttttttgttttgttttgttttgttttgtagtaatatgtcctgtgcactcgttgggacatacttatgctaaaaaagttgttttctggaattcaaacgttactacctgccccacattttcatttgctagatgttgcagcctgggtagtagtgaaagtcatatgcaagatatcaaaggtgagaaactgaagaatcaacacttggaagtggctacattcctacaatctcacttattgccaatttgctatctcaaggggcttataacaattttcagtcatctgtagtacttaagtcttaggaatattttggtgattaaatgaagtagtacattgtaagtgttagaacagttactgttgaatagttagggccctgtaactgttcgtttttatttttttttcccaaatcagtgtaatgcatagtagagcattttcctgtattttgaatgaggatacaagagatggccacatgtgtacatttgctaacaatgtctaatctatttgtcaatactgaaagacacatctttgaaaaaagatgggtcttgttccgtttggttttaatcactttgtaagattccagttcagtgcctgatgagcctctgactttagaagcatgctgttaaatctaaacttttttttttttttttttttttttttttgagacagagtctcgctctgtcgccaggctggagtgcaatggtgagatctctgctcaccgcaacctccgactccgtggttcaagcaattctcctgtctcagcctcctgagtagctgggattacaggcgcaggccaccatgcccagctaatttttgtatttttagtagcgacagcgtttcactgtgttagccagaatggtttcaatctcctgacctcgtgatgcacctgccttggcctcccaaagtggtgggattacaggcgtgagccaccatgcctggcctaaatctaaacttttatgtgtccagtgtattagttcttagggctgctgaaacaaaaccacagattgggtcacttaaaacaacagaaatgtattctctcacagtgtggaggttaaagtctgcaacccagatgttggcagggttgttttttctggaggttctgagtgactctgttcccggcctttctcctggctactggcggttgctgttagtccttcgtggaccttcacttgcaggcttatcactccagtctcggcctccatgctcactcacatggtggtctcctcattgtgtatatctgtgtctcttcttacaaggacactggtcatataggattagggtctgcccgaatccagtattacctcatttagcttcatttcatctacaaagaccctatttccacactaggtttcattcacagatgctgacaactagtaaaacaacctttgcagacattataacagtgagaaaattatggcagtgaaagagatctgatgtaatcaacctccattttgcctttagccttcaaactgcccttaattattcctgggtttgggacaagctaatttggggaaatatttagtttatagttaaatgataatagcccttctcaaccacctttgtaaagctaatgagagaccaccaggtttaaaggatgagaggaacttaaattctgctacggtgtagacataaaggattacccaccattatttcaaaggtcacaagatacacaacttctctaattactcctgcagataacatcactatttgtagaaccaaagattggcctttccagatgtcttttcaggtttttttgcatgcacatctgatgatggatggctccacctggacccactaatcactccagtgaccccaccccgagggactcagcatgcgggaggaacatcttccattcccctgggattgcacccccaaccaattagcaagctcccattgccaggtcaccccctttcttccaccaaattatccttgaaaaaccctagcctctgaatctgggggaagactgatttgagtaataataaaatttctgtctcccgttcagccagctctgcatgaattaagctctttatttcaattcccctgtcttgataaattggctctatttgggcagcagtcaaaatgaacccattggtcagttatactaggctttcaacatactttgggtggacacaataaggaccagtggctatacttcaggggtattttgaaaacctcaacgattacattttatattaataggcatcttttttaacatttaaggtattctctacagtgtatcattggtatagagaaacaaaggttttctttcaaaaagtgttttcctcaatatttctagaacatacatttaggaactatttagggaacaatatctaggtaacaatacatgaatattatatttaaacactttatgatttgattgtaaaacaaatttcacagtctagaattcccaatgctttgagaagtaaataatgggggtaaataaaataaaattggtaagagaactattttttttcttttagcttcccttattttggggccttcatctctgcattccaaattacttcattatttttaaagtgccattcaattttcaattgtataacaagtgtttgctaagcaattacgtaaattttcttgtttaggtgggcaattagatgaactgaatgctaagatattttaagctaatattcttgcatgaaaatctaaattttctcattttccagagaaatgttaataaattttactcagccatgcaattaaataaatgccaacacttagattattactattcttaacaattaacaaatttcacaaatacttccaaaattagagtggtgtaaagagtagtcttggattgtgaatgacctcattttacagtttactaatctataaatgaacattaagtacctaataataatgccattgtcatgtttaaatactttatattagtaaagaagctataacagattttccatagcatatattcaaaatatattatttctcttttcctctccatttttaaaaataaaccacacagtcatgcccattaaatataaccagatatatttacttgcttggttttccttttgttttttcttgtcggggaattatagggataaggaagagattgatttttgcttttttttctgctgaagttataaatgcttgaatttggaattattttgtaattctagttgaaatgtgaaggagcatttactataggaaacatatggtcctataaaccagtatcagcagttttcaggtaatcaataaaataaatacgagatatccccatgataccgctattgtccaataaacgattacctgttacacagtgtcctttgcattgtgtaggataaaatgacagattatgtacaccgattttggtaatttccaggaaacaactgactcacagaagcttaggtggtgtacttggaatataaatgcacatactaatggagctgattttatcattcttaaagcataatcaaagtcagtagtttactaccactgaggagaatgatgctttagatcccagggcacttaccacaggaaggatacagggatgaggccatttgtaagccacatccagaagatggtgagatgacctctgtgttcctcacataagaaatttaacaccagcacttacccacacacactaaaaccaaataatttggatagcctcgttgtgattcacgtacatgtttcccaattgccggcaattttcactgtcaggctgactaaatgcagatcattaacttacagggtcatgtttttcaggccgttttggtattatgtaagaacattctcaaatctataatagcaagctctacccagtaatatttatagaagcgtatgtgtaattgttagtaggagaaatatctgaagacgattttattcgctctgtaaatatgtaggtcagggtcttaagaaaatgctcattgtaaacatttcttttttggacagggagatgtccctgatgttccccctagatgtccattgaagtactactcatgggagattttatttaggccacctagcattttgctgagcattctggttgtcagaaaaagataaagcacctgctgttatgttgttgctcactaagtagagaaggggtccaatggctaaaccgacgatttcaactcacggtggcaaagagcatcacgagcatgctcaggaagcacgctgaggaggcgggcacccaaccgaacctgcagagacggaggacatctttctggggagacaatacctagactgagttgtacaagatgaatacgatttagttgtgtggcgtgatgtttcaggtaaagcgttcatcttgagaaaatgcatagaataataataataataggggtctgaagaagaagataagagtggtatggtctgaccaggtctgtcaagataagtagctgtaatgagggagtggggaggtcacggaaagcttgtatgacttgcaagtgagtttcacccttatcagatatgcaatggagagcccttgatgtttattgcaaataatgcgagccagttttgtcattggcacttactggttttttgcttgtttgttagatatctgtatcttccagaagttactgaagataatggctacaggtgtgtcaattggcttgcttgtggtaatcatttcacaatgtatacctgaatcaaaacatcaggttgtacaccgtaaatctatacaatttaatatacacaatttttaggctgcaaaaaaaaaaaaaacgaaacaacagcctttgtcctaattccattacacattaaaacatgtattaactagtagaaaaaaagcacagtctgttcttcgagttgaataaaatcctcagctttctgtccttttagacaatctaccatgatcttaaatgaaaggcttaagttcaaatgtggcagtgttccagaagtagtactgtgctgcatatcaggtcagaaccaggcagggtgtaggctgtttaccatagaaggggatggcctcttagtgccaggtcgtcgttctcagtggaaatatatttagcatagatcaactggctttggtttcttcttaaactctgttcagaaaaaactctgagaggtggctacttgatattttaaacttgaccacaagtgttgaataccattcatttcaactatgaaaaaccatttccattatgaagtagaaaattaaaccctctggggctgatccacgcggagctcagttgaagtattacactttctcatctcaggaaggtgggcttctgatgagtctttccattgctgactaagccccagcacagcaaacctgttcttcattagggctcctcagacagcaactcaccacctccagggagtagcttaaaacagctgacccatacacatatactgttgagacaaaagtcttttcaattaaaatagaggcatgatcacagtgagttttaaacaggagattcatatgagcagattctgatttttgaaagacgacagtaaaagcagaatggaagtgtcaatttcagaaaggcaagaggatgtacacaggttacctaggaggttactgaagcagtcagtgctaaactatttgtattaagaaaaaaaaagagcttaagagaaatgcacatttatactgttgtgtcaaactccaaaaataaatggaaattgtgttaaacaataactagtatagatgagtaattttaaatatatgtatatatatatttatttgtatttctaccagatgtgtgtattaaatatagatatagatatagatataataaaacacaggctagagtttattaaattactatcccttatgatcacagccctgaggtccattataccagtttggttgttcttatctctttattgtttacatccattttctatgcaaaatgtgaaaggagctacctctctaaaaccctcggaaagattttcaccttgaaaataacaaaaaatggacagcttcttgtaaatctaatcaaagctctaacatgttttgaccagttacatagtttttaaaaggtgagggacagtagagctaatttaaaatgctaacaagtttttaggtaatcaatcttaacaattagatgattaatagctggggagttaatcatccccagtcacaaaagaatggctctgctcctgcttcatacacaattaattgtgagccagcaacgtcttgccattatctactgtgtctgaacagctattgagttgaggtttcctttatcatctgatgatgtataatttgattgtttcccttaaaactcattcctaaccaaaaatcaaaagaaacatactgagactttgatgatgaaaataatatatctaacatttaaaataaatagattttataacttggtgacgaactcagtttgctctctttccctactccaataaaaattattggttctgaaactaattttgacatttaatatcacattaactttcattgtcatttaattgctccatgtcctccttgttttcccatagattttaaacccctaggccttggacatatttctgaattcctcatcccattttataacattgtacacatccaataaatgtccacaatataattgaacagaattgagatcatgacgttttatctcagtaacttgataggcttgtaattatacagtatgccctaaagtgttgaattacataatctctacccccttttattttcttttacctgattcatttcttatttataactaatgtttattaatatgtaaatatgccccatcctttcctcctgaccgcaacatatatatacaaggactgtggtttctgttttatttacatttgtgaccagtttcttgaatgagtggctaaataattcagtgaatagaactcctactatctgtttcattgacttagtgagtttttaattctctcacttagtgaaattttacttgtcatccttgtttttatttccaccacttcccattcctaaggatgccttctattctataccttagttttagatggttaccacattgatgaataataatcaattctttttattttatatgaatgcaacatcagcttccattttcaaaggaaccttctatccacagaacacaaactaggaccgtgctaaaatttcaggagcctagtgtttattgtgttcataaactcatgacattttccagcttgaggtgatttaagaggccatgtagcacaaacttgtattttacagatgagaaaactgagcattgagcaagttaaatgatgtaccaaaagtcaaatcactagtgaatggcaactgagactgaaatcaaagtcccctaggcctggctgtgtccagattgtacgagtgcctcatgatatctaagctacaaaaccatgatgggggatgaggggagagtcttgctagtgtctcacagtgcggctggatgacaagttaggaacaacagcaggactgaggcaccagagttgctaggctatgaaacacatcacgtggaaccatggaatcacgtgcaatattttatttattatttattattttatttttattttaatatttgcttaatatttttatatatttttattttaatatttgcttaactgttttttatttccatcaagttgctcatttcaatgtttaatgaacatttagggaacagagtccaagatctgggttcaaagacctgagcagcagagtgagatgaaatcaagaaacctttcataaatctaaaaaatgatctgtaggctgttgatacaactcacaatatcagattggcagcctggaaattagtatcttcagttgaggaatacattaaaatcttaaactaaggtctttcaagaaacttaaaacagcacggatagaagtgtgtttttaacgtataaaattatttgtgcctgggatttaatttctttaacacattccaaaattcctttagggcataggttttgttctgcacaccactgaaattctgcataaggcacagtgtctagaacccagaaagtattaaataattttttgaaaaaatatactcatgtatatattccttagtttttgtcaatagttatttgatatttagtaaaaattacattttttgtctatatatatatataaaagcatccaaaatgatagagaatagagtgatatctaatgctaactgcccaaattacacaattattcccagcgagtacctatcatatgctgaggaattaatctgtagattcagatacagtacagtggccaagattcaccaatagatttctatttttttcttatacacatttaacatcagaatttgaacatcatagaagtttcaaaacagtttgtagaagctacttaaaatttgtttcagatctcctgtaatatacattttattattttgaccctgcaaagcaaatatcatttttatttataaagccgatgacataaaagcttattatacagaaacttgcatttctcatttcctaaaacttgttttctcttcacatgttatgactttgtttcaacttaccataaattcaccttgctgttccagttaaacttgaaatttatcgtgtactccttgctgctaaccagtaagtcagtgaggaaaatattgtatgtcagatgcttttctcagctctattttcctctcttgttggaattgccttcttcatttttttgtgtgttgtatatgatattctactgcatttttaaagaagagagataacttcaatgcatttataattcaaaggtttactcatgttgttcttctgttccagatgatagattttgaaccattctttaacactgatttggccatcataccaaaaagaaatacagttgtccctcattatccgtgggggaattggttccatgaccccatagataacaagattcaaaatccaaaatcggatgcttcagttctttattttaaatggcatagtattttctataacctgcacacatcttcctgtatactttaaatcatctctagattacttgtaatacctaatacaatgtagatgctgtattgatagttgctatattgtattgctatttgcattattttttattattgtgattttaatggttttgtattttcaaatatgtattttcaatctgcagttggttgaattcccaaggatacagggtgaaagtgtgactgtgtatgtataaaagaaactacattttcaaaagttgatattctaatcataaaaaatagactgcactaatatataatcatagaccactaatagaaaagatattaattgggattgagaatggaaatcctatgctggctaaaaagtctctgatgagctaaatagactgattttgctaagagctactctttcaagagcccacgggaaataggtacttattcagtttagtcaaacattcaggaatccagacccttagtaatttgaaactgtgacagctacaaacttgaccaatgtcaaatttacctatttcccatcaaaataaatatttacataggaaataaatcataaaaacagaatatttggggatgaagcattattcttttcagttgtcattttattcgtttgcttattatttatagtgttttataattaactgcaaaaaacaaaaaacaagaaataaaatatatacatttaaattcattttaaaatttaaattttaaaccatgttttaaaaaatctaactttagattttgaaataactcagactattttgctaatttgtttgaactagtacagtctcatattataataagattaagtgacatttacttagtttgactaccctttcctatagcgaataaactgacatttaaaaagttgctgcttgctggcacttaagattgactgatgaggatgtgcagtcatggaggaagagccaggactgagaaagaaatataaatgaggaaaaggaagagagaaaaggagccagacaagacttgaggagagatgagagaaaggaaatactgtttgagggtagaaataggataaatgaagtcacagagaagaggctttcatttccacatctgttacttgaccatgtccatggtatgagagtttcatagttctttttctgtttttgcaggctgcatgctcaaatattctctataaaacataaacccatctccttaccctctcttcatttagcatttattttcaagatgctggctacattggtacattaatttcttatagatatttaatgagtcagttcacattaactggtgttcccttgcttaaaataataataataaagatgctggtagcttgtacctatgattttggtcaccaaaatacaggatgtttttccattacccagtactaataaaaggtgaggtacagaggtacagtaggtgagacaaattcataggctggcagcagcttagtttttcctatatttgaccccaactggagaaatgtgtattattatttttcaaggctgggtatagagctatatattgttgagctgttttattaatataaatatatagagagttaaaattgttttcaaaaagcatgttaggagttcacctaatgggagtgactgagaagaagaaaatgcacagaatttagtataaagaaatcccaaataataacaataaaaaagcataaagtatatctgaagatttatgttcaacaacctagttcaaaatctataagaaggaatgatgatattatcacacagaaaattatcttatgtgaggttctagaactgactgtaggtgtcacacaaaatttagacaacagagattctgaggaaatcaacatatcctacatcaaggaaatagattaaaatgtggtatggtctaaaggtaagaggtctgaaccaatattttaaactacataatgcaagatatactaatattagattctaaatatttttaaatatttgtgatgttacttgtacttgaacaaatgaattttgaacatgcttcataattctgaaactctgccattacttaatgatgctaaaatatgcataatatcctctcctcaaggaatctcgatgtgttttccaaaattaaaactgtgtccaaactgagttttccaaaatccttaattttgagtaatgctgttatctttcacctctggagtgttcacaaaatctatttttattttctgaaggagtacagcgtgtatatattaaacacagctaaatgaaccgagaaagaaatccagatgtttaaccatgaaatctaaattttgaaagagtcttttgaaaatatgctgaaatgttttcaaaatatcatgatgatcaaaacaaattgttattggaatgaccttcactgtaagcagtattaacaatccggtattatacagaaagcatacatctttttttgaaaaatctttgtaattttaccattcagtgataaatataaattcctgaaaatgccattcttaccagaaaaccagtcaatatggttttacattagagcttttaaaaacttagtttgtggccaggcacggtggctcacgcctgtaatcccggcactttgggaggccgagacgggcagatgacgaggtcaggagatcgagaccatcctggctaacacggtgaaaccctgtctctactaaaaaatacaaaaacaactagccaggcgttgtggcgggggcctgtagtcccagctacttgggaggctgaggcaggagaatggcgtgaacccgggaggcggagcttgcagtgagccgagatagcgccactgcactccagcctgggcaacagagcaagactctgtctcaaaaaaacaccaacaacttggtttgaaacatgtatatataaatgtatatatttaaatatacattgtggctatacacctctaccttctctgtattacttatctatgtttatagctatttatatacatgtatatgtatgtgcatatatatacatatgcatatatatgtgtagagaatagaactgtagttactagcagcttggaagagtagagggtaatagggagagattggttaacagacgtaaaattttagctagagagcgggaataacttctagtgttctatagcacgttagggtgactgtagttaaaaataatttagtctatattttcaaatagctagaagagaggatttcgaacgttcccaacattaagagatgataaatgttccaagtgacagatatgctacttactctgatttgatcattacctattgtataagtgcactgaaatatcactttgtacaccctaaatgtgtacaattattataggtcaattacaagccaaaataaaaaaaccacacaaataactcataagaatacaatataacaattattcatatggcatgtatattgtattagtaatctggaaatggtttatagtatgagggaggatgtggataggttatatgcaaacactgggccgtttgacataagggatttgagcattcctggagtttcatatggagcagggtcctggaactaatcttctgcggataccaaaggataattgtataagaatcttggcagcaaaattgtggcagttcagaactataaaaaaaagtcaaagacaatgggaaaaaaagactcagtcaggtgtccttattctctgcttttgatggggcactgagacattgcctgtgaggatttgaggattgattatttccttgtgctaagtgttttcctgaactatgtgttttacctgaacattgaaaacctaccaccacatctgagggaagaactgttgttatttacctatctttcatgaggcaactgacacaagtagatattaactaacttgactgttagttgctgctactaaagggcagagatgattcagagtgaggcagctgcactccagggttccagctctcaaccgctgtgctgcactgcctcccaggaaatactgaagtgctaagcatggttgcgggtctacggatgatgcattacagtttatggacagaaaaataatcaaatgcttcatctgaagaaataaaggattaagaacaatagaacatagattcttcagaaactggatcatatgagtaaggtcacagaaaagtaaaaaagtaacattgttgagttttctgccttttcaataaattaatgactttaggaaatatctattagagatatataattttaaaatatacacacatatatatatataaacttttattcaggtatgttagagagaaccagtagagggagcttttagccgtaagtttactttctattgtgaaaggaattaatcaaataatgtgtgaagaaaaataaattctaaatatgattattatttacgtgatacttcaaagcatccaaaaaataaattaagaatgttatttttttcagttactttggaactcagttacaagacatatttttatttatagtaacaggcaaaatgtatttattgtgtacaacatgatgttttgatatatatgtacattgtgaaatgactaaatctggctaactattctatgcattacctcacatagttatcttttttgtagtgagaaaacttcacttcaactcagtatttttgaaggacctagtatattattaattatagtcaccatgttatacaatagaactcttgaatttataacttctgttaactgaaattttgtatcctttaatgaatacctcctcattccccaccagaaaccctagcccctggtaaccagcattttatttattttatttctatgggatgaactttcttagattccacatatgaatgagatggaacaggtataacgggttatgcataaagtgccttatgtacaggttatacataacgtaccttattatacgcttataacttatgtgtaacaagtataaggtgagatctcattgggttttaatttgcatttatctgataatcagtgatgatgaacatttttttcatatacctgttggccatttgtatgccttcttttgagaaatgcctattcagatattttgtcttttgtctttctgtgcctgatttattttacttaacataatgtccttcaggttcatccatgttactgcaaatgataacacttcgttcttttttaatgggtgaattgtattctattgtgtgtgtgcgtgcatatagatagatatacaaacacacataccacatttgctttatccattcatcctttgatagatgcttaagctgattcaatatcttagctattgtgaataatgctgcaataaacatgggagtgcagatatgttttcaaaatactgatttcacttcctttggaatatgcctagtagtgggatttctgtatcatatggtaattctattttcaatttgttgaggagcctccatcctgtttttcacaattgtactaatttatattcccacaaatagtgtgcatgggttctttttctccacatcctcaccaatacttacactttctcattttgataatagccattctaacaggtataaggtgatatctcattgggttttaatttgcatttatctgataatagtgatgttcaacattttttttcatatacctgttggctatttctatgctttcttttgagaaatgcctattcagatattttgcccatttttaaatcaggctattttattgttgctgttgacttgtttgagtaccttatgtattttgaatgttaaccttttatcagacatatagtttgcaaatagtgtcttccattcagtagattttctcttcgttttgtttattgttcctttacctctgcagaagcttttatgtttcatgcgttcccatttgtatatttttacttttgctgcctgtgcttttgatgtcatatctaaaaagttttattgccctgaccaatataaaaatgctttcttctatgtatttatctagtagtctcaaagttgtgggtcttagatttaagtatttaatccattttgagttgatttttgtatatggtgtgagatggggatgtaatttcatcatttcacatgtgaatattcaattttccaaacagctatcaggttctgggctcttctttgacggtagacattttattactgatttaatctccttacttgttattggtctgttaagattttctgttttttttttttcataattcactcttggtagatggtgtatatcaaggaattaatccagttaagctaggttatccaattttttggtgtataatttttcataatagtctttgatgatcctttgtatttctgttgcatcagttataacgtctcgtctctttgtttctgacttagtctttctctttctgcctttcttaggctaactaaagatttgttgattttgtttatctttctaaaaaaatcaactcttagttttgttgatcttttctatcacttttctagtctctattttattgatttctgccctggtccttattattttcatctttctactaactttggacttagtttgtttttgtttttcaagtttcttgaggtgcaatgttaggtcatttacttgagatcttcttttttgatataggcatttattgctataaaacttcttagaatggataaagtaattcttagaattgcttttgctctcccaggggttttggtattttgtgtttccattttcactggtctcaagaaattttttaaagttttcatgaacattttttcacagactcattgattgttcagaagcacgttctttaatttccatgcatttgtaaattttctgaagtttcccctgttcaatcaaactattgatttctagttttatattattatagtcataaaagatacttggtatcatttcaaaattctgattttttatgaattgtggcctaccatatgatctattttagagaatgaatatgcatagaataatgcttattctgtagttgttggatggaatgttatttatatgtctgttacatacatttgatctagaatgtagttcaagtgtaagtttctttgttttctgcctgggtgatctgtccattgctgtaaatgggttgtaaatctcctactattgttttattgcagtctatatctctttttaagtatattaatacttggtttgtatatttaggtgctccagttatgggtacatacgtatttacaattgttatatcctcttgctgaattaacccctttattattaaataatgacttatttttacctttttacagtttttgacttggagtccatttaatcttatataaatatagctacttctattctcttttggtttctacttgcatggaatatatttttctatttattcaatttcagtctatgtgtatttttacaggcaaagtgagtttcccatagacataccatttaaatcctgtgatatgaaaatttgcctttttgatgctgtcacataagtttcataagctttttttcagtccttgtcattctttatttttttcttctgactttatattttcaaataacctgtctgtaagttcacaaatattgttttctgcttgttcagtttttcttttgatgctctctattgtattgtttgtctttcattgtatttttcagctccaggatttctgtttttttttttaatttaatccctctaatgaatttctcatttttttacttattattattattgttttattttgttcacttctctgtattttttgaagttctccgagcttctttaaaatggttattttatattattttcaggcacttcatgtattgctatttctgtatgatgtcactggcaccttaaaatatctgtttggtgttgtcatgattctcattgttctgatctttgtacttctatgtcaaagcctgtgcatgggaagtcattgcttattccaatttttatagtcttgctttttctaggaaagccttgtggcaggcatagttctggggcgcatcagactcctgagccagtgttgaccagtgtagcactgccagaatcctgggtcctgctttagctggtacaatgctggggcatgccagaatccctggacagctgtgactggcatgacactgccaaaagcctggaacccactacagcaggctaggtgttgtgtttggctggaagcccacagcctctgagaattgcttgctcctgagggctacccaaagcctgggaccactgatgtcaatatggcagttgtgtaggccagagataaatttcactaagcaagcttaaagtgtgaggctatgtggtctcacctggtgagacctggtgtcctggtgggtctataggctcagtctgctggtactggttcggaatatggagctatgaggggtctgctggtgcagagttttcctgtgagtacccagtgttgtgtccaggaaaaatcctgtgctcacatccctttcattctatctagtggatggcatctctttccatactgtgctgcctggggttgggagaggggtgatgtgggtattgtaaaactgtgattcctaccctttcaatgtgtcttttcttattattgtactacaacgaggcactgtgatctctcacgtggtaaaaagatcctagcccttgtgacgttatttttgtgcatagatagctgttcagattgatgtttctgtgaagggatgcttgctggagagtcctactccactgtctggctcccacaaggcatttttgactgctcatctgttgctgtgctggatattatcatccacaggagaattgcaaagatgggtgcctagacacaacgagcttataattttgctggtaaaattgttagcttattagaaatgtattgtgaatgaaatttatacataatagtgtattggcaataagcttgacaaagaagataagcaaacaggagttagaaagaccagagcacagagaataatagctgttcccgaaaagacaaaggatatgaatttatggtgaagactgtgaagggaattttcgatgggaaaatattatgagcaacatggctgatttaggaatgggcatggagggtgaggaatcatatacatacaaccaaaataaaaggttaatatgaaggatataagacacagatttgaatattgcatgaggccgcaagtgctggcaaggagatgaaagtgatccagatggtagtaggaaataagaatacattctataatgagattgcagcaggaatggagagggtaccgaaggatggagctagaggataattaggaaatataaaaaattggaaggaaaaaaccctaacaagaggcaatagcaataatccaggcatgaagtgattaactttgttagatgtgatgtgctgtttttcaagccatataataaactctccttactgaacaaaacaataattatgtgctttcattctcttgcttctccttttagactgtgttaaaaaaaaaaaaagaaaatttaagctagttttggcagtgttccagtgagccagtttgtggcatttttgtccatctgcctttactttcatggtttactgattgcttattttgcagtcttttgtttattttatttatttcttcataaactaaataaataacatttatctaaagtatcagctggatataatggggatagatgtccagggtaattttccatcatacttaaagtcttctttaggagtacttttcacattccactgccaaccactgaccaccagtatgttcacctttagccttcagaactcacggaagaataggcaagattaatcggatcataaggatcatatagaaaacttataaaaatggtaagggtaaaaaatataaattggggtcttcaatgccagtccagagtgtaataatgaacaactgtaaagtttatgtatgaggtgataattttaagtcaactcttttgagagattagcatggggttgtccttagaacggactgaagagcggaagattagcagcagagagagaaatcagaaggctgtacaataggataagtatgaattgatttcagagggaatgaagaagatttaagtaggtaatgagagaagagtaaaaaatcaatgatttactagatgtaaagactggagaaaaaatgtcaaagatgactgatatacacagtttaaacgattagtactgtaatagatatattcgggaaacgagctagtatttagttgaaaattgtgtgtcatttttaggcacattgatttttggtactcacagttgatataggcatatgtacaaatattttaaagctatttctcatattctcatagattccataaagaagactaaaattctaaaggttgaatagccttcatttttttaaaaaaagtatagaactcattagaaattagatttttttcagaaaaatatttggctaaaaatagtgaaatctttttttttaattttattttagatgtctgcatcgaaaccctgataggtatttcatgctatttcttttctggaatgtgaaatccagtattaagtttgatacatcaatcagtatgctatccactctgacatagtgaaattgattagtaaaaaaacaatgcttgtgttgtagaattaaaatttcctttttcttattattatggagaacacatgtcagagtccataggaggtacaaacaggtattctatgacaagggacttgaaaaggtggtgtgtttgtgtcccttaaagttaaaccatcagtggacctaattagcataagttatagatgccttttttcctgaggttgacaccatggagttatttgtcagggatatttttcatccctggaatttgtctttgaatgcatcttattacaaactagtgattcgaccaaattatggatgtacatcatttgtgtttagctaaatagtcacttattgtgtaaagacattttttggaagctctagagtaattcactcttctatgcactcctgcctatgcagtgacttttttttttttaatgtgtcttaagtacttgcctgaaaatcataaccatgcacagtacaagtgtctgagtaaagttacacaaataatattgtaatatgacaatacacatccctcaattagtagcaccaagaataatgcccttgcagtagacctgacaatttcaaacaccatacaatagggaacagcatccaagacagccaaaccctctgtcatggcagaaacagaaacagcctgggaaatgttacctccatattcacttgtggtagtaatcataactgtttattgcttaaattagagagaaagtccaggaaaaaaatttcttatttagctgagtagttttctcattcaaaaatgcatttaactttaggccaggagtggtggctcatgcctgtaatggctcccagcactttgggaggctgaagcgggcagatcacttgaggtaaggagtttgagaccagccttgccaacatggtgaaactctgtcgctactaaaaaatacaaaaaatagccagatgtggttgcacgtccctgtaatcccagctaattgggaggctgaggcaggagaatcgctggaacctggggggaagaggttgcagtgaacagagatcgcactattgcactccagcctgggtgacaaagtgacactctgtctcaaaaaaaaaaaaaaaaaaaaaaaagcatttagatttaaataacatttaatgagaaaatgaacaacctggttaaatatcaaatgattaaacttacattagatgtatagaagctaccatcaaaattaagccttatttactgggatgatttcaaaggtttctattcttatgctgattattctgtgattatttaaaattggtagaaagatctgattctggctcactcacttctgcttcttccatttaattagcaagtatttgccaagtagttattatataattagcattgtgctagagtctttacgatgccaacatttcaaggagcaaattgcttctctcaatgtctgcattgcttgaaaatggagttgttaagtcaaaactcttaagctgccagtaactttctccctctgtttaatagtttaccaagacctccaatgttggaactatcttgcatgtcacaccaattaaataaaatgggtgaatattttcaaattcagtggtggtaaatgtttctagaggaacacagctgtgtgagtgggtgcaatagaactggatttgatatcaagtggccttctacaagtatgattttccacaaaaaaaacacaaagcttaagttaagccctgttattcctactttctctaccttcagatttgagtgataaagacaatagaataaaatatatcctctaagtagaatatttgcattatgtaagctaaaaagattggctttttaaaacaatcaagtggtgaatattcaactccctaatccaatcctttttctttcagaacaactttggaatttcaagatttcaaggttgtgtgctctagggctttgaaaggcagagtaactgaggataattctttgcaaaccataacaatattaatagaatcatcccatcatggttttagaaaacaacaacaaccaccaccaatccattactaaattttacacccaataacattattaaggaccaaaatggatttaagttttttcactttatttacaaacatctaatgctaggcacccagaattagtcctaattgtgctaggtattgctcctagagctttaaatttattatctcatttgatcctcacgataaccctataagtttggtatcattatcttttattgaagaaaagaagtctaaggcaaaggtaagttaaatgacttgcagaggatcacaaagtcagtgggtgattgaaccaagatataaacaaagacaagatataaacaaaggtatactgactttgccatcttaaaagtctgttaaggcggctgggcgcggtaatcccagcactttgggaggccaaggtgggtgtatcaggaggccaggagatcgagaccatcctggccaacatgatgaaaccccgtctctactaaaaatgcaaaaattagccaagcgtggtggtgcacacctgtaatcccagctactcaggaggctgagacaggagaatcgcttgaccctggaggtggagattgcagtaaactgagattgtgccactgtactccagcctggcgacagagcaagactccatctgaaaaaaaaaaaaaaaaagaggtctgttaagggtaacatttgccattggtagataaggtttcccttcacaaaagaagagaaactatggcatatgtgcagtctatgccttctgccacccactaaatagaaagggtgcatgtatcttggaagagactcgttaatcaaacagatgtgctttcaataatggtgaaatctcttcattaagcactggcagtaagtcattacaatatcttctctagccttttggctgtgatcaagggtagactatcttctcattaggataatggggttcaataaaagagtgttccatcgttctccaaaagggagtagagtggaactttttgttaactataatcatttagtgattcattttatcttttttagatcttgttaattcattgttgcacaaggttaatcctttatccacttaggctatggttttgacaaaatgtgttggtcataaaagttaacttcttaaaagacgttaaagacagtttcaatgaacatcagtaacataatgtgtggaaataagaaaagtattttgtttctatttgcttgcccagagtgatattaattaaagcatgatttatatattttaaatgaaataattgaggacatttttgacatatgttttcattttttgtggcaaacaagatcaggagaaaattataaatatttgagttaaacatgtatttggcagtaatattgtttgtgactaaggtcagtccttagtctcacaagattatattatcatgtaaaagttataacaataatagatccatcaaaaattggaaaatatgaaaatgagtctctccctttgagttttttaatgcaattttaccaatcaaatatgacaatgatgaataattttgcacatttacttttagtatcttccccctatgaaaatgcttgtattataaaattttacctactggtaattacagttaactcacaaacttccatcctgattatgcctacttaccattagatcaaaagcatttgccaatcatatccttttaaataatcatttgaatggttctgatatttcaatgataaaattctgtgatttagttttatgcttatagttggatatttgaattatcccagatgtttttgctattataggtaacctagcaacaaagaagttttttcctattatcttttttccatatttggggatatttctgtagaaaataatccccagaattgaatttattgaatcaaagagtataaagctcttgatacggagtccctgaattcttaaggaatatgtttaatccatctatgtagctctggaaactggcttactacctagtatgctcgttacttacatttttgaatgtgttaaacttttaagaaaacctattaaatgactactttatgtgcatggctatctgataataatcttttgtacttataatagattttcctaatatctaataaattttcacatacattatctgaccttatacctacaaaatacttgcaaggggcacaaggcagacattttgatcatcacttttcagagaaaaaataaaaaaggacctaagagagattaaggatatggcgtagaatttagtcttcttacctggaacagcagtggctccattacatcctatctctgtgtacatgtgctttactacggaaagaatttgaaataagttgattttgttttcttttcagtgaataattgcttttattcttaaggaggaaaaatgtctgtcagaatgattttgtctgttttatagtgaaaaatgcataccactccttaatcatcatcatacaatttttctaaatgttcagtgcaaacatcaatatatgttaaagcattattttatacgtttaaacagaaatgaaaggcaaagatcaaagtaacccattaaactctatttatggtacttaaaacattagttagggcatttttaaatgtactatgtgtgttatgtaagtgtgagctctgaattacaaagtaatttaaacaaatacggattcctaaaaatttctcccaggcaagtccttacatatagatcccctataatggtttaagataattatggactgaatatttcttagttttttaaatttagagcattgattgaacattgatgaaattttttcaactttaaaaatgtattttataatatctatccaatatgattgaatattaaattattcacgggatgaaactgcctgctataggcttaatgaacacaatgtacaaaatatactagttttccgtcttttctcctttttttaaaaatttttatttactttttgaatcaggaaatgatcaacctgatttcagagatgagaatattaaagcccagagagtaaagtagtttgtccagatctatgtggtgttttcttttcttttcttttcttttttttttttttttttttgagaaggcgtcttgctctgtcacccaggctggagtacagtggtcgaatctcagctcactgcaagctctgcttcccgggttcacgccattctcccgcctcagcctccggagtaactgggactacaggcgccagccaccacgcccagctaattttttgtatttttgttagagacggggtttcaccgtgttagccaggatggtctggatctcctgacctcatgatccgccctccttggcctcccaaagtgctgggattacaggcgtgacccaccgcgcccggccccaaatctatatggtttttaaggatctttgctggggattcaaagcctattttgttcacttcaaacctcagctcttctcgctgaacaaaaaggcaattaaaagaatgatgatagacaaagttgaaagttcactagtttataatttttaaaaatcctatgccaccatttttctttcagtagtttagacttaatacgtttttgaagattttaactcaatgtaatggaaaacatttataatatgatggaaacatttttaatgaagcttttcaacaaggagttcttaaaataaataaactttgtggtcaaacagagattaaatggctatctattaagaacactatggaatttctattcaaattgggtagcagactaaatgacttctaagatacaatcagtttgtgatttaattggttcttgaatggatctgcctctggcttgtagtctttatactgtaagcatttatacaacaagtctgcaattcaaccatttgactacaaattgccgtaagtttttggaaagctattaaagctcctctaatttttacaaaactctcttgctaaagttattgtgtagcgagggcataccatgtgtcaggtattatgaaagttttccttccttctttctctttgcaattgctctatctacctatttatctaaaatcacacacatatataacatatacatatatacataggtatacatgtacatggatacatgtatgcgtatgtgtatctttactaaatatgtatctatacatatatgtgtatgtatctatatgtatatgtatatatttgtatctatacatatatgtgtatgtgtatctttactaaacctaacagcagttttctaaagtaaacacttttattacctacactttgctagtgaacgtaaagaaagtgaaacaaattgccaaagattacataactggcaagtggcaaagctaggactcaatctcatggacaagtgacatctaagcctttattcttaactactagattatcttatgataatttaaacttgtgtgtatgttttatctttttgttaatcatcagagtcaatgatattcagcatcttctgcagtacagaccaaggaaaacaaagccaagctgtcttaggcagccaaaaaatgactatccatgcaaattaaatgtcactatgttttacaaatttgtctttactattagacatcaactaaagtagttcagaaaagagatgataaaaccctgaatgagtgaagctatagaggaaaatgtgaatgaaaaattaaaaagaaatactaagtttaaacaaatttaattgtggtagaaatttaaatatagaagatggatttcaggggttgtagtattaccacctcaatatttggaggatctgtttacatgtcttctcctaccactggcagaagagccttggggttagaactttttctgtcccttgttatcttctcagtatctcacctggaccaatgctatggcatgttttcaaagataacctagtagtggtgatgaaaggcacagtttcttcatgtttaaagatgagccatgggtttccttttatattttctcacatagactcccagatctgtgaggtcctggaatgtacaagtggttatcctcataaattagctaacaccagaattcatctagtagcatagagcaaaggattgctctgccaacatctgaacaatcaaatcctggcccaaacaagccaaattatctcaacatcaactcatattcttaccacatcctgatgttcctatgctgatattgcttgatcatacagattccattttgttctcctatttgagagtttgagaatctgcttctcttctctttccacccctacctcaccctcctcccttggaattagagattgaatgatctcggacatcttgataatctctcctctctgctctgtatgctcagctactcgtcttacaatcattaatttttaaaatttaactacatgagtgtgccatttgtttttcccacctccagggaaaagagatgaacttgactcatgattttgatcccatgattcatcctcagcccttgctgttggatgtggcggaacactcactagtcctttaataaagatcagatgctgtgtggatactggtgggcttcttgagcaggttgctattgcctacctagaagcatttgccgaggattttcttttcttttgtcgtcagtgctataatatgccacagtctttaaattgacctcagtagtgtctcattgaacttaatatttagttcatttttctgctgacttttgagaggtggcatggccagaaatgtatatagtgattgtatcttttctctttttgccttatgaaatttacttaactatatggcttactaaatatataactggagaaattaaatagcaaaaattttactactttttccatgaaaagttaagtgtttatgtagtaattaattgcttagtccagcttcctgagatataaaaataatgctgataggcattaacaggcgatatgattcactacttttactcattcattcaattttatattccaaagaacatgttttctaataagaggataattaaatgtttacaagtgttatcttggaagtaaatccaacaataatttataataataaaatggtgtttgggttatacatgtggcactgtctcaaagagtcttaatagcatgggaaaattagttttattgtgcagatatattaataaatttaaagataatcaggataacttttgaacatttacaaatgctcaaattcgagcatacaaatttgagtatacaaatttgagcatacacatttgagcatacaaatttgagcatacaaatttaattaaagtatttttacctttttgccaacctaacatccttacgtgagaatagcatataattacatatcactataaagagcacattgtaagttatttacatattgttagactgttagaatgttacctgctaaattggagtgggaactaaacacacatacacacccactgactgagtctggcacatttctgggtcttcctttccttacaggaattaaagttcttgactaagtgattcctaagtttttcccaagtataacatgggtatacatttatgtttctaattttaaagaggctactaaatcttacattttatcatgctctctaattcctcttttttttatttttaaattttactctaagttctgggatacatgtgcagaatgtgcaggtttgttacacagttatacatgtgccatggtggtttgctgcacccatcaatccgtcatgtaggttttaagccccacatgcgttaggtatttctcctaatgctctccctctccttgcccccaacccccgacaggccttggtgtatgttgttcccctcgctgtgtccttgtgttctcattgttcacctcccacttatgagtgacaacatgcagtgtttggttttcggttcttgtgttagtttgctgagaatgacggcttccagcttcatccatgtctcttcaaaggacatgagctcattcttttttaggcctgcataatattccatggtgtatatgtgccaccttttctttatgcagtctatcgttgatgggcatttctgttggttccaggtctttgttattgtaaatagtgctgcaataaacatacgtgtgcatgtgtctttatggtagaatgatttatcatcctttgggtacgtacccagtaatgggattgctgggtcaaatggtatttctgattctagatccttgaggaattgccacactgtcttccacagtgattgaactaatttacactcccaccaacggtgtaaatgcattcctatttttccacagccttgccagcatctattgttacctgactttttaataattgccattctgactggcatgaggtggcatctcattgtggttttgatttgcatttctctaatgatcagtgatgataagctttttttcctatgtttcttggccgcataaatgtcttattttgagaagtctctgttcatatcctttgcccacttgacggggttgttttttgcttttaatttgtttaagtttcttgtagattctggatattagacctttgtcagatgggtagattgcaaaaattttctcccattctataggttgctgattcactctgatgctagtttcttttgctgtgcagaagctctttagtttaattagatcctatttatcaattttggcttttgttgccattgcttttggtgttacagacataaagtctttgcccatgcctataacctgaatggtaatgtctagattttcttccagagtttttatagtttggggttttacatgaaagtctttaatccatcttgagttaatttttgtatgaggtgtaaggaaggggtccagtttcagttttcagcatatggctagccagttattctagcaccaaattcccaattagccaaaaattggtttaagtgattcataaatctcaagtaaatctggatgttaaaggttgaaccttaataataattacagagtaaatggaaagtgagtgaatctcactggacttgtttctttagagccaagggttgaggcagagttcatagagcctgacttttatggattcaagttgtgcaggattttctgaccaaagcttcatcctgtgatttcatcttggtcagttaaatctaaataaattctactgtcatttactaaaatatttagggcattgttatgcaatctaagattatttacactttaataaatacatgaaaattctaattgtatttattgtgtcaagttttccattgcaaacactgatttatttttttcagtcaaataataactcaggaaaaaaaatagaccaggtgaggtttccttacacattatccatgctaccatttatttaagaaacatattattgatcttttatgtttttgcaaattccatgtaattaaaaaaaaaatgtaagaatggtcaatatctgaacttgcttctgtgttttccatgatgacctatttatgttgcattatagaatttaaccaactgtgtatgaaagtttagatgatattaacatgtgagtcaataagaaaagaactgttatacagaaatattggaatgatttgactttcaatattctatactcaattgtatgcaagttagataaaatcatgttgaattttatctcatgtacgttaccaaagcaatacaaattccttagaagttatataagtaaaaatagatttatttttaaattatcctggaaaacattgtcttggtattcaaaccattttcacctgtgtttatcatcagaggtttccatcttttagaacatttatttaccagttctcttgtatttttctcagctgtctgtttgccatatggtgttactttcagaattctctgtaatactgagaggttgtgcttgtggtaacataggataaaattccatgcagacttgaatatttgaaatcttactatatgaagattcaacctatacgaaaatagaagcttaaccataatttataggtattatgttagaaaaatcccagctatttctacatctattttttattcttttgtggacatgtagatacattcttagcaggcagatctggcctaaggcaagctagtggtatagcaacattggctttcctgctttcaataagacacaagttttattccccctgaagtttaatgcctcatatcttaatattctcttttgattcccttaaggcaaccacccatgaaagttgcattcagactcttcattctcagaaggtatactcaaatgctatttcttccagagacattttaattctagtaggagtcaaactcgtaaagaaaatggttgaaactctgagacaaattgataggtagcatgtatagttaagcctgctataaacagtaaaagaagcaacataaggtagaacattttcccctccaaggagaaaaaatcatgtccgttaagtatattttgattcattttttattgtaatttttgttatccctggaaatagaacaaaaacatgtgtcagctgactaccattgaacctgtacacaccctgcttcagcttttatccaatgagaaataaaattaagtcatgtaggttgttagagtctctctctctctctctctgtctctctctctctctctctctctctttttaactgaacctggctgcaataataatactgaccttgactgtgacctctctgtgtgatagttccattgctgtgccttagagtcgaatggtatctctacagttttttcagaattcttgggtaaaaaatgtagcaggtgttgtcaggggttaggaaagagaggctatttattctttccctgtagttttggatggaaataaatactttttaggtgatctgtttctaagaagtgcagttttccggaaaccacacaccgtattctcaaaactattttcctgtttcttccttagcatttagtctaatcatctcaaagtaaaggattattcttaataaaagaaaatacggctgctcacattaaatttgcttcaagtccaggagaaaacctgcttcaaattttttaaagacatttttgcctccattgtatatggattattagcccaatttataagagtaagtgccagaatacagtctttggtggtattttagggtgatactctcctgcaatgggattgattttagaatttgtagggtatatactagttgaggatgtaattggaatttgtgcctgtaaacctataagctccaatcctaaaagacacatgtttattcattcaaaaatatatatctagcattggtgttgtcggttactttgctgggcataaaaactcagagatgaatcagacacagtagagaatgtctgcaatctataggaaattatattctgaacagggacggactcaaaagtgtatgtgtgaatatatgtgctcttttaaatccaagaaaaatattttccacatcaccaattgtgccactgaaaaataaattgttattggtatacagtggcatttgaagatattagaaaactcaaatcaaaaagggaacattgctctgccatgaataaatgatgtttatacttctctttgcaaactgctatgtcacctccaggataacttgtcaagtgcattttcatattatgtttcaaataacactacccaataagtggaacttagaaaaatgtatcagtgtgcatattcttatgttctgaataataagaaatgtgaaatgtcaagtgatgaactaatagcaaacaaataattcaaacctctctaggttagcttgcaacacagagtcagaaagtgcatcaagaaaatgtaacagtgtgcagaatgaatttgtaaactgatttattgacacattcaaatgatacagtgctatttataggacactgtactatagatgttcctgcagttactggagaagaaactcttgtcctgtggggtctacagtgactgccttgcttcaataacatatgtttatttgccatatcgttgtccattttctaaaatagaatatactttgtaaggattttcaataagtttatgaatatgaaacgaaagtggatgactgaaggaattttctaggcttcattagttgacatgcactctttttgagttaaataatatgatattctagaatctaaattgattttctatgaaaatagaaacaaaaataggaaaaaataatattttgatctactccgttggtttacatgaatgcctgcaaaaaataagtaattttgactacctacaaaattgtatttttgcacataccttatagtgtctcttgttttaactaagatgaatttatgataaaaacatgaaaaaaaatcaagtggttaactctaatttgtttattaagctatgttagtaaaagcaactaatactggcctatgactttccaatttaaaaagaattttgtgtcatttcattgaactctccattagcatagtggtatgcttgataacattatcttctgggcaaaattagttgtactactataagtacccatatcactttcttgcggcattgacatctctagtatagcacttgatagtatatggtaggtatcttttcatatcttttctagactctcaagtctcattaagcaaaagatgtttattatctgcgccagtcacacacttcccaaattcaatatatacacacgggcttcctattggtagtaagactttattaactttgattgagttattgtttcaccaaatcgaaaactgaggttccaagatgttaataaatgtacccaagaatgcatatgaatgagaagtagaccaaaatgcaaaggtaggtcctctaattctaaatatcagttctttctaaaatcttgatcttccaacctttcctgttcttagcgcatttgaaattataggtctacacagtataagaaacattattaaaatgaatacagacatattttaaatagtactaaacatttgtgttataacacgtatatatgtaatttttcagaactgcttcctatatacaggtcacagggcactgcctcgtggttatttctaatccaccccacagttcaataactcagaattgtaaaatgtgatcaaataaagtaatcatgatgccaaattcccttaaggatgcatcatttttaaaagtttcttaatatgaacatttcgagtcagtgatttagacagctttgaatatcaatttttcatgaaaaagaacaaatgcgatgacataagcagacagtgatccacttgtgttatgaaggtagcagtaaatgggtgacaatttcttgaaatccagatatgttcaaatgagcagagttggcagcgtgtcctaggcttttttgacaaaggaatgcagtgtcattatctattactttgatgatttatctacgtcacagtaactgcttcaaacctagaaaaaggtaaaggggcaaaaagaattatttttcattgttctgctatgaatccatatcagcatttaggggtttgttttataatgttccttaaataagtttaatttctttacataagcaagtgataattaagtaagcacttttttgatagtaaggaataagctcacttttaaaattctgttctctcacaaacatttcatgacattatagaatccagaaatgtcagctataaaagagatcccaaggatgatgttcatttctcctgctttacaaatggagaaactgagattccacatgaatatgtcacttgatcaagagagttgacaactaaatggaaattagaacttaagttttctaaattcaggttcagaggccggcttcagtaaaaatataggtgttgggaaaatagtacagtgatttccatgagattgcagccatctcttcattattatggtcatgaatatacatatctcatttatttttcactgctatggctctatttcttatttcaaaatgtaaaaacagcaacttttctcatctcttggtggctatatgaacttcagcaatacagaattcagtggattgggccttctccatttcctatttacttctgattacattgttttctcatgatgcattttgttttcccatctggaattcattctctgggaatctcctctctgagaaagcttcaaaaccaaacagtgtttattttttgtaatgacattgcttgcactttcattctgtaatatctccattcagaaatctttaattgttcccaattcctttctagatgagatcgcaaattctctgcttagctttcaaggatcagcacactttcaatcactttttcttaacacttcccaaaacccacctggcgtattaatcaaactgactttttgtagcctctgattagtttcatttctgtacctttgcttgtttctgttttccttttttcctgcccacaaaagatgtaagatctcctttaaattgtgaaaatctctagattgtagtgcttctcttctcatgcactcctggctgtgtgaacataaaacatggaagaggttatcccaggtgtggtgctcaactgtctgggtgaggctttgatctcctgagttctggtctctgtttgccgctgtattggtgattttcatgctgctgataaagtcataccagagactgggcaatttacagaagtaagaactttaatggactcacagttccacgtggctggggaggctttgcaatcatggcagaaggtgaaaggcacatctcacatggtggcaggcaagagaagagagcttgtgcagggaaactctcctttctaaaaccatcagatcttgtgatagttattatgatcaaaagaataatgcgggaaagacccaccccatgattcaactactttccacagggtccctcccacaacaagtggaaattgtgagagttaaaattcaaaatgagatttgggtggggacacagcgaaatcatatcaccgcctacacctgacttcctttctgattcttctttcctgattagaactttcaggacttgaatctctcctctccttccctttttaagaccagagttaagcttcaacttgcttatttcaaaaacctcctactgagaagcactatcaatttgctacttatcactggtgatgatggcaaaatgatccaatcaattttcttccttcagttccatctaaaatgagtgcacacccacatatatgtgttgaaatgacttactttttgttttcttttggattggtatagtttttttatttttcataaaatctgtctgaaaacaattttatttagaaattaaacattatcaatactatatgtcaaggcaagcaactttctttggaatataatatatcctagaaatcaatgcaacatatttttacgtttagattacccccagatgcccagagcatttctttactggtgaaatacagaattcttggacttgacactgagaggaagtgtcagcagtgatctaaaaagtatttcttcttaaaataagggaaatgtgtgtgcttaaagacagagacattagaaaggggaggatgaacagattatattttttaaaaaatggttaggccgggcacggtggctcacgcctgtaatcccaacactttgggaggccgagatgggcagatcgccaggtcagagatcaagaccatcctggccaacatggtgaaaccccatctctactaaaaatacaaaaaaaattagctaggtgtggtggcacatgcctgtaatcccagctactcaggaggccgaggcaggagaatagcttgaacctgggagtcagaggagctgagatcacgccacagcactccatcctggcaacacagtgagactgtcaaaaaaaaaaaaaaaaaaaaaaaaaaaaaaggtgggtggggtggggtggggtgtgagagcaaggtccctcagaagttataaatggatgggcattagtgcatagctatctttattttccaggttaccccttatggaaaaaggttcgcagttaccataacaccaattaataaagccatatttgctggaaaaatcttattcaacagcaaagtatcacagtaagagaaaggacgtttagtaatttaatatataaaaataaaccttcggtagttttgcctgaaagaaggccagtaagtatcttaaacatcttagggagcttttacaagtgctgtagcccttgctttctgttttctagttaagcaaactttattgctttcaccaatgagttacagaatctatgactggtaattttagtcaaaaacatgagttcaattagatgtgaagatacaatcttggcatatgttcttaaatgagccaaacctcctattttaataaataaggtaaatgagcccaaatccatattttatggccattgctcagtgaatgactacacacactattcagtcacccacataagaaatcagtaatttttgtcattcttcttcctattacttctcacatctggttgaaaaacaaattcagtcaccttctaaaatatctttcaccactttcttctcttgtcattccactgccactgccttcattcacctctgtatcatctccaatttacctttttttttttttttttttttttttttttttttgagacagggtctggctctgttgcccaagctggaatgcagtggcataatctcgactcattacaacatctgcctcctgggttcaagccatcctcccaccttagcctcctaagtagctggcactacaggcacacaccatcacgcctggctaatttttgtattttttgtagagatgggttttcaccatgatgcccaggctggtctcaaactcctgagctcaagctatctgcctgacttgtcctcccaaagtgctgtgattacaggtgtgagccaccacacctggagactactaatttatactggtgtataatagtgtccaagtttctagaacattcgtccaataatggctgtaccacccagatatcaatgttttgtttcttctaaaatatagatataaccatatcatataactacactcaatgaaggagccgtttcagtggtttctcaaggcctacagaatataattcacatttactgcatgacatttactaacctgtgaagtcttgaatcaaagatacctagattcaaacataataggtatccaatacagatttgttgatagaaaaatgagagtatgccaaacagggtcaaatgaataagattattcagtttgccctcggcattcctttttgctcatctgttctgtagattcaatgatcgccaccttccatacatccactgtgcattcattctgacactggtcactgtcccatatgccaagaatacagaagcaaacaacacaacccttacgtccaccctaatagggttaataactcatagtagagtcagatattaaacaagttaatacgcagatgaatgcagaattactaattgtcataattgctggaaggaaggaaggaaggaaggaaggaaggaaggaaggaaggaaggaaggaaaataggaaagtgtgttccctgaaaagagagggaagcagactaaatttagtgtaagtgatggtgaactcagggaagcacttgcctcctgagatttgatgtaggacatgatcatttatccaagagaaaatgtgaagaagagcactttaggcagcgagaacaagtgtgtttgttctgttgttgttgctgtttttaagtttgtttgtttttgtctctttcttgaagatgctatacattcccatatttacactttattgtgatattgactctgttgcctggagtgctcttctctgtcattttatgtgtagtgaaattgttcttatcataccatctttttttttaaatattaaaactgtccttaccccttcaggcagaacttaccttgcctcctccctttgttcactcctttcaattgcgattatcccattgcttatagctaactgggtaatttatttttctctagaagacaagccttctagaaggggatacaacttctttattcaatggtaggtcctccgtgttattgaagacatgaggagaaatgaattcagattactgggagacaaaggggaatatttttcaaatcgccacttcaaaggatagtatgcgactcaaaatctaaatatatttaagaaagatatagttaattaatgccagattaacagaaattaaaataaatgaatattattttaacatagatccttacattgtttaagataaattcatacccaggggactaaatattctccaacttattttccttgttcattagagacaaaaagttgatttggattacttagaattaaaacctgttgtgagagcccttatatagaaattttaatagaatcatgtctagatagaaaataacacagtttacattaaacgtctactttcattacagcatacttggcaaaatatcacattttgtcttgttgtgggcttccattctttgaatgttactgaagcccagttcctaagaatccctggccaggtgtggtggctcacacctgtaatcccagcactttgggaggccgaggcgggaggatgacaaagtcaagagtttgagaccagcctggccaacatggtgaaaccctgtctctactaagaatacaaaaattagccggacgtggtggcacatgactgtaatcccagctacttgggaggctgaggcaggagaattgcttgaacccaggaaacagaggttgcagtgagctgagatcgtgccagtacactccagcctgagtgacagaacaagactccatctagggaaaacaaaaaacaaacaaaaaaagaatccctgtagtagtctgttctcacactgctaacagagacatgcctgtgcctgggtaactcataaagcaaaaagatttaatgggctcacagttccacgtggctggggaggcctcataatcatggtggaaggcagaggaggagcaaagtcatgtcttacatggtggcaggcaaggtagcatgtacaggggaactcccctttataaaacctgcagatttcatgagacttatttactatcataagaacagcacaggaaagacctgcccccatgattcaattacctccaactgggtccctcccatgacatgtgggaattatgggagctacaattcagatgcgatttgggtggggacactgctaaaccatatcaatcccctacaaagcccacaacatgtgggaattatgggagctacaattcagatgcgatttgggttgggacactgctaaaccatatcgatcccctacaaagcccagcaaagttggcttccatcccagtcttctgcagtctctctggccactttccgtcctgtttacctcatgcttctgctccatcctcactggcctcctaggacctctgaacatacccaccttgttcctgctccgagccttttgactggggtttgttgtgctagaattactactccacagatatcagataaccctatggcttgttctctcttttccattaagttctgctaaaaatgataccttatcagtaaggccttctgaaacctctaatttcaaggatgcttatccattcacccatactcctcatcttcctgtcatgccctattttccctataattaacaccatctgaaatactgtgtattttttttattatttactataatatgaaactctaggttgttcactgttgtcccccaactgtaggcactctataaattgtcattgaaggaaatgcatattaactttgcactcagcgtcactgggtagttaatactatttttcaaatgttataaaatcaatatatgttaattgaagaacatttccaagctgtagaaaatagaagaaaatgaaagtcaacaattatctagcaatcagtacagtaccatgattgacattttggtttacatattctttcagtcatttctttacctataaatatctatttcataaaatgaagatcatattataaatactgttttatagactacttttttagcctatcatgccataaacatttgtcaattgattaaggatttttctacagcttcacccttactggctctatagcgctccatttttcactctgtacctcttgattgcatggcctaatctgaagttacttaagccaagtacactgggaaaatgcttacctacagcacttagttatttaaagctaagtgggttaagtagtctaggaaatagacttggttttcagtaagtacattgcttattgctaaatgctaactttcagttaaccagttaatgaaaccagagggtcaaaaattgcaacatttaccagtggaccaataaattacaattcaaatgagcccagcccttaggaagattgtcaatcaaagctttaagagtactcaagttcatttagtcatattgtgattgaccttgacggtcttcagattattggtttattaaaagttctaggtagctcgaccttcttacgagactgtagaatttgagttaaaaaaagaaaagtctactgtcaccactgtgttagagattaaaacctctgcctagctcctgggtggtgattcagtttttgaatactatttccttttgttgcatgaagttataaaattaaaacttcaatttgttttccagattacagctagggtaaaaattgttttttattattttgtgttgtagagtttttttttttcttttaaattagaagatcaagttcgaggagtcaaaagcttaatttaaaaaaaaagcctcacaaatctatttcatttctagtacattacagttcagtagataatttgaaactgattcatctgttataccatctgttggaaatatgctacagctgttaaatgtccagcaaaatttgaactacttctcgaagtaatttgcccttggtacatgcagaccagacaattttttatttgatttacaaccaagatttctccaaacatgaccgattttctagctatactacttttatttcattattatttttaaacatagctattagacaaaccaaaatagaaaatgaaagaaatctgaactaatttttaagattaaaaataatgaatttattcattgccataagctattaaaattgcattgattgtgttcaatatttttcaaaatatatgaagacttcctatggtgtgccctacattctgcatattgggaaagaaaagaagttcccttcctcagaagaggattattggcagagaaatcaacatataaaccaatattgatcataatagattttcaatgatacagaatgaaaatattatattaggaacaccaaagtcttatgttctttttaagactaaaagtagatgtaaaagagctaactgacagtagtcaatagtttcaagtctcaaaaaactcatttgctggagccaagatatttaaaaagtcctaaagtcatgtactgtactgatgagttagacaaaccctctatataattcaggggttccaaattacaagtcattttaagttgttgaagatcagagatgatatttcttatgtgggatacagtgaagtagatctatgtgtaagatcatgggatgaagccatttctcttttgcaatgcagattttaaaatggaaaatacaaaaatacatcttagaagctaaacagatgaagtgaatacatctcaatagtcaaaactaggaagcactttgccttgcttgcttttagatggatttatttcttatcattgtcagtaattcattgattcaacagctctctgcaaggttgtgttatgctgcatgacagattttgaggctctgggaatagagagtggacacatcaggcacctgccttcctctcatggtatttacagtccattcaacaagaaaagtaataaagaaattaaaaacaaaccagataatttcagattgtggtgagtgctgtgaaacaaaacaagacagtgtgatagaatagtaagcaatgtctcaatgaagacagaaattgagttggttaatttagatgaactgatcagaaaaagtgaaggtagtatttgcgtcagaatcagagtggaaaggaaccagctcttttaaacctggtagagagaattttagctggacagcggagaggatggaaaggcctttgagcaagggtgtgcttggtgtgtatgagagagagaggagagtgaatctagagcttagtgacccagagaaggagtgaaataaaatagcgccagagatatcttcagggccagaccatcttgggcccagtggagcttcgattttatactaaataagaggggaagccatcaggaagccttcagggcatggcaaaatctgatgcccagttttaaaaaatccatctggcaactgtgaagaaaatggattgtaaggagataaagatcgaagcaggaaataagtgcccaataaatatttattgaatgaataaatgaaataaagttgatgtcttttgctgaggctattcaatgtaggcatatccattaaattgctgattatatatgggtttctctgagaacatctatttaaaactgcagaaacctctttcagttaaaagatgtgggtctgatttggcacacaaaatattgaaattcctgcaatattattatatagggtaacatttcatgtaaattcttagaatcaaaatgagaggtggtgagaacaatttgacaatttcaatattattaggtctgtgtagcccagtgcaacatatatgattttacctgaagtcactatagaaaccatttgtcccagaaaactagacttcaaaagcacaggccttagaatcaggtacaatttggcctttgtcctgactttaatatcctttagctgtgagatctgaagcctcctcatctataaaatggtaatactacccatctcaatgggttactgtgataactcaatgagatgacccactcaaaatatttacttggctatcacgtaagtgttcaataaatgattgctattactatcaattgattcgttgattgtggtttaatgatctctgccatctgtatattcatcaaggtccaaattggaaggattgagatgggaggtgggaaggctgcctcattcgggctcacccctataacactgggctttgtctcattaaatggaaaatgaaataaaagagtaaattaggtcacctccatctagtaggaaacaagagagatatagtaaaaagaaaaaaggaaggcagatgaatttattgtattcacttagcaattttcgctgtgtgtcagataagttatgtccaatcagttgatttcattccaattccattatctttagctttttcctaaattagcaattgatgacaaactaattgtacttctcttcatggtccttctgtttgataagttcttttgtgaacttatttgtagactctatgagaaaataattaattctcaatgcaattttatgacctgttttagcaatgacctagcactctagtattttctgtgcaaagttagttgcttctgccatgcagagcctaatataaataataaaagatctctaatataaaatgaaatacataaaatgaggctatatttgtatgggaatttctatgatagatcagtaagtgaaaaggtatgttaaagaccagattgtaaatgttttttgtttgtttatttgcgtgcatatctaaatatctgttacgttaaatgttgcatctgtgtatatgtactatgaagagtaataatagcaatgacttctatggattattagggttctttctttaactgtattgtatgaaattctacaggagcaagagaaagatgtatcttattttcaatagcaaagagtagtccagggaagctggagcaagagatacacaaaagcaatgtatgaaccataaaaatgggaggaaaatatggtataagtgaagatatataagctagattgagtagtagtcaatgagttctttgccctaagaaggagcatacatttttatagcatacttctataactctgaatgtttaaccatttattttatgttgttatgatttaaaaatctagaacgactgggtcaaaacaggaaaaggacttttgaaataatggaaaaactaaggaaactgtgggtaagacaggattaaacaagctgccccaatttatgttgctaggaataaaatctaaatattttgactctaaggagcatgctgctacctctgaaagtcacgcctttcaccaaaaagtattaattatacaaagttaagttaaacttgaccctcaactatgtctaaaaattattataaaaattggaagagaatatcatattctgtttcctgtactttccacatattattaaagaaaaatgtgatatgtgaaaattagaaaatgtaaaatataaattaaatttagacaaaatttggcttgcagacatcaggagtaatttaagaagctctggccaaacctcccaacaaacttgccttctgcttcccatcctgccttgttccttatgactaaaactatcttgaattacaagctgaacgaaaagctcttctatggcttcccaagcagcacagcagttcctcaagaggtcttttgtcttcccccgatgtccatttcagggtctggtgtcccaactcagtgctccaggactgcaccttgccttctgctcctgagtgtcccgatgttgtgtgcccccccacatttctgaccatcattagttattgcattaactaatgaccctgaaatggacatcagggggtagataaaagacctcttggaggaactgctgtgctactgatgatggaaaggaatagtcataacacgtgatgcagggtaaatgtgcaggtataggtagagtagctcgaacttcaaaaggcagaagttgaatgtacacgtaagaccacagagtgatgtgttcaactcagaatgtgccttttgccatggaatttttcctaatataaaagtgaggatgttattgctagaatttctgttcagctagcactgtctcattcttgagtcatttgttgtttttagttgttttcctccattaggcttatgttaccaaatgggtcatataaaacatctatttgaagtgttatagtttaaacatatattgttttgtgaaacattttcagacattatatttcagcagagatgcatttgaaaaccatacttttgtgtcaattacgtatattctgaagtcctttaatcttgtaaactcctgccagtatcccttgccaatagccaaacctctcagccgtatcttttaggtaaagggcaacagctatttcatgtctatttgccaataatttcctctgctccagcttgagttagtacaggattcatatagctagtctgccttcatgattgactgaaattgtgtgaaaataaaactcaaggcccatctgcttttctaattttcatccaagattccctggaagggaagtacgctggagaccaaatatttgccattgctgtgtatggctgtagttttggaagacatcccagtatgggaaaacacaatactggattatttcaaatgttagttctctttttctttcgctccttccctcctttactattatataaaaattctaaatttctccagggatttgactgatttcctagtatttaatgtctgcaggagattgagatacatgttttagtacaacaaaaaagcagactttttagaatgcataatgagtgataaccattattacagttggaaataaaaatggatagtatattgtaatagtcagtatggcaatatgtgcttgcatggagtgctgctacaaccatctctgggaaatttcaaattcattgtgggctctttcatgttgcttgaggtgttccctctttctaaaatttcctttctacctatctgtagtctctaatttcttcagattctattcattaattatatggcatctgacactctaatcattaatcattctgattcctaagttccttcatatttgttatactggataagaggtttggaaactcactctgtaaaagctcagatagtaaatagtttagtttcgtgggccatatgatatccattgcaatattctactgctgtgtgaaagccatcagagacaatacataaatgcatgatgtgtaactgtgctccaataaaactttacttacaaaagcaatctgtgggctgggttgggcctgcaggccatagttttctaactcttggtggttaacactattttggggttttcagagcttgagagaaacttaaacttcctcatattacttgtgtatcacctgtaggaaaggggttcattgacatattcagggtcacacgtttatgatggagccaggtctaatgagcaactcaactaacaacaaccctacatttctaatttatttgtggctttttgtatttgattttattctatttagcattgaattttaaaccatttttattactcttttgttgcttcatgtttaattactttttgtggattcatttattactgccacttatggaggaatatgccatatctttgtatgtatgtgtgtgtgtgcatatatacaaatggaatgtagcgaaatggaattatatatatatatgtgtgtgtatacacacacacacacacacacacacacacacacatatacatataatctgcctgaagtagtgaaaacagcaaaatgcagtgtaagatctcaataaataatcgtgattaatgtcctccagggaaaaatatagtaattgttgcattttttagcttataatatgattatagattatgttttaatttggaagaatgtgagattgctggtgctttacattctgataataattttgcagtcacctttaaaaaaaattgcttattggccctgatctttactaagctcaatttaattctaattattgttattctgaataattatataattttttcaaattattactttaatttttaaatttttaaaaattgatttgattttttaaattagtaaaaaatgtaaaatttggtactcagatgatgaattagttacagaagccaatttgtttaatgtaataactctaaactatattatggttttataaatgctacatataaattctaaatttaaattagctattggatcatttaatcagttatcaacttagtttaattacattcaacgcaaccatatctatccattggatattcactcttagaaaatgtgtcatgcattattatcaagtatgagctagcctgattgagcaggtatggactagaaaaatttctcctagcatgatcctgcagatttataacgtggctttcttcctcattttcttcatatttctactcaaatgctacctgatcattttgtcaaaactttccttgagaaggcagcataaaatagcaattctcttcctctccacctcacccccaaactccctgcccactgtttcatatttaatgttccttcttagtattaattaccatagcatactataaatttacattttttcgttggcatgtttcttcccacaaaaacataagctctacaagggcagggcattgttaatttcaccttcagctgcacttcagtgcttggcagttgatgcatatttaaatgaatgaaatgaacatgagtgaatgttagcacatttctaatataacgggaacattagaaggaatgtttactccaattaaaggcaacacttatctcaaaaattataaaaagttataatcaaatgtatcagaaagtaggaaaatcaaggatgtatgtttgtgctcacagctaaacagaagtagatgttttcgattaatatgaaacccattactttagatgatagctttgtgaattgatacttttaaaacaaattttaagttcttttcattcttttacatttaactttctggggaacttatttatacacacatgccatatttcacagaggcacgcagtataactaagaaaaataagcaattttacaaatattatatgaagacggatttgttgattttaatttccaatttgtatacaattgagtggtgagataataaataataattcatttctccagtatcattggggacttaagtgaatttacaagaaaattagtttattctttctgttgctaaaatattttttgcttataaatttgagagagaaacatttttgaatatatagagaaacattttctgttttattaaacagagttctgagcataaacatttgtggggaatttaagaccactactctaaaaattaagtgttgtggcatgttataatatgagatcttgcttccagactctttgaggttcattgggtttagtacattcattcatttatcctacaaatgtttttagagtacgtgccaagtaccattgttcagatcactggagagtaagcattaggccaactaaaacttcatttcagatagagctttctatctagtgggagagaaagacaacaaaacaattaaatgagtaacaacataacatatatgtattatgacagaaaatcaagcaggatgtggatacagagactgatggcaacaaaatgctgggtgaactagcaaaccctgtcctcagtggcaaaggtcacattgagcagagacctgtgacaagagaggatacttggagtagtagttgcaaaggcttacagcaggggtaggattgtttttaaaggaagaggaggggccaggtgcggtggctcacacctttaatcccagcactttgggaggccgaggcgagcagatcacgaggtcaggagatctagaccatcctggctaacatggtgaaaccccgtctctactgaaaatacaaaaaaaaaaaaaaaaaatagctgtacttggtggcacacgcctgtaatcccagctactcaggaggctgaggcaggtgaatcgcttgaacccgggagacagaggttgcagtgagccgagctggcgccactgcactccagcctgggcaacagagtgacactcggtctcaaataaaaataaaaaagaaaaaagaggaaaggggccatggtggctagacaggaatagacaagaacatggggaaagagataagactagtgttgtggccatcataggccactgggtggcggggtagcaggggttgggcaggggtactttgaacagtaggccaagttgagagcaggagccagagagcattttgagtacagcagccacaagttcacttacagtttgaaaagtgtttcttcagctgctgccggcaaaactatagcagagtgagaggggaagcagggagaccacacagtcttttgtaacagtgatctctggaagctgtatgtgccctatctgtagctatggagttgaagtgaggcagtaggatttggaacatcccagtatcagaagacttagccctccatgccatttcccagagacccagagagggacggtagactcagaacagtcctggccacgttaacattagaagcacttaggcgttggcaaaatgagaaagatccatcaaaggaatcagagagcaagcagctaatgagaaaaaagagaaaaaaaaatcttaatgacattataaaagccaagtgcagaaagtgttacaaatagaattgaggtattgcctggtttcagtgcagttgattggttgagcatgatgggaactgattaatttttctgtcagtaataattttcaagttgatggttattctgtctttacttgctgatgtctagttctttctttctttgatttttgagacggagttttgctgttgttgcccaggctggagtgcagtggcacgatcttggctcaccgcaacctctgcctgccaggttcaagcaattctcctgcctcagcctcccgaatacctgggatcacaggcatgcaccaccatgaccggttaatttatcatttttagtagagatggggtttctcctgttggtcaggctggtcttgaactcccgacctcaggtgatcaacccgccttggcctcccaaagtgctgggattacaggcatgagtcaccactcccagcctcttttttctattctagtgagaacatgtaacatgagatctgccttgataagtgtgcaatatcatctagaggtataatatttcacaccagatctccagaacttagtcatctcacataactgaaattttatacgtgttggttagcaactccccatttcttggtcttttggctttggtaggagtcctctttgtctttcctcctccaacattagtaattctagttccctgttcctataatgtataaatacctgaagatttccaggagatgccagataccaaagcttattacaggaacaagctcaattttactcatgattctcagatagcaagactgaggtgaagtcctttggagtaatgtgctttgctatggttttccatttgaatatcagggttatataaacagctcctgtgttatattatatttaggataacagaattgcctaaattcctttgctaaatattgtttcaaagatacataaaagacatatcagattcaatgattttttaaccaacacataccaatcgttatttcgaaatcgttgttgagtgtctctctccctctctgtcttttgttttcagaaaaatgtgatgagccacttgtctctggactcccccatgtggctttcagcagctcctcctccatctctggtagctattctcccggctatgccaagataaacaagagaggaggtaagccaaattttgattcttttatcaataaacatgttaaataagaacatgttatatttatagccatatatatatataatcacacaacagatgttggcagacaccagaaatcactcctgccacttctattaaaagatccatagatgccattaacctctcatgtaatctccacattgaaataacataggaaaacttaggctggaagttagagatagtacgtcaaaaaggaagacattttgaagttgcctgggataataaagtcaaaatggcataaacgtttagagttaaaattcctattaatcagaaaatcatttagaaagatgtaaaaaagaattgactcccaaaatgcgtacggtgtattaaaaaaagcactttgtatttactgtatattaatgtaaaaagttagttcctattgaaaatgcaaatgccccttgtaatttttcctccggtacccagaatgtagctctattataaaatctgtgtaaaaaatcgttagatgtgtgcaactacaatgtgagttcttgaccttaaatcatggtatttgttagtaactggcagtttcaaattttctagcaattcactgagagtaaaagaacataattaaggacagaggcaaaaaactcttttgcttcaaaggaacactggtacaaacatcagtgaatggcaacttaaaaaggaaagaaacaatattatctcagataaatatgaatcaacaaacagagaccatgatgtttaattcagtaaaacaggaatggtggtggttgacaggggcttcggtggagagggagaaaaaattgagatatctgttaaaaggtacaaagttttagttagacaagatgaataagttttggatatctattgtgtagcatggtgactatagttaataatatgttgcatccttgaaaattgctaaagtaacagcttttaagtggcctcaccatttatgaaaaataactgtgttgtgatggatatgttaattatcttgagttaattatttcacaatacatatgtcaaaacaccatgttgtatactataaatatataaattttttgtgactgcaccttaatacagctaaaggaaaataagaaatgtgaaatcataaaacaatctagaatcaaccaattctataaataaaaaaatgaaagggaatgaatataggaggaagtaagaaagggaagaagggagggaaggagaaagggagggagggagagaggaaggaagaaaggaaggaaggaaggaaggaaacaaagatgaaaaaagaaagcaggaggaaacccaaaagaagaacaagaagaagaaaataaagagagggagaaaaaatattgtatcagaaaagaaaggcatatcagatttagaaagaccaaaaaagagaagaaaatagataggaaaaagctagcctagtgtatacagaataatatataaggtattcacagatctatgaagaggtctcagtcagtaaaaagacttggtgaaagagtgatacacaagcaaaggtagaggaacataacaaaaatgcagttttaatgtaatattagtataaattagctcatttttataacctgatattcatcaggctatggacatgagagagttgttgagttactataagttatcaaaaattctgcataaagatgttgaagtaatataaattttaatatatttctctctcataaaagtcattgaaaacaactaaaacaatgaatatagacagaaaaacatgaaacaagggactggccatacccaaatggtaattatgatacagaccttcccattactaggaaatctaggacaaaatatgaaaaagaaataccatataattctaggtcccaagagagtgtactgttccctaaaagaagtgccataatgccgagagacataaagcacctgtgaggaatggaagcagagtcagaaaatgttactttcaaaagttttgagtgaaaatacgactgaagaagatgatttgctcagtaaatttgggcaagtcaggttctgtcatgcaaacagcacttcaggaatacaaatgagacaatctagtcaccaatgagaaaattgaaagtgcacaataaagaaattgtggccacatgactggtgttgagcaaggaacccatttccatataagacctcgactaaacgatgtaggagctatagttgtaggagagagtataaatgttataggcacagaaatgtaaaagtgtcaattatgggaattagagagatgtgggtgttttttcttcctaacctttcagagcagcaggttaccagatgctgaaactttaggtacaaatttattctgcctttggttttttaatgggaattaacatcttttacaagaaaaaatatataggttttttgctctcatttaattctagaaaagttaaattattttttctttgttttaacataatacaagataccactttacaccatttagagctgcttatgtatttatctactcatacagagagagtcaggtatctgatattaagcttccaaagtgttaatatatttcttaacttggacacttggatttgaggagtatctttactttccttatagtagttttgtctgtagtttgtagaatatatatttatatctacctagatgattgacaggtaggtaggtaggtagatagagagaaatagaatgcatttccagaaagacagatgtttcaaaagcaaaaaaactataaaacaaaagttacagtttcttaactgtgtgacccacagttcatctctttttgaccattgatatactggattgtcatacattagggtgaaattatcacgttgggaaagaaagtgttgtctgtcctatagatatagatctacacttcattgtagcccattttatcatttgttatgtggggatgtgcagctacgtactttttggcttctaaagactgctttgcttatcagcgttatgctgtccataatgacatataactcgccctccccaacgctctcatttttgctccctaatttttacggatggtgaggtaactaagctatatcttcaccctttatgctgctctgcccctgcaggtacagcaagaaacatacatgtagggcttcacccttgttggccacgtaaatgtgggtcaagggaactagcatgagaaagaaaggttatatcctctccaaggaaaaacaaaaagaaagtcatacatagttgttacaatacaaaactttttttttttttttaagacagggtcttgctctgttgcctgggctggagtgcagtggcatgatctcagctcactacaagctccacctcctgggttcaagtgattcttctgcctcagccacacaagtagctgggattacaggagagtgcccaccatgcctggctgatttttgcattttttaatagaaatggggttttgccatgttggccaggttggacaacaaaatattttcttccactctaaaatttatatgcaaatgcccttgggagaagagccatgtagggtgaaattcttgaaaacatatatgtggctaatagccagcattgagagaaaagagatttttttttttaagtatagcatgatgttatatatctggaagatataaagaagacagacaattccaagcagaaaaaatatatgaacattatagaatccaggaatgttggagatacattttcttaatttacaagtggcaagagtcatctgatacagacactatataagtatctgaaagtgagaagatcatatactaacagaaaaatatcagaatgtaacctactaattatacaaatgcagaaaagaacaaattcagttgagcattatgttgataaacattggcttcaagttttattatttacttaaatgatattcctaaagtacattttggagagaaagtttataaatacataggaaagcaccatataaatgcatatattcaaatgacagattgtcacatatttatgaaattgaatttagtttatggttctccacaatacaaatccatctgctataatcttgatgtcagggaccagtacatggcaaaagtatggaggaaatgagatgtttaaatgaaaaatccatgcgtaattctgacatgtcttttggagctcattgtttttagtttattggtgctgttgttttcttatcaacaccttattcctgtgatctgtgttctgatttatccccacatttttaatccatcgaaggcttcccagtcttgtgtcattctgagttagtagcacttagatgtgttactctttccaaggttagcacagatacaaaacctttgaaagtttcaaacagcatatcccttaccttacttttaatatagaattttacagattataaactgctttcatctgtgctctaattgtttctcaatcttcataacaacctggttagaaagaatggtcagttagagatgccaatcaattcttctgccaaactttcaaccttgtacttcatatgccttttgtagaaatcagtccttttcttctgccagagagacagccatccaccacgtggtccaggtctctctccactaccacagaggcttagtgagaacacctgatctcaacggttgctattagaatccctctgctttgttacctgacatcgttttgggaacccaggggactactggggaaacgataacaggctatgtgtaaactagagagaagaggagagcaggtgctggggaagaagtgaagacatgaggccagggtacctgcacagagaaggatgaatcaagctctggtttcactcacaggctctttcagacccctgtttccaacttgcttaacctctgactgaacttcagcttgagtctctcagatgtatcattccagttctaatggtcacctccccctgtctgagctcattaaagtaagtttttcttcctagttactaaaggacttttggttttaaagaaaaacacaaacaaaaactagttattatccccgttttacaaattcaaataatacatatagaaaccccaaaatacatcattaggttctaaagtagcatagctagggaacagtggcacagggagagggacacaaatccatatcttctgctggaacccaacactctttatatgtaattacaccagatgaggtaatatcagtgctgcctttttgaattagcccaatgatggtgcctaaaatgagtttgaagatttgagtcaagttcaatttatttatgctgttatagccagagaaacccagtcatgcaatctcagtatttcccaactaatgtagatcctgaataattttctttcttttcaccttcctgccactgatttttacttagtagatatgtctaagaatcttgtttgttgcctcctcaaagatgtttcctcctatgtattttccctgagtaatttctcccattttaagaatgcgtcatcttctctatcacaccagagggcagaaggttgtggtggtgatgttgttttcacattagttttcctctatttccttcagcagggaaaacacattgcacttgcggtcacataattaataatcacttatcaaaggagtatgtgaataacagatgtttggagagactgctagaatagatctcttgaagtttctacgtgtatctcaaagagaaccacagtccttacctttccttaaaagacaccactttatactagaatgatttataatcctttgggtgtgtacccagtaatgggattgctgggtcaaatggtatttctggttctagatccttgaggaattaccacactgtcttccacaatggttcaacgaatttacactcctaccaacagtgtaaaagtgttcctatttctccacatcctcgccagcatctgttgtttcctgactgttttttttttgagacggagtctctctctgttgcccaggctggagtgcagtggtgcgatctcggctcactgcaagctctgcctccgaggttcatgccattctcccccttcagcctcctgagtagctgggactgcaggcgcccgccaccatgcctggctaattttttttttgtatttttagtggagacagggtttcaccatgttagccaggatcgtctcaatctcctgaccttgtgatccacccgcctcggcctcccaaagtcctgggattacaggcgtgagccactgtgcccggccggtttcctgactttttaatgatcaccattctaactggtgtgaaatagaatctcattgtggtttgatttgcatttctctaatgaccagtgatgatgagcttttttttaacatgtttgttggccgcaatccaacccaaatggccaccaatgatggactggataaagaaaatgtgggacatatacaccacggaacactatgcagctatagaaaagaataagttcatgtcctttgcagggacatggatgaagctggaagccatcattctcagcaaactaacacagaaacagaaaaccaacactgcatgttctcacttataaatgggagctgaacaatgagaacacatggacacagggacgggaacataacacaccgtggcctttcatagggtgaagggcaaggagaaggagagcattaggagaaatacctagtgcatgtggggcttaaaacctagatgacagggccgggcgcggtggctcacgcctgtaatcccagcactttgggaggccgaggcaggtggatcacgaggtcaggagatccagaccatcctggctaacgtggtgaaatcccgtctctactaaaaatacagagaattagccgggcgtggtggctggcgcctgtagtcccagctactcgggaggctgagacaggagaatggcctgaacccgggaggcggagcttgcactgagcccagatcgcgccactacactccagcctgggtgacagagcgagactccatctcaaaaaaaaaaaaacaaaaaaaaaacaccctaggtgacaggttgataggtgcagtaagccaccgtggcacatgtgtacctatgtaacaaacctacacattctgcccatgtattccagaacttaaaaaaaaaaaatcactaaagccatagtttccagtttaatttttaaaaattaacataaaaagacacaaaagacaccactgaagttcataattgccacgatgcctttataccacagcttgctcagataatcactgtaggctggtgtcattttccacttcctgttggccaggaggaagttctagtgataagcatgacgccaacctcttccctagctcacacttacatacacatgtccccctccggaaacgcgctgggctgcctcttacaggctcccaggcagttcagcaaacagtaaaaccttattctactcttgagaaatctattattcctgctactcctagaaagaaaatttttccctttttcccactctcaattctcttgtctctgagttgcatttataaaacaccttctttccctctgctttttctttgctctcctctttttgcctttaaatattagaaggatctgtcacaactaattaaatctagaactgcagctgatatactataaactgggaacggaaccacagcgcgtccatgagggcattgtctgtctgtgtggcctagctcctcctgctggtactcttctgctgtctctagtccgtgatgtactcctttgttacacatggcccactcatgaccgcccgaatcagccacagtaggcggtattcttaaccttaattaggaagctttattcttagaatataacatcaaggcttaaattatgaagtagactcaagttcccaattgatgagattctgccctatttttgcagcttccattccaatatttttcctctttccctttgccagcctctaccatgtagtactttttaaaattttctccttttctcactcacaggtaattcattattacttaagtatgaagtaatcggtgaagtgatacctctcaggacgatttgccttataaaagcacatccttgggagcagaaaaattcaaagaactggtttcctaatggggcatttcaggatatttgacattcctattttggctggtcatacttcttcatcttcaattggctctcctggaaacacctgctgattttgtcggctctgaggcagtgctgagcagtaaaaggagagtggcttgtcttcatgcctaactaagttccagtactgagctgaccaaggacaagcatgggattagcaaattatttaaatgtattatatcttggtttcctgatttctatgattactatatctgaaccaggatataataatgataaaggatataatatggaataatttgtcatctgagtcaggaacttttgacagtgaaagagagtatcattaatagttacacaaggataatcctgaaagtatggtccctctacttgtagtttaaaataaaatcagttatactgtttagcagagctaccgtgaaggttaaaagaaacaatttacacaaactatgttgcattgaaatattagtctctttcccataagttactcccagcttctaaaaacaacactatagataccaacattttaaaacgaggattgaattaaatacctttgtcattacaaagacgatgcctccttaaaaatttattgtttaaatttgtgtatttgccaatgtatgtgtgttttcccccattatcatctaagacaaaatattatcataataatttaaaaattagtaaaataacatttttaaaactttcagtatttttggggtgttaagacttacagtgacttaaatattctgcaggacttttcacctcaaactcctttcaatttaagtgaaagagattatgccagtgatttttaagtgttgttttgttcttattatcttaatgttgtttgaatttgatctcttagaatctatatatcttatagaaactaacatgtagttataagcctcatataaaaaattgttctggacattagggcgaataaaaagtatcacctttgttttccttagcccaatatattctatcttttaaatacaacttttcaaagatttcttctgaagacctcacagatttcatatccacctccccaaatgaatgagagtttccatctaactggtattgtgaattttaatgtattcttttttacttaattctcaaagataaaccaaaattttggcttgactgggagttttataaaattaaatgtgtaatacaggaatatgtgtatcattgacacttgttataaatgatagaatgttgaaagcaaactcaccaggcaatgactcatacattttgtttgggcatacctttttaaattttaaaatagtattgttatttttcaaccattacactcaattttaaaatgttggtatttcaacaccttgtttttgttttcttcatagaaatctgtgctaggttttgttgcaatttccatagagcaatgcgtcccaaagtgcatgatgttaatatgtgtggtgaacacacgtatatacatacaagtttccataatcaaatcagactggacagatcttgtgctctgggatcttcttttggagaatcacagatcgtctttatcacagaacatctttaaggccagcagaatacatttccactttgggatttgcttttataaaatttagctaaacattgtgcggatcacgggctttcaatggggtttctttaatgtacttagaaatatagtcgtatctcccatggtttcactactgtgtttctgaaaatactgattataaaagttctttgataataagtctagtgatttttagtttaacagaatgaactagacttaattagagaaaggggaataaagataaaagagtttttcaattttggacttttgagatgaagaattttttagttaattatttttaggaagttactattttcccctttgtgtaccaaattctatatatcttaatatttgctattgagaaaatcatgtactggcttaacatcaatgctatcacattgatccctgctgccgcctttgaaatggctctggaatattaattttctaacactctctttagatcacaacattaatagctgactgtctaaaagagggggaagtttgcgaataattcattattataatatgtttggtaattttagtttaaacacaatactgaaaactatcctatttggtactggccctataaagtttaggacatatgggatgggataaccacatctgaattagcaaatcaatgtatttaaacaaacaaacaaaaatttaagaagatgtgaagaatacatatacctttgtaagattgttgatatggatctagatttttcgttacccataggagacatcttgggccacttcctacttgtgttcaattgccaaaattcctcactcacttctataatgagaaattttgagtggacactctctaggaccctgtcgtcactgaacgcccgttgtgtagccaagaaagatcataattccttggtcttgatcttactgggctcttacagattcttagtggtctggaccacacctccctctgtgcgtagatatcgtttctatgaaatttctggagaatggtcaggatatctaggcaaaaagctttatcaaatatttacacactgaatttttctttctaaaccattcaagaatataggcaaaatgtgtttacgagaataatcatttaatattcctttatccctttgctttttttttttttttcttttaagacaaggtttgtcacccaggctagagtgcagtggcatgatcagggctcgctacagcctccacatccttgtgctcaggtgatcctcccatctcagcctcctgagtagctaagactatagactcgcaccaccatgccctgctaattttttttttaatgtttgtacagacagggttttgccatgtgtgtcaggctggtctcgaactcctgcactcaagtgatctacccaccttggcctcccaaagtgctaggattacaggcatgagccacagagcgcagcctatatgctaactttattcatagagagtctttagtatttttcacatctcaaataaggaggtggagaatttttgtgaatgatttctaccatcagaaatattcattttaaaaataaaattcttcacagcctgaaagcactttcatgctgtacttatgcaggtttgactctcagagaatattttctaaatgtgtgaacaagtacataaaatattatttactgcatatattattctactaattgtaaatttcaaatactcattgcttatatgtaggaatcatttgttaaatcaagagttaatatttgctggtacttttcttgttccaaaaaactatctcacaaattgtttggtcactgtcgtagccaattggaatctagactataatagcagatgagtaacaacaaccaacgcaattatcatcataaataaactagaaatttaaatctcatttttaaaaatgaatattcagagtcattagagaatggccctctcatatcaacattctttcaacacttccaatattgtagaacagagaccatgaggataatgttgagctgataaagcatgcctttcttatctcaagatattatttcacatacatggctttcgacttgtgctggcttttgggtaacagaatacattgtatcggtccttaacactgtatctggctcataagaaatacattctgtaacccagtagaagcagtgtagcctacaagaagaaatgaaggccaggaaagaatagggcaagtccacaagtagccgtttgggaagctcacatcagctggttggtgagtggcattgaacagagttcattcaatagacaagtttaggccataaaaaaactgcacctgtaaaaactatagttcaaacctgaaaattacaattcctctataccaaatgagtgactgtatttttcaatatctactctcctgtgattaaattccatgcttttgtgactatttatccctttttctttattttacttattaagaggcagaccaaattatttccaagacaattgggaggacttaatctaataatgactctgttagcaaccggctcaggtcatacttattaaaatgaacagacccttctcttaatacccttagcaaattagtgactttttcacatttttttctttcagaattaagaaatatagaattgttcttttatatgcatgccttgcaaaagtaattctaaaaaaattgtcactaataagaattcaaagcagtgtagcctttgttagctgccttttctatacaccaagaatgagcaatcaacattgtttactcatcctcttgctttaaaactcagatatatgcttgacgcgaatattgctgacaataaaacatgacatttaagacagtctatttttattgttcttgcctctttaacatcaaaatgtaaacacaaaatgtagaaagatttcttccccaggttttcacccaaaggtcattttattttatttcccttagctattatgattttcttagcaaggtaaggaattcatgttgcttttattttgcttggttttcattctcagcaacttttgcaatgtatttcctttgcatctgtcttctgctttaaaattgatagacaatggtatctgtttgaactgcgggtccttgtctgcaatatgtctgtaaccaccacctcaccagacatccacaaccggaaagactcttctgcctccaggatgaattattttgcattacaaggtttgtgcctgagcatatgtatgaataatgcataattaagcgtgttctataattttctctagccagtgtctggcacatacatatttggatggataacgaattgggttttgttttgttttcaaccctctgcttagaccaccaaataagtcttataaggatctactcttaagatgatgaaaagtattgttgacttccttactcttcctccctgagtgttctagagggtggaagttaaaatcacgtgcttctgaggtgtacaggcttctatggtactgtgtgcggaattggtgggtttttggtctcgctgacttcaagaatgaagctacggacccttgcggtgagggttacagttcttaaagagggtatatccggagtttgttccttcagacgtccagatgtgtctggagtttcttccttctggcgggttcgtggtctcgctgacttcaggaatgaagctgcagacctttgcggtgttacagctcttaaaggctgcacgtctggagttgttccttccttctggtgggttcgtggtctccctggcctcaggagtgaaggtgcagaccttcacggtgagtgttacagctcataaatgccgcacggacacaaagagtgagcagcagcaagatttattgtgaaaagcgaaagaacaaaccttcccccgcgcatgagggtacccgagcaggttgtcactgctggctggggtggcctgcttttcttcccttatctggccccacccacatcctgctgattggtccattttacagagagccgattggtccgttttgacagagtgctgattggtgcatttacagtcctttagctagaaacaaaagttctccaagtccccaccagattagctagacatagagcactgattggtgcatttacaaacctttagctagacacagagtgctgattggtgcgttcacagtcctttagctagacacaaaagttctccaagtccccaccagattagctagacacagagggctgattggtgcttttacaaacctttaactagacggaaaagttctccaggtccccaccctaccgagaagcccagctggcttcacctctcaatggcactggccacgggactttgtggcacctagcccaggcactccagcagcccagagggagcttgtcccccaaacaagcccagcaggcgcgggctggccaccaagccggcgcccacctggaacccgtgtggcctgagagcagagggagcggactcttgcctctgccagccccagagggggacccccacagcacagcagcgggctgaagggctcctggagtgcggccagagtggacgccgaggccgaggaggcaccaagagccaggaagggctgctagcacattgtcatttctcagtactagagtcatagggattgctagagactcttctcgtattatggtaaggtcatatgttctcataggatcatatagaattcccagaggaggatgattaaatttattccaacaagaggctaataaagcagaaatgatgacttctttactgttgaagggctggcagtccacaaaaacaagtgccaagaaggccaaaatagcaaaggatgttaccactgcccccaccacatttatattcccaaaccttccacacacctacattcacattcaaatagtattaaagtataagcacttctcattggtcttcaggtttttttttaattagatagatcagtcttcttaaacagcattaacatgtttaagcttcctgtcctttggtagtgacttaagttgtcaacttccttaaaagtcattactgacggcaaagtatttctttttggtcatttcaagacatccacgtgtttttttgttttgttttgttttgttttgttttttcgtctatctctatctcagaacttataatgaagtattgtattgtagacttatttttctgaccccaagagactgggtgggtgtcacctgaagacatgtcctgtgtatcaagtatccatgaatacttgacatacaggatgatgccaagaacagagctgatattcacaaatgtagaaataaatgcttgtatgtacatattattttatctgatccttacaaaaccctaggaagaaattcagaagttacaaaactcagtttgatgaataagaaaactgagattcaccaagtttagattcttgcctaaggtcacagctaacagaaactggatctgagtatttgaaattaagtcttctgacttcaaaataattcactattctgtcctccacttgtcttccctgactttgtgagaacttttcttttggaaaaatttgaataatatttgagttggttataaagcataactaaagttttcccactggtgttttagaacacaaaaagagacatttctctttcatttctgagaagcgtatattgagtagattttcattcagaatgcctttgtgatttctttgcatgttttttaatctgttttaaataatctgaaagtaaaagaagttattttaaatatttgcatataatgatgtatttgttaaaagcatatctttttttcactatactaaaagcctagccaaaattgaaatcaatttagtctaatttttgaacttgtattatgtggggtggcaggcaaaaaaaaaaaagacaaacctgtactctaaatattatatatgtgggaaccagtaaagatttgaacagaacaatgagaccaacattctctctaccagaaaagaatttaaataagaaaaaactactgatatgcagcaccaatacgctagaatctgacagaagctgtatttttaaagtcactaacactcttaatattcaaaacacacctgggaaaaagcagtaagtcagtacaaagtgaaagaaaatgaataacaggagtaaacctcaaccacaaaatataaagtatgtgaggcctactagatatgccgtaagtggatctacatttagtgtgagatgagaacaatctggcatcaataataacaatatcccattgtatgatcattatcaatcactaaatgctttcttccctttcaaataaaggattcagcattgtgacattttgcctttcattttgttgttgtttagtagaatgaccatacttcctggaaaactagaaactcccaagggaattgattcattcttttctcccaaacttctttctatcaagtattaaataaagtaaagcaaagactcatttgaccaaatctttcaaagttaccattatctaccttctctatagattatttaagacaatcattgatgatggaaaataattttctaaagactgtttccaagaagcacaaaatacttttggtttttaattcaaaatcctgtatttgaatttcaacaattcaaacaagaaattggaaaccaaatattggtattttgtacaccaaactgtgtttgttggtttcattcccaaagaaatagcactaactaggaagagaagtatgagttttaggctttcaaatcgtggccatcaggacttgagaggaaatatgcaggtgccccagttttagggatgtttattggatacgtccaaatgatgcaacttcagcaaaactatcttatcttcgtgatttggtcagtgatttttttttttttttttgtaagacggagtctcgctctgtcgcccaggctggagtgcagtggcgcgatctcagctcactgcaagctccgcctcccgggttcacgccattctcctgcctcagcctccggagtagctgggactacaggctcccgccaccacgcctggctaattttttgtatttttagtagaggcagggtttcaccgtgttagccaggatggtctcaatctcctgaccttgtgatccgcccacctcggcctcccaaagtgctgggattacaggcgtgagccaccacgcctggccgatttggtcagtgatttctatgcaggggcctggagacaggctttgagtacctcagtcttttttttttttaactttaagttctggggtacacgtgtggaatgtgcaggtttgttacacaggtatacatgtgccacggtggtttgctgcacccatcaacccgttatctacaatagatgtttctcctaatgctatccatcccccagcccctaccccctgacaggccccagtgtgtgatgtccccctccctgtgtccgatgttcccctccctgtgtccatgtgttctcattgttcaactcccacttatgggtgacaacacgtggtgtttggttttctgttcctgccttagtttgctgagaatggcggtttccagcttcatccatgtccctgcaaaggacatgaattcatctttttttatggctacatagtattgcatggtgtatatgtgccacattttctttatccagtctatcagtgatgggcatttgggttgattccaagtccttgctattgtgaacagtgccgcaataaacatacatgtgcatgtgtctttatagtagaatgatttataatcctttgggtatcagtcttaatttagcatcttgtggttccaagtgagaagtttaggtagacagacccagagatgccaatcagaactcaacatgctccttgcagcactgggaaagaaaacgcagggtggaggaagcacacagtcagtggttatgacagagataaagaatgctgatgctttgttacagcttcactttcatgtatttgtgagctctttctaacttttccttccactgatatgacatacatttggaaattatcagttctcctcagcaatttatcaatgaaatggcaaggattcactaaggagtgataaacaggcaggatgttttgtcaacagcctgaaatacgttaatcagcttctggaatgccaacaatttaaattcaaatagatttctcactgagcctgagatctaaaaccctgtgatgctgtttctgtttattggattaatgtagattttaggttcctttgtcctcaactcttgggaatcccccctactatttttttctttgtttggatggcttagttggaatagaaaaaagtgtggttgatttcttcagaagtgttatctgtgtgacctcatactcaactgcgggaataacagaaaggcagaaatcgggaaataaaaatcctgttgccgaatgagaattctacatctcactgccgtttggaatggtacagtgattcatatttcaggcacctcaattagacattcattattcataaacacttatgtaactctgagttattcaggctgggagagaacattgcaatctttctttttccttttctttattatatgacatcttatatcaaaaaaaaagaaaaagctaaaaaaaaaacactctgctacatgtaaatctgaactatttattttaggcaaaatggcatgaataaaacaaagctgatctacatttggctttgtcttgtcaaagaagcaatctgaacaaataggctaagatcaattctattagaggtgaaatacggaccaagataccaacattgatcccttcagccatggcccttgcatatagttccaatgtacaataatacaggtcaggacctggaaaggcctaaatgataagactaagtgtcaaaatcagtgttgaaaggctgctcaaactacagaaaatgaggtatccaggcatttaataagcatgcattgagctaagcacataccaccactaaagattcatttgcatgtgggattaaaacatctgaaaagttgacaagggaacgttttagagactctgagatggtgacatcattatgacacaaggcactgttggtctgaagcacactggtgagtgtccccaaccataaatttggagatagttcaggtggcatctgagtattaatcaaaagaaaatagatacttgtcttactcgatgaaaataataattattttttttgaaggggcatcaataatttaacaaatatttgtggtttactttgtgttcagaacatgttgtagtctatgtcagcactgtctggtaaaatacatggtgagccatatatgtaattttcaattatctaatacctgcatggaaaaaaactaaaaagaaacaggtgaaatacattttatatgttttagttaaactaaaatattgaaatattgtcattttgttatgtaatcaatataaaaattatcaatttgctactttacatttttcatactaaatttttaaaatctggtgtgtatgttacacttatcttgattcagaaactaaatttccatcagaaatacttcatctatatttaaatttcacaacatttatggtttaaacactggactcacatagccaaattgctcccaaaatatctaaaatgttctcctataaatgaattatcagttttaaaatatacatttaaattatttaaaataaaatagcaaatttagatctgcagtctctcaggcatgtgttagtccttctagcaacatgccaagtctgagtagccacaggtattgacacctgcacctgtgggaatggtgaccctggggatgtgcagggtgtaatcatatgcagtggcattaatctttggggagagtcagaattcatttatagcctggtggtggctaagagatggcagaattataataactgaggaggctaagtacttaacatcaatttgcagggcagtctcattttatcaggaaaagcaagaatggcagaggcaagaatgcgatagctgttccttgacattggaaaaccttcagcaaaacccagggtttgggggttccccctgggtgtctgaaatgtagcattcagcactagctccagcctttgggcagctgtgggggccagagaccaagtgtggtccctggcccagggtgggattagacagcataagtggtgtcaagaagtatatgttagagttaatgaagagtaggcagtatgtggatcacaactctagggaccatcaaataaaacttctttcagttaaggcattttgtttactgttaaagaagacaggactctaggatgtgtcttacttttccagaacatgttacaaactgatgtttcttgagattatgttggggtatgctcagccagtctctctcaccgggttctagagacagctgctgctgattttgagggtaaaaatctagtattcattgatctgaacagctgaaagcaaatcccttttgatgcaatcagattgactcaaagcattagacattttctctctgtgcagactaggctaaatgcccttggatagtctgtttcatgggcttagccttagcaatatggacctggattaattactctggcattgtgtaaactctgtaactatgtagaaatagtattatctcctatcatatctctatgtctgaacattatatgcaaccttctgtttattatcacagtaaaaaagtctgtccaaatcattgtatatgcataatttctattatgtttagagggattgatgattagaagttgataggaagacattatttaataattacaagagaatgcattctttaacaaggataatatacctcattaaaaataaaaatcattgaattatttctctactgaaacatatcagtgtcagaaataacatgaccctaaaggatatcagttgtgaataaaagccccaaagtggggattaaagtattaatagtcatgggggtaggtatgattttgcagaggtagaaactgaaatacagataaataactttcccatggtgtctgttgtatgtagtgaagccaggattaaaaaactaaggcctatctaactgtgttttttcataatgaggtactaactatgatacgaatgctccaaagctgtcaaaccacgagaggaataatgtattataccgattattcattcagaaaaacaatacaagtacttcaaagtagcaagaatctactctaaacaccattttcacaggtataaagcaaaaataggatttgatctttgaaaatatctattttaaagaatttagtatattgtgcttttatatcaattatgtactgccttaaacattcatcaagttctgctctaaaatgcagcatctctgaatatgacctgcagcttcatatgctatagacagagtagtcagagaaagtagaaagcaggggcacccattgcctttgaagagttttcagtgaaaaatttaaagaaaaaacgctaatcacagacataatgtaagtatatgaatataactattttcccctaaatctgaacatagataatgcaacataaatctcatgataaagagcaatctctaccttatatagcttagtggagaattagaatataattagtaaatgttgaaaataaagatcaactatgttgatggtattttaaaccattcagttctgtatatcgacattttgccaacactatgctaattctatggctctctttttggccctgagtttacttagtattctccacagtatactctgacctcgcaaatcaacattcatggtacaaaacattaaaagtacagaatatattattgttaagaagaggattcacatgtaaagatgacaatgaaagtgttcctggggaaaactagcaagggagtggaaagtgggatggagaagtaaagtcagtgtgccaaatgtcatggaatgtaaccttggctcagatcccacagggaagctcttgagataagtcacatgtcacagctgtctgaagcaggggctagaagctggagactttatatgcctacatctatcagacgttggttacttttcccaatttcccaactacccttatgttcaggcaagatgggttctggcagcctgagggttgtccgcagacaaaatcttatggattctagctattatttgataaaattgacatgttcacaccttatgccccagcaatttcaatgataggaagacatcccagaaaaatgcctgctcatgtttatgggaagatgtgtattaaaaatatgcagagaagcagtgtgtattgtataataacccgaaaatgaaaacaacttaaatgtccataaacatcatcactgttcaaagcatatgctacattttatataaagaaatacaatttgaaattcaaagggaatacacttcaagtaaatacacatgaaagaaaaatcataatgttgattaaaataagtcatagaagaatacatacaatgtcatttcacttacataaaatccaaaaacaggttaacagtatatactttaggaatatatgcatatatgataaaaccagaaagaaacagaaaggcatgctttattgaaagtgaaggctatcggttacttctaagttgcagggagggagatggtgtcacaggaccaccagatttgtatgcttgctgtgcagtaacagacaaacacactgagacagcagggtttgcaacagagaaagactttaatgattatagggcagctaagcaaggacatgagaacgaccgtcacatccatctccctgaggagttctgggctggagtttttaaggggattgtggagggtgagcggctgtaaaattggggttttgattggttagggtaagagtgatgaaatcatcttgatgcggaaactgaattttttgtcagcttctcctggggtactttggaccagctggtgtcagtaattccacccatatgtaggagctattgtagatcaagatatgaagataaagaagatctagcttctgaaacgcagttctataattaaagaagtgatataacggtatagggacttagagggccgactatgacttcctaggttagaaacatagcttggccacttaaaaactgaataacctcagtagaacctcattgatttcactgaaaatcaacttccttatctataccatggaggtaataatgctgactaccttattcactttgtggggattacataagttaatacatgtaatgcatttcaagcagagctcagaggcaagtgaagcactcattaagaaaacattcttggccgggcgcggtggctcacacctgtaatctcagcactttgggaagctgaggcaggcagatcacgaggtcaggagatcgagaccattctgtctaagaccgtgaaaccctgtctctactaaaaatacaaaaacttagccaggcatggtggcgggcgcctgtagtcccagctactctggtggctgaggcaggagaatggtgtgaacccgggaggtggagcttgcagtgagccaagatcgcgctactgcactccagcctgggcaacagagcgagactccatctagaaaaaaaaattctttttaattatacatgattttgattgcactgaaaaagggtgggccagttgcacctgtaagaaaaatcttattagttttctgttgggactactgagggacacaggatggaaaagcactctgaacagacaaattggcatgtgtgcaaagcattgaattacaaaataacaagggaaaaggtgttcaagggaaagtgatggagaagattgtatgggaggtggcaggagacaccttgatatcatgtggggctgtctgataaatttgcattttgtcttagagctatctgtaattcttaggagattttaaacatggaaatagcatacagactatttcactaataaccaagtatgccttgtggaggatgaactgaattaggacaaagttgttagcaaaagaccactaatagctgtttcaagtgaaaaatgttgatggatttaagtaaagcagggtagaagaaaaagaaagcagattaaacagatatttctgtagaattaactatactccataactgactgacttcagagatagaaagatgctaaattatgctgcagaacaagctaccaccaaaatctcactgatttacaaaaaggaaggtttagttctcactaagatacgtcctggcagctgcagcattcaaaatgtatttgtttgttcattaccatttatcatctctttctctgtcactgttgacaagatagagatacaaagttgttcaaaaatatttcaggtgtaactatgtatacatttgttacatgaattatcacaaccttaaatcttttatttctattgtcttaaccatttttgccacacagaagctattcatatgacaattaagttgatatttttggccgagtgtggtggcttacagctgtaatcccagcactttgggaggctgaggtgggaggatcacttgagcctaggagtttgagaccagctgggacaacatggcaaaaactgtctctctaaaaatacaaaagttagccaggtatcctagcacacgcctgcggtcccagttactcaggaggcagaggcacaaggatcacttgagccggggatggggaggcagaggctgcagtgagtggtgatcgtgccactgcattccagcctaggtgatagagccagaccctgtctccaaaaaaaaaaaaagactttttttgtggcagtgtctcaaacagacacaatctgacataatttagcatgttttctttatttttgacacagggtctggctctgttgcccaagctggagtgcagtggtgtgatcttggctcactatagcctctgccttcttggctcaaacaatcctcatgcctcagcctcctgggtagctgggattacaggtgtgcaccatcagtacctagctatattttttggtacttttagtagagatggggttttgccatgttgcccagaatggttttgaactcctgggctcaagcaatcctcctccctcagcctccaaaatgttgtgattccaggcatgagccactgtgcctggcccataatttagcacttctatcaaatgcaattatgacatgaaatatttctggttaacaactgacaatgtaactaatacaataagttttatttacattttatgggcagattttttttggtgcattctgtagtcatgaacaaattaaatggtcattatcctcatggagattctagcaaaaagcaaattataattacccacattttcatacccagctaagagtcctagaaagcctccaacctgttctagccattttctcatatttgtacagctgcaaaaaaaatatttttgagtacattatgtgagctaaattgtatttcaggtggtagagactatagataaatatcctctttcatacaaactaatcctttcattttgatgcattatttttgaggttcatatgaaccacaaccacatcacttgaattgatgtattggaaatgtgataaacattgtgtccagactgtatttgctatttattagaacttacctctccttgtatgaaattaagtatttgttttagatcaatttctttgagttgctttcttttttcttttttaagtgaaatagaaaatgaagtctgtagaatctggggaccttcccttgactaaaaatgagtttccatagtattaccataaaatctatggtaacccatttcatactgaaagattcttgattgcttacctgttgatgtcattccctaggtgacgtctccttaaagacattattgtatcccatttttatttgtatacacagcatctaacatcatgtccagcatagaatatgtgtctaataaatgttggttggttgaaagataattttcatctgcagtttctttatgcacattcgagtttagtatcttctgaattattgttttgttttatatatgacttacatgcacattaaagtaagaaattttccaaagagcttgagtagcgctaagattggtcattttcaagcatatcaaaagacaatgagtgaaaatactgtagctatactttattactctgcaagcgtatgactaaatgcagctgactcctccacacaaaattaccatagtggttaagagtgagattttagcctaatacctaagtctgaacctttctctgctgctaactcattgtgtgatttttgtgcaaattacctacatttctggacctctatctcttcacttttaaaatggggatcactttgataattgcacctatctcacagagacattttcaagatcgaaggagtttaatagtgtataaaatttagtaaaattcctggtacatcataattgctatgaaagattggttatgggactcaacaaaatctgttaaataaaaaaagtatgaaaatatgaaaatatataataacatagtaacatactacaattatgaatatggactcagttctaattctgaatagtagggaatgcatttggaattattagtaactaatatgatatattcttttgtaataactatatttttccatgcttaggtactgatcactcaggattctagttgtgaatgatagcagcaacactagctattcaaacagaaagagatttattaaagggacttttttactgaagtttctagacagctacaatcagatttgaaatgccaccaccaagaacaacacctacatctccccagagctcctcagtgaagccagcactgctatacccactgctgtagatgcctgatgattctggcactgcgtgccaagctgcccggggtggcctgggaagaccagctggctctgaccctagccttgtcagaaaatcagtttggcacagaaattgctttatctctctagaaccaaagtcttgtgtttttctttctgttgggcatttaagtcaaatacctctactctagctgcaagggaagctgagaaaatgaacttctgaaattccccaaaatatgcaggttgttcaaagctgctccctggccaccaaggtgtcctcaggcacagagacattaactagaagaggattccttgagcgccacaaataagaacttatggggccttatttagttgacaggggtgaacagtacctggaatatcagttgtaaatgtaaggagaattctcacatagagtttaaattgcttaactatattcaattatttcaaaaacatgaaacgaattatactagatataatctcccataggatttactgaggaatacagagaagagtaaaacaccctgctctgattcttacagtgagcaaagaaggtgtcaggagtagagaattttttcccacatgcaatgtgggaaaagtataaagtaccctacagatgcattgaaggaaactcctctctttaggaagaataaggagagtctgaattgatttgctggttaagtgtattggtctgttttgcattgttataaagaaatacctgaggctgggtaatttataaagaaaagagatttatctatacaagcatggcaccagcatcttctcagcttctggtggagccttaggaagtctttacccttcatggaggatgaaggggtgcaggtacatcacatgatgacagaaggagcaggaaaaaggaggaagtttcaggctcttttaaacaactagctctgacatgaactaatagagtgagaactcactcagtaccaagaggacagcaccaagccattcatgagggatccacccccatgatccaaacatctctcactagacgtctgagaccatctccaacatttgtggccacatttccagatgagatttgcaggggtcacacatccaaaccatatcattgaccaaacatttattgaatttcatattaccaatgaaggtacaaattaagtaatatatgttccatggaattattaaactttctccacatgttgaaagatttattcaggcataaaaagtttctatttccaagaaaggtacgtaagtggaaatatatagagaattttcagggaaaaatatgctttttaatttgactaaaaagttggttagatccagaaatatggtgggttctttgtgaatgccataataaagaactgaggcatgacactcattttattatttttaattgtttttccagagaagaggctgacatggttaaagtgtgttgttaggagatttccattgtcaatgtggtacagatcaaataaaagtgagaaagctcttttattataccaaatagcagatacggtgaattttaaatgcttcatggtaaagagaatagagtggaaagtgagatgcagatgacatagattctatggttctagaataaaattattaattttaatgaatgtgtggagcaagacagatatgaatctcagtgaccatgctggaaggactgtggtgttatttacatctatagaaacatgatggaaaacacattctggaatttagaaaaaaatttagatagaattgttgtgttgaatgaattatatttgttttctgttgctggataaaaaattaccataaattcagcagcttaaaacaacacccacttatcaactcacagttctataggtcagaagtccatgtggaccggactgcattctctgatatgggtatcatgaggtggaagtggatgtgttggccggactaaggtacttggaagctctggaaacagtctccttttagcgcattcagattgttgacagatcagtttcttgcagctgtagaaatgaggtctcagttttcttcagcaatggaaaaccccccttacatcaaatccctgtcttgatttcagtctttctgatttctgcttttgctggcagtttagaaaatcactgcttattttattagattagggatatgatttggctatgtgttcgcacccaaatctcatgttaaattgtaattcccaacgttgggggagggacctggtaggagatgatcatggggggcaagatttccaccttgctgcttttacgatagtgagtgagttctcaggagatcaggttgtttagaagtgtgtagcacatccttctttgtttcctgtctcctgctccaccatggtaaaacacgcatgcctcaccttcaccatccgccatgattgtaagtttcctgaggcctcccagccctggttcctgtatagcctggggaactgtgagtcaattaaacctcttttcttcataaattacccagtcataggtagtttgtttacaggagattgagaacagactaatataaataggctcttcagaatactttctctatcataaggtcaattgattactagacttagacaaatagtgtgcagctggaagtgctctctggaacttggaagaggattgaagtaagagatatactctgaagagtgaattattccagtagtgctatgaagagaagtgactgacataatcaatgaagattatattgagaagcaaaagtgaaaaatctgagatcttgcaggtaaaaaataaataaataaataagtcttagtgaaaagatctcaatttcatttatgggagtaaatgccaggaattgagagcgggaggtaaaatatgtattgttagacttgaggaggtcatgattcttgaagtggaatgaacgtgcacgtctaaaacacctaaaagtaacgggaaaataaaagaaatgaagaaagaaaagaataacttcccagatatctagcaaaagggaagcaatagaatacaccagctgagggacttgtaaggaacacatcatctgaggaaacgttcattgcagtaaaatgagaagatggaatgtgaataagataaaaatgcaaattatgtagaaagcatagttgcaagaacacagggtggactagagacaaaaagggcttaggaggtaaagaacaatcccctagtgcacataatctcttgttttcatctctttgccttggatcacgggccaatcatgacagcaatggtgcattttcatctttgaatccatgacacattgttggccctcaataaatttgcattaaacaaatgaaaagcaggtaaccagaagcgatctgtgcctacaagaggagctgtgtgtgccaggaattagtctagcaggagcttggtagattatacttcctggaaatatagatgcatataattttaaagatataatcatgaaatattaaaagaattgtaaaagtggcagtgaattatttagaaacagtgtccctgcatgcatgatacaatattcagatgtgtgttaaaatgtatgctccaaggaaagtcttggtatagttttatgtgcgctgcatattttcaaataatgctggaaagcagtttaaagcttttgaatttcttcatcccgttttcctgtctccttgtagagctccctttgatttcaaaggtgcttcattgctagaatgagaaataggtggtaggaaagtttaattctttgaggctaaagtttgaaacagtttttcatttacagataaaaattctacctttggacttcagcattgttcagttttccccgagataaatccgtagaagtagcctacacctgcctacaccttgtgactacatcttcagattatatatatgcaggcacagttttagaaatgggctggcaaaggaagcaagagggaacagaagataagatgctcccctcctctgtaaaagagatactgtaatcatatgattgtgtttttagccaccgaaagcaaaaaccgactgatattacctttagatgctaatgatttatttgatagaaatacatttttgctttaagcttattgatcatgctcatttataaatgtaaatttattctgtcatcaggattccaaatcatttaaaacctacaaatatttattgaatgtttcttgctaaactctgtggttggttttgggaggatgtgtaaaatccaacacttgatctccagggattttcatcacctaggaaggagagataaatacattttctttttgaatggaaaactaacatagcaaaagaaacaaaaatgctataaatattcaaagtatgagatgttagtcctatcacatcctttgttgtatgaggataaatataagtaaatataaaaacacttatatacatggcagatatcacttggtattaattctccttcagctcttggaaaaataaatcttattgaagagccctataaacaccacttctcactacacttactgcataattttagaaagaggtttaattaacatgaaatagctacactcaactggtctaaagcagctgtgtagcgtgaaagtcacacaaagccccagtctcaatgatgtattcctcttcccacctcaatcatcataatccactttctgtggtactccagtaagttcagggaggctttctttcaatactgcaagtcctcattgtcctcctcttaattctcataccttttcatttcagaattctctcttggatctttgatagtacttgtaccacctactggctcaaacatttattttagttgctctgaaagcacaggaggcgaacaagaggcaaaagtggagactttgggcatagtggccattgggtttgtggcagatttttctggcccatctcagtaaagaaaggaatcatagtgtttggggtcttaaggagaggacaaggaagatatgagccaggtatcagcatcagagagaccatatggccactgaaatctcaaactggatcatagcatactgacagtgcttacatggcccgcattccttgaattctgaaccctcaagatgatgaaacatggagaaatagctgatgtaaacttataaatacataaatcattaggcatagggtaggcctctataaaattgatagttgaattgtgactcatcacttgggattggtgggttacaaatgtgtaaagcctcaggatttgctctctgttttcaccttaatttgcttatttattaaatatgtagagagcagggatgaggaaccactagcctgggagcaggatccaattctcaagaagaagtaattgtttattatagagaagtaaagtagcagaatgaaagaggaaagaaggaaggaacagcaagagggagggatggatgttaatttgccccacttgggtcaagtctaccactctctactccatgtctataatattaatctctgtgtcataagggaaggttctgtgactggcagccacaccgtaactagttggaagagttgtccaaagcaagttagtttgctccttctgaaaaaaggagagcagttgtagaaagtttgcacaatgaaaaaagtttatatttatttgaactgttgtattagtcttcctattattaacagagactagccaggcagcaatatttaactatgtgaataataaagaccagaagtcaattttttttaaagaaaccatagctggccagaataattaaagctgcatgttttcacagtttgaggttctgttaagtcaggaattaagtcattgtcgacacaagataggtcaatctcatttagtagcatgccattgtaaattaggtgatttctcatcactccttgctgctccatgatagtacaaatgcttgtcaaaagctttaatggtcataggtaaaacactaattatgtatcccacaatagttgttacagtaaggtaattctttgtgtctctagggtaggtaaatgtttcagttatatatttgcaatgaaaactgaggacagttacagtggctcatgcctgtaatcccagcactttgggcagctgaggtgggtggatcaccaaggtcaggagttcaagaccaacctgatcaacattgtgaaaccctgtctctactaaatacaaaaaaaaaaaaatagctgggcatggtggcatgtgcctgtaatcccagctacttgggaggctgaggcaggagaatcacttgaacccaggaggcgggggttgcagtgagccaagattgcaccattgcactccagcttaggcaacaagagcaaaattccatcaaaaaaaaaaaagaaagaaagaaaatcgggtaccatcctatcttgatgaacacaaatgtgtagaacctcaggatttactctctgttttcaccttaatttgcctatttatcaaatacctgtagagcaggaatgaggaaccacttctctgggagcaggatccagttctcaagtttgattttatctaatctatagagagttggtattctgccatgaaaagtaagtctttcaaattaatgtccttaaaatgcccttcatctggtccaatcagaacagagtaggagaaaacagtgctagagacacagattctcagttagactttctgatttaaaggcccaactccaccacatgatggagtgtaacctgaatgacttagtctctctgtgtgtgtttctgttttatctgtaaaagtggtataatactaggacctacctcatatagttcttatgaggattaatttggataatatttttaaaaatgtttggaacaatgcttggcaaacgaaagcaacataagactgccccttaaatgaaaaaatgaataaataaacaaagttcctcaagttttaagtacatgtaaaaagcttttgtgagctaatattttatagctattaaaattatacaaatggtacacatttattataaaacattcaagttgaataactgaaataaattactcataatcttacaatctggtattgatagtattttagcgtatttttaaaatttttgtacatcaaattagaatcttacagtttaactgtatattctcatttgtaatggtattgtcttatgtggaattctataagcattattccatagtcttacatattttaataatatattttttaactaattccttgttgctagattatgagctttgttacatatttagataggttccaattttgtcactttttatgatgctgtaataaacattctttatgaaagtctttgcccacttttggggtgatgagagcacctggaaatgaaactgagaaaaagagaggaacatgtaaattatttgatcagtaaatctataaatattatgccaatttacatttgcagtatcattattacctctcatggtgacaatgtaaccgaattttaccaaggtcaattttccttacctaacccacgctttggaaccagctgagccttctctcctccaggtctcttcccatgacctcttttccctccctctacttgtctttagtcttctctcctttgtctctccatctctgtattttcttcttttcagtcctttttatctgattctagttgctgctaaaaaaatatatatgtctcatgaggtatgttcttcccaacactcatagactttattctaacttcagagtaatggctgtctgcccactccttcctttgtaagtaagaatctgtgacttgaagaatcacattttttcactctggcatagtacatttgctagtggtcttaataatagtgggccactagaaaagtaagttttaattgtgtttttaactgtggagaaatgataagagatgtcttcgaaaatagcaaaattattgataggatgtttctgctgcagcctacaaagttagttacttttcactggagactgagtttattacatgagcggcctgtcttaagtttcttgccatctctcaagcacattctctaatataatttattcattgaagcatacaactgtgtttctgccttagggctttattttcatctcctcacaatatacaaaattaaaccccaaagacaatagcattatatgtttcaaataattcttcaatagatatttgtaatttatatttcatgcaatataacaagatgctgtgcattgattgagagcactgtagagaatgtaaactaaactgtaaaatgtgtccagaatatatttcaactaagatggttttatcagtctaaacttaaaatgtgtttcaaaaatcctgcaataccaggattctgcatctattgtgctgattttgctcacttctgactttgtaactttttctgaaggaatcacatttttaaaaatttttaaatatgtaattaacaaaaattgaatatactcaaggagtacaatgtaatgatttgatatttgtatgtacgtttgcaaggattatcaaaatcaagttaatacattcattaccactcatgctgtacattagattcagacttgttaatctaattggaagtatacatgatttgaccaacatctccccactttcctagccccttgaaactatcattctactttctgcatctatgactttgacagttttagattccacttataagtgagattgattgtacagtatttttctttgtttatcaagcttatattcataaaatgtccctccagttcattcacgttgtcacgaatgacagaatttccttctttttatggctaatattacagtgcgtgtgaatgtgtttgtgcttgtgtgcatacatgtcacatttttgttatctatacacctgttgatggacacttatgttgtttccatatcttggctattgggaataatgttgcaaaaagcataaaaatgcagatatcccttcaacatactgatttcagtttttttagatttgtacccagaagtgtgactgctggatcatacagtagttctatttttaattttttgaggaatctccaaactggtttccataataattgtatcagtttaaattcctaccaacagaggagtataagcattcccttttctctacagcctcccaaacgttgttgtttcttgtcttttgataatagccattctaacaggtgtaatgtgattgtcttgatttgcatttctctgataattagcaatattgaacacttgttcatgtatctgctggccatttggtttttcatttgtttgttttgttttgtttttgagatggagcctcactctgtcacccaggctggagtgcagtggtgcggtgtcggctcactgcaaactcaacctctcaggttcaagcgattctctttcctcagcctccagggtagctgggattacaggcacccaccaccacatctggctgatttttttgtatttttagtagagacggggttttaccatgttggccaggctggtctcgaactcctgacctcaagtgatttgcccgcctcagcctcccatggtactaggattataggcttgagccactgcacttggtctctgctggccatttgtaagtcttctttgaaaatgtgtcttcactttttagaaattgttttgtaattgagttccttatatattctagacattaaccctttatcaggtttaaaaatattttcttccattccgtaggttgccttttcattttgttgattgtttcctttgctgtacagaagtttttagtttgatacagtcccacttgtttatttttgcttttatttcctgtgattttggtgtcttatccaaaaaatcattgccaagaccaatggcaagaagcttttcccctaagttgtttcctagttgtgttacaatttcagctcttacatttaagtctttcatacatttggagttaatttttgtatatggtataagacgagggccaatttcactcttttgcatgtggatatccagtttttcaaacccatttattgtggagacatctttttcctcattgtgtattattaatggcattatcaaagagtagttgatcagaaatgcatgggtgggtgtttttctgtgctctgtattttgtttcattggtttatgtgtctattctatgccagtaccatgctcttttgattactacagttttataacatagtttgaaattcggaagtgtggttcctctagctttcttttttttttttttttcaagattgctttggtattttcatttatttggggcttcttcaatatttaatctgtaccttatagtttttagtgtatggacctttcacctcctaggttaaatttattcctgagcattttattgtttagatgctattatcatgggaacattttcttagtttatgtagattttatatgtagatttcgtatctgcaactttactgatttagttttctagttataaaaggtaaagtctttagggttttctgtatatggtattatgtcctccacagagattatttaacttattttccaattaggatgctttctatctgttttttttttaaacccaactgctctaacttggacttccatactaggttgaatagaagtgacaagagtgtgcacctttgtcttgttcttaatcttagagaaaacgaattaagctgttcaccattaagagtaatgttagctgcaggtttgccatgtatagcctttgttatgttgaagtatattcattctacaactattttgttgagaatttttatgataaaagaacttttaattttgttaaatgctttgttgcatctattgagatgatcatatgatttttagccttcattctattaatatagtatatcacactttctgttttgcatatgttgaaccatccttgcatctcaaggataaattccagttgatcacagtgtagaccttttaaatgaactgtttagttcactttttcagtgttttgttgaggagttttacatctgtgtttattagaagtattggccagtgattttcttttcttgtagcatccttatctggctttgatatgaacgttactggccttgaaaaattacattggaagtgttcccatctcaatttttgggggggagattttgagaagaattggtgttaattgtttgttcttaaatacttcataaaattcaccagtgatgccatgtgttttaggctttctttgtttttaatgggaagttttaattactgatttaatctctttacttgttattgatctcaaatagcctatttctttatgattcaatcttggtatattgttcatgtctaggaatttatctgtttctttgaacttatctaatttgttggcatataagagttcatagtgatttcttatgatactttgtatttccgtggtatcggttgtaatgttttctttttcatttataattttatttactttgttagtctttttttctttgttagtctagctaaaggtatataaattttgtttatgttttcaaaaaaactcagtttcattgatcttttctataggcttttctttatttctagtttttatcttattatccaatctttttcccctttatcaaggaaaacttctgataaggtttagctgtgtctgcacccaaatcctatcttaaattgtagtttccataatcctcatgtgttgtgggaggaagccagtgggaggtaattcaattttgggggtggttactcccatgctgctgttctcatgatagtgactgagttctcatgagatctgatggttttacaagaggcttttttctctttgctggtcttctctctcttgctgccctgtgaagaaggatgtgttgtttccccttctgccatgattgtaagtttcttgaggcctcctcagccttgtggaactgtgaggcaattaaacctctttcctttataaatcacccagtctcaggtatgtctttattggcagcatgaaaatggactaatacagtaaattggtactgggagaatggggtgttgctgtatagatacctgaaaatgtggaagcgactttggaactgggtaacagacagagcttggaacagtttagagggctcagaagaagacaggaaaatgtgggaaagctcagaacttcctagaggcttgttgaatggctttgaccaaaatgctgacggttatatggacaataaagtccaggttgagttggtctcagatggagatgaggaactcgctgggaactagaacaaaggtgacacttgttatgctttagcaaagagactggacgcattttgcccctgccctagagatttctggaactttgaacttaaaagagatgagttagggtatctggcagaagaaatttcttttatatgtatatatatataaaaaatatatatatatatatatttatactttaagttctagggtacatgtgcacaacatgccagtttgttacatatgtatacatgtgccatgttggtgtgctgcacccattaactgctgaagaaatttctaagtggcaaagctctcaaggaagcagagcataaaagtttggaaaacttgcagccccacagtgtgatagaaaagaaaaacccgttttccagggagaaattcaggctcactacagaaatttgcataagtaacatggagccaaatgttaatcactaagacaatggggaaaatatatctagaacatgtcagagaccttcatggcagtgcctcccatcacagacccagaggcctagaagggaaatattgtttcctggactggacccagggtccccctgctctgtgcagcctcgggagatggtgccctatgtctcagctgcttcagcaccagctatggctaaaaagggccaaagtacaccttaggccatagcttcagacagtgcaaatcccaatccttggtggcttccaggtaatgttggtgcacagaaggcaagaactgaggtttgagaacctctgcctagatttcagaggatgtgtggaaatgcctggatgtctaggcagaagtttgctgcaggggtggagcagtcatgaagaaccactgccagatcagtgtggaaggaaaatgtagggtcagagcccccacacagagtccccactggggcactgcctagtggagttgtgagaagaggaccactgtcctctagaccagagaatggtggatccactgacagcttgctttgggcacctgcaacagccacagtcactcaatgccagcctatgaaagcagccaacagaagggctataccctgcaaagtcacaggggcggagctcctgaaggttgtgggagcccaactcttgcatcaatgtgacctagatgtgagacatggagtcaaaggagataactttggaattttaaggtttaatgactgccctattggatttcagagttgcatagggcctatagcccctttgttttggccaatttctctcccacttggaatgggtgtatttacccaatgcctgtacctccattgtaactagaaagtaactaacttgtttttgattttacaggcttataggtggaagggacttgccttgtctcagatgagatgttagacttggacttttgggttaatgctggaatgagttaagactttgggagactgttggaaatggatgattgtgtttcgaaatgtgaggacttgagattttggaggggtaaggagagtggaatgatatggtttggctctgtctccacccaaatgtcatcttgaattgtaattcccataatccccatgtgtcatgggagagacccggtgggaagtaattgaatcatggggatggttacctgcacactgctgttcttatggtagtgagtgagttctcatgagatctgatggttttatgaagggcattttcccctttgcttggcacttctctctccttccaccttgtgaagaaggatgtgtttacttccccttccatcataattgtaagtttcctgggtcctctcagccctgcagaactgtgagtcaattaaacctctttcttttattaattacccagtctcaggcagttctttatagcagcataagaactgactaacacaacttcttcccagaatatacccagatataaatgaaatagataataaatcaaagtcagctgtactgagtttgaatgagactgatggtctcttgagcccagagtttagtttctaacagatctggaattgaatctaggcttcttccctagccatttcttggaggtagcccctttggaagtatgactagacctttccaatcattaatctctttgtctctaaagtaagcataatatctacttttttagggctgtgttttagtattaaggaaataacctgtttagctcaatgccaatcacactgtaaatattaagttaatggaaaaaatgctaaaaataaaattgataacaataatatagagaaccttttggcatggttgtctaaataagagaatagataaaaaaagaagtgcaaactatagaccaaatgtttggatctcatattagtttagcatttggaaactggctatagaactagacaattaatattctttgctaataatctataacatttgttaaacagttcgaattacagtagaaccaccaagaattctgaaaacccagtaagttaagttgatgacatgactggctgtctggatgctacggggcatgagctttagccatactcattaactttgataccccaaagtcaccccaaagaaatacaaatacagtgtattaggtatgcaatatccgcttcaagacaaaacttacagtcatttctggtatgatcaaattgattcccctaagtccttgttataggaaaaattatgacacacccacttatcagtaagacacgaatgtaacatttcctgagatttataatagttattgagaaaaggaaaagaaaatttatgaataatagaaataattttcctttatgttttgaaaaattaactcttatttttcagttatcgaacatgtaccttcaattcttcaatttagagtttatttatgataactaactttgatatcctctgagagcatgtctagaagatggcaaatgcttttcaccatgaattagtgctgaatgcagttttaaaaatcttaccttgttaatctgttagaagatagtagcaaataacaataccacattgcttatttgttgaatagcaacaatttcaataattcagtagaagacataagttatatgacagatatatataatcataaatctaatatatttgtaatgaagacaaatattagcttatatgtatgatgtttaatcttactttagactctaaataactgtgtgatattggaaatttactgaaattcgtaatgattatattttatttctttgtaaaatatagtaatttgacttaatgatctctatgattacattattctctaaatctggtaaaggtgaaactttagaaattgtgtgtgtgtctatatatatacatgaatacatgtgaatatattcatagacacatacacatatgtacacatacacaaacatatattcacatccatatatattttttaattgggtagaatatggagtgaggaaacttattgtattcacaaattgagtacttagtaaatatttcatagatttattaaataattttactttatgatatatattagcaagttccctgtgcttccctgtgcacgttttgaagattaaatgtagtaaaggatatagagcactttttttttattatactttaagttctagggtagatgtgcacaacgtgcaggtttgttacatatgtatacatgtgccatgttggtgtgctgcacccatcaactcgtcatttacattaggtatttctcttaatgatatccctctctgctcccccaaccccacaacgggccctgatgtgcatgatgatccccgccctgtgtccaagtgttctcattgttcaattcccacctatgagtgagaacatgtggtgtttggttttctgtccttgtgatagtttgctcagaatgatagttgccagcttcatccatgtctctacaaaggactttaactcatccttttttatggctgcatagtattccatggtgtatatgtgccacgttttcttaatccagtctatcattgatagacatttgggttggttccaagtactttttatatgtctggtactcatggtatgtgctcaaagattcagagaagttatagcacttcaatgtgagtctgatagtcacagatgcatcattatgaggatagtgtgcctgggatgaagggaaaggtagagaggaggcagagaagaaatgccctgagggtccagattggaagaggattcggtggagagaacttttcatttcaagaacaagagaaaaagagtagaaggaactcagcctgaaagtattcccaatcgaggacctcaccaactgactgcccatgccgggaacagttggccatcccacagtctaagagaaactaatgggcacacactgtaaaatgtaataggagtttaatgtaaatgggtatctagactttggaacttgggcgtataccactaaagatgttaacctaaggaaagtatagagttatcagtaataacatgtcagtttgtttcttgtttggttggtttgcttttaaacagtaggatagactgcttgctatacacatgttagaagctttgtagttgctaactggcaggcagtaaagcacggtggttaaaagtcatgccctgggtcaacatactagctgcttttcttactatccatgtgatctgtggcaacttacccaacctgtctatgcttaagtttctttaattgtataaaacatgtgcaatagcacttgtctcctacagctgtttcaaggattagctgagtttacctgaggaaaatatcatagataataagttcccaataaaagctgttactttaaaatcatttaattcaggtctggagaaaaacaaacttggaaaataccaaaattgagaggggaaaggcaggatgaaaatctcacagaaaataaatggttagagttgatggacgaccaggataacacagtgtctctgatccccagatagtatagaatagaaaggaaaaccctgttacataaacagtgtcaaatactgtattagactgttctcacactgctataaagaaatacctgggccaggtgcggtgactcacccctgtaatcccagcactttgggagactgaggcaggcagatcacgtgaggccaggagttcaagaccagcctggctaacatggagaaaccctgcttctactaaaaaaacaaaaaattagccaggttggtggcacatgcctgtaatcccagctactcaggaggctgaggcaggagaattgcttgaacccgggaggcggaagttgcagtgagccgagatcgtgccactgcactccagcttgggcaacatgagcgaaactccatcaaaaaaaaaaaaaatctgaaactgggtaatttatataaaataaaaagaggttttattggccatggttctgtaggctgtacagaaagcatgatgctggcatctgctcagcttccaaagaggcttcaggacacttacaatcatggaagaagacaaagagggagctgacacgtcttatttggcaggaacaagagcaagaggaagggcagggagatgctactcacttttaaacaaccagatctcgtgagaactccctcatcatgatgagaacagcaccaagaggatggtgctaaaccattaatgaaaaaccacccccatgatccaatcacctctcaccaggcttcacctccaacattgcggattacaagtcgacatgagatttggtgggacaaagattaaaaccatatcaaatactaaaatttaaagattaaaaactgaaatcagaaaaaataagccaactagaaatttgttaaaaaaagaatataagatattgattgaaaagtaagttattattctgtgtcacttccatataaaacattttttaattggcatgaatatttagagttaaataaatactagtagtgtggttaagggtttctgtactttatatttttcctcatttgtttatagtgttttttctcaaattttctttcttttctattaactttaaagattctattgattcttgtaccaatagagagttttaataggtttatgaattggcaagttctctactaatggatggtgagaatgattcatctttaaccccaaattcaaataatatcaagagactgttaaaatggtgcatgacgattttagcctttgtttcagtattaaactagtggcacttcattaatttttaacgggattcaatttgcctgttaagtagtttatagaatcatcttacttttggtttcctaagaaggccaaagtattttgcatactcctttctgtttagcatattttttccatgtctctccatgaaataaaaccacatttgacaataacttaagattggtattgtcaagtgtttgcaacctttaggggtcttttgttttaaatacctccatggaaaaagaaagcacacgatgcggaatcggactcatcagaactcaaactgatttctgttactagctctctgtggcctgggcaagtcacctaaactctggaagattttgtttttagcatgtgtaaaataggaaatttgataaatgtaacatttaagtgtattatgacatgtgaccactaaatgaaaacttttgttacaagtattttatgggaataatgactaaggattagcattcttgatatttaaaaagctcacaaattggataagaaaaacgatatcacaaaagctaaaaagagattattcagttaataattttattattagtgtatgtatgtaaaatatttaacatcactacttaacatttaaaaagtaaaaaccacagtgatattcattaaggtaggtaaatttttaaataatgataaatataatacaaaaaatgtggagttttattctataccaatcctgaatcatattatttataattttacctacttttaatcaatgtatattcagattcatattctgctttttaaaaataatttgaaaataatacatattatttatatcagctataaagtattctatatgatcattctatctcaagttacccaactttcccttactgatgaaaatttaaaagtttccagttgtagttgattatgaatagtggtagatggaagcaatgaacatattggtgcacattatttcctcatttaagggaagtgatgacaatggtagttatttctatagtaatgcagattccatgactgggaaattggagtttgtgaatcaaagacattattctatttttacttgaaaagagtgtgttgccacattatctcacaaaatgatacagtgaccacttcctccatctagaaaacttttctccttggctaccacaatgccacacactctcacagttttctttctctctcacttggcattccttttctttttcctctaaatagttattagacattggcacgtcccatcaagtcttggacagcacttctttcactagatcatcccatctaatctcatctttcaataccattcagctactgatgactcctaaatttatgtcttaatttcatcttcctgagacccaaactcatctttaaaaccgatatgggaacttgacacctcaagttaagactaaaacacagctcctaattttcatccccaaatctctttctctaatcgtttttttccgtttcaggaattgctactaactcacttcaagtttctcaactcagaatgtctagaagtcagccttgattccttcttttcacttgccatagtcgccaggagctctcaccctgaaatacaggctgtcaggatgttctgagaatactctcatatatccacttcttgatacatccacctcaggccaactcactcactatttttacttttccctgttattgttggaatatccatacaacttattcttgatgtagcagttatagtggtattttcttcaccaaataaaacaatgtttacattgtaatttgatcagaagatgctaaatagatatttcgagcagtgctcattgaggtatgtagagcatctcatgctttctgaattaaaagaacatgtacagtgtacataatatttggtcagggaccctaagactggtgagttttatgttttttcagagtggtaaattagttaatgcaaagcaggtgttcatttatagcttcaagtaggaaaattcactgtcctataaaaataaattttataagcactgtagctatcacaaagttaatattatgttttgaggaattaataaaaaaattatatagttagcaattgaatatttaatctcttgttcctgtagtatatataagtaaatataaaggaaaatggaaaaaatagacaaaacatacagacttttaaaacctcagacatttgtcagtttccatgtagttgagcggttttgagtgagtttcttagtcctgagttctagtttgattgcactgtggtctgagagacagtttgttataatttctgttcttttacatttgctgaggagtgctttacttccaactatgtggtcaattttggagtaggtgtggtgtggtgctgaaaagaatgtatattctgttgatttggggtggagagttctgtagatgtctattaggtctgcttggtgcagagctgagttcaattcctgggtatccttgttaactttgtgtctcgctgatctgtctaatgttgacagtggggtgttaaagtctcccattattattgtgtgggagtctcagtctctgtaggtcactaaggacttcctttatgaatctgggtgctcctgtattgggtgcatatatatttagaatagttagctcttcttgttgaattgatccctttaccattatgtaatggccttctttgtctcttttgatctttgttggtttaaagtctgttttatcagagactaggattgcaacccctgccttttcttgttttccatttgcttggtagatcttcctccatccctttattttgagcctatgtgtgtgtctgcacgtgagatgggtttcctgaatacagcacactgatgggtcttgactctttatccaatttgccagtctgtgtcttttaattggagcatttaccccatttacatttaaagttaatattgttatgtgtgaatttggtcctgtcattatgatgttagctggttattttgctcgttagttgatgcagtttcttcctagccttgatggtctttacattttggcatgtttttgcagtggctggtaccagttgttcctttctatgcttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatgttggagcttctgcacagcaaaagaaactaccatcagagtgaacaggcaacctacgaaatgggagaaaatgttcgcaacctactcatctgacaaagggctaatatccagaatctacaatgaactccaacaaatttacaagaaaaaaacaaacaaccccatcaaaaagtgggcgaaggatgtgaacagacacttctcaaaagaagacatttaggcagccaaaaaacacatgaaaaaatgctcatcatcactggccatcagagaaatgcaaatcaaaaccacaatgagataccatctcacaccagttagaatggcaatcattaaaaagtcaggaaaaaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcggcactattcacagtagcaaagacttggaaccaacccaaatgtccagcaacgatagactggattaagaaaatgtggcacatatacactatggaatactatgcagccataaaaatgatgagttcatgtcctttgtagggacatggatgaaactggaaaccatcattctcagcaaactatcgcaaggacaaaaaacccaacaccacatgttctcactcatatgtgggaattgaacaatgagatcacatggacacaggaaggggaacatcacactctggggcctgttgtggcgtgggggcaggggggagtgatagcattaggagatatacctaatgctaaatgacgagttaatgggtgcagcacaccaacatggcacatgtatacatatgtaacaaacctgcacattgttcacatgtaccttcaaacttaaagtgtaataataatacaaaaatttaaaaaaaaaaaactcagacatttgtcccaccttcccctgtttttaataatgctcgttgttttgttcctacagtgtctgagtattaagtattttctaatgagaccttttgtgaattagatggttaacgaaagagtgaaaacattacttatcaaaatactaataaatatttaaatataaatatacttattcttaagcatatttatatataaatattcttaagtatacacttaaatatatatacttaagtatatatatttaagtgtatacttaagaatatttataaatatactcattcttcagcatatttaaatataaatatactcattcttcagcatatttaaatataaatatactcgttcttcagcatatttaaatgtaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagcatatttacatggaaatatactcattcttcagtatatttaaatatgagtatactcattcttcagtatatttaaatgtaaatatactcattcttcagtataattacatgtaaatatactcattcttcagtataattacatgtaaatatactcattcttcagtatatttccatgtaaatatactcattcttcagtatatttccatgtaaatatactcattcttcagtatatttccatgtaaatatactcattcttcagtatatttccatggaaatatactcattcttcagtatatttacatggaaatatactcattcttcagtatatttacatggaaatatactcattcttcagtatatttacatggaaatatactcattcttcagtatatttacatggaaatataccattcttcagtatatttacatggaaatatactcattcttcagtatatttacatggaaatatactcattcttcagtatatttaaatatgagtatactcattcttcagtatatttaaatatgagtatactcattcttcagtatatttaaatagttgagtcagtattatatcttctaattaggtttctaataataatttcaaaaactatgacatgttttcttcccatttttttatggctgaatcaaaatgttgagatttataacttggaccccgtattctataatgtcacacagacatatatttttttaaattttaccttaagttctgggatacatgtgcagaacatgcaggtttattacataggtacatgtgccatggtggtttgctgcaccaattaatatgtcatctgggttttaagccccacatgcattaggtatttctcctaatgctctccctcccccagccctccaacccctgacaggccctggtgtgtgatgttccccttcctgtgtccatctgttctcatttttcagctcccacttatgagtgagaacatgtggtgtttggttttctgttcctgtgttagtttgctgagagtgatggtttctggctttatccatgtccctgcaaaggacatgaactcattcttttttatggctgcatagtattccaaaaatgtatatgtgacacattttctttattcagtctatcattgatgggcatttgggttggatccaagtctttgctatcataaatagtgttgtaacaaacatatgtgtgcatgtgtctttacagtagaatgatttataatcctttgggtttatacctagtaatgggattgttgggtcaaatggtatttctggttctgcatccttgaggaatcgccacactgtgttccacaatggttgaactaattttcactcctaccaacagtgtgaaaacattcctatttctccacatccccttcagtatctgttgtttcctgactttttaatgattgccattctaactggtgtgagatgagatctcactgtggttttgattttcatttctctaatgaccagcgatcatgagctttttttcatatgacaaaaatatcttataactaggtttgattctagtccagtatgctttttgttataatatgttacttaaagctcagacaggaaatgcaattctattttggggaattaaaattagtgatgtggtggtcataaagatgtgggaaaacttttaggatagtagaagctattgtccttattaaggtgtacaaagaattttggacctgttttttttttttttatttgattttcaattattttctctacattgtcattttagcccattgctatgtcaaccagtttcagcttgccctatgggggaaaaaagcctattaaagaaattctttacatgaagaattgatatctctgtgtttatgaatgtaacactttcagaagattgcactgaaagcaactatatttacaaggcttatctgtcctgtgtgtgtgtgtgtacttatcctaatgttgttaatgttgtttctcattcagagccttgtgaagtgggactgctacacacattttaagttaatatcaaaacacacccacaatgcttttggtgaaattgtttcatgttgccaagtatacatatgccaaaaatctcccctctttatcaaaacagatacgatagttacagtagttagtcattgaagtagctggatatgtgtgccattcaccttcataggaatcagagggattgtaagaatgaacttgagaactgcattcttgccatccaggaactagggttaggattggaataagtaatgtgtgtagcaagtgccagccaaagagaagggaatcactcactatgcatgagtcctggggaagatcagagcactcataaaaggcatttgagttagatcttaaagaatttgtttactatatttaaccatattgatcttgagaacaattcctttgtatttcttcctcaaaaatgaactaaagcagataaagtctttataacctatgttttcaagtatatgaaattactatatcatagtctgagaccaagtgtacaaatatgaaaagtggagatacaaagcaattttccacttactgcaagtcagagcaatatctgtctcaattgtcatgagattttacttgaacatgacctcatctttttgtcctttcatgtgtggtcgacctagcttcaaaatcattgtatagacagtacattttccttatattgttgcacagatcactggcaattttgcatcattgaatgcaacattgtatatcaaaaattggcatatataaattatatcactgcacacagggcagacaaatttgtacacattgttttgcatctatttgtatataccattgacattattgcctgtttaataatagattttgttaatgcacagataataagtacatttcttttttgctattctgcatttttttccagtgatgtcttttagagctgagcctctgccccagaaaataatgaagcttcagtaagagtccctgaggcagatggcatggagatgttatttgcatccctaattatttggttaataaacaataaactatatttagttactagttagaagattttcattttgtaaatgtacctctgacccttttctttcttaagtgaatgaaacagtaataaataactaaagctgttttttgcacaaaatgctagatagagactaggatttgagaatctatttttaaattcacttattgttacccacttagctaaaagccactatgtgagttaaaggaatatcctgctgtaaacagttccatttaaattcttaacatttctactttgaattgtggatcctctcagccagcttcccgggtccctttgaagcaggcctgtgccaagattccccacctctcatggggaactaagcaagtccattcttattcccagctcatcagaataccctgtccactcactctgctgacccacataagctgattgctccctgatgtgtggagaagtgattgtgataatgttcacaggaggggatgtgctaatgcatgagtgataactggagcccggtaaaacttactgagacagaattctaagcagaattccacactcctttcctagtgtggtccactctgagtgctagagttttaatacaatccaaggatttctccaagataattgttaatgacttaattttatgaggattttatttatgtaaacaatcaaataatttttaagaatgaatgaatatatgtatatatatatatatatatatagagagagagagagagagagagacttgagtaagaatatctgcataaaataaattaagccaagaataaaatctagaataaatacagtaactgctctggagaagtctaattctgctctactggagatacaatgagaaccactaacatgattaaggagatttttttcaattacaattcaatttgccttacataatctctgtcgttcttatatgtatgcagctggacccaagaattttccctcctgtttcagggatgttatttccaggatataattaattaatatattcattttttactttattcttatattcattttgtagatattgagtgcctattatgtccagagaaccatgctaggcagtggttattaaataatgaatacaaataatttcttgacttaaaaacaatgggcaatcctaagagtttacttagtacttgttcagggtttgctacaaattccatgatttaactgattttcttattgatatccattctttgatcttccctctaatagaggggcaatttggtaacctatatcactattgtatgtttgagctttgaagcattttgtagtctatatacttactttctgcatcttcaccgagtaatattccttgtgatctgcgtggacaagaatgtttttacttttttttttttttatatcagagagaataacatcttgagaatgatgacattttctggacaattccagtgaatgggcacttagctagggaagccaagaaattatgcctaattaactatgctatttccaaaattctgcagacttttactaagaatgcatgccagggatgaaaaaatacaaagtaaagcagtagatttgcacccagaaaactgacataacttttcctttctttgcaacattgatatttgccttcaactgatgaaggcttcgatcttgatttcaattagaaatgcagtgaacaaagagattctagggaatacatacaacatgaagctcctcagtcttccttacaggggagaactacacagcagcttccaaatagttgcaaagacgaacatgacttcagtgactttgactagattatattatttttattgcctttatttttcacacataagacttcatttctgtgaataaaatatatgacatatctggttttccatatggtaaaatctttaaagattttttgtacattctctaaatgaataaattggattctcaagtataaaaacatcataaaaattgcttataaaatattctaaaagaaaccctgagtagctggcatatagacgtgctctacaaatatttgctgaatgaatgaaccaggagaggtatttatagtaaataaggaaatgaccagactcattaacaataaaaattatatacagtcaagtgttacttagctgaaataacatggtgtaaataaatggtgtaaataatatgccccctatattaataaaacagatgaagcaaaactgaaaataagccaataagaaataaaatccacttgatagttttgctaatgattgtaacataatagcttgcattttaacttacattttaaataaagaacgcagtccaatctctcaaattatggaagtttttcttctaaaataattctgataactagctttcatttgaatatctccagtagtgaagagctcattacttttatgggaatccattctattgttggtaatagttatcctaatgctttaaaaatattacattgacatctgactacctgcatgttccttttagaaaaagtttaatttagaaaaagaaaaatactactacctgagataacacacaaaggtgtattttctcttggccacagtattttcaggacattaaaaaaataagattatacatcatttatactgtttagtaagtgagctttcaaattacaggtcatgtaagtgttcaagatgttctaatcagacctaattgtcactattttacattaaacttgtatacatgtctaatgtaaaacaatgtgtttaaaataatgtaaaataagggtatgtttgtttttacactctggctcaggctagcctctgtgtatatcactgtggcttctgtgtggagcaagaacttaatcaaatttggatttgcattcacattagtttcaccactatctaggctttacgtagttgtaagcaactgtttagcttttgggtctggctttcatttttcttgtctcttataatcttagggtaatatttgacattttaaaaacaaattaacatccttaaatcaaagatcttaaaatataattgttgtgaaattccctgaaaataatttacatattttttaaatacatgaaactaaatgacttgctgtaagtctgtttctcacaactgacactctgcttttcctgtgaagaaatacataaacagaagcctcagctagacagattttcttttgtttgcctaattgccagaaggttaatgattttcataatgccatttatgtctggatattatcagcactgtaaaaaaaaaagttctaataacttttgttagtgtagtctgcagaaccattgaaggaacaaacatattgtataaggaaactttttgttttctcagcaaagtgtttcaaatatgttaaaatcagctcaatattcagtattattatttggttaaattccagaatggaaagaacttgtagtaaaatgattaggctatgaacagacaaatgcaactgacaatgttaagtcgaaaagtattttttttttacttaattgaagcaaaatattaattttaaaaatatgagttagagctgaataatctgtagacataaaagcacgtatacttttagaatgtgtgatgttattgttgcatcactggaaaaccttacgtgtttattcttttgaagagtggaagatggaatttaatttactctttaactttctgttataaagcttaaccgtctttagtctcttcagagcaatgttacgagattgagtttccacatcattctggttattcttcttgaacacccttagttttaaaattatctttcttaaaagattgatctcataagattgaataccttgtcctatgttttatagcttataatttttcttttgtggactacctgttaaagtcttttacccattttttattaggtttactgattgtttcttattgatttgtggggcttgtttatacattaacaaaaatgaatatttttgttataggtttagaaatatcttctcccaatctatagttagccgtttaactctctgattcctgccttttgataatcgatgtctaattttactataatcgaatttatattttcctgtttagctagtacattttgagtcctgtttaaaaaatctttcccaaccacaaaaagatgctgtatgttctcttccagaaacttttacaatttgatctacacgttttgaccttgatttttgagtatggtgtggggcagaatcacttctagaacaatttattgtgggggaaaaggacggtgatttttgaaaaaggaaacaagaagagcttgtggattgctggcaatgatttctttatagatctgggtggctgttacactgttatgttcattgtgtgataattcctgatactagctatttatatgtttgtaatttgttcatttatatatatatatgtaaagactttataaaaatgcatgaaaaacatatctaataatacattgtaaatataatattctacttagatgtcataattttaaccctgtatattatttcataaagtaaggttacataattctttctaagcattagatacctttaatcatgaaattgataatgcgtttcttcaaaatgagtagctttgtttattgttgatgttaaaacaaactgtactggtataggttcaggtttccagccagtgaaaaacatttacatcattattcagtttgttatcctattaggtttcttttccaggtttatataattggcaaatttcataagcatgtctttcatgccttagagaataaaaatattaaaaatgacagtatacaggatgaaagcctgtggaacatcattagagagcgctcttcaagctgacatcaccattaatcaacgtatttggggcacgataactagccattttttaatctacctaaaactgttatctcccagcccacattttactagtttacatttgccagatattttgtcaaatgctttgcaataattaaaattgaagatacatctatggaatttatgctgttctattaaacaaggactcaattttataaaaggaaatccttataacctaccactattgcctcctctatcaccagaccccattcatctttttcctaaatatttacaactcacatgctagactttaaagaggatctctcttgttatttttcccagatgtaccaacttcactgtttttaaaatttatggtttttatggtttttagtttttgactatctttctttttttggcagctcctttaataaatattcaagaaagctaagattacatttatggataatgccagtccttggggttataatctgaattcgaatgcttcaaaaagttaaaggaacaggccaggcgtggtggctcagcctgtaatctctgcactttgggaagccgaggtgggcggatcatgaggtcgagagatcgagaccagcttagtcaacatggtgaaaccgtgtctctactaaaaatacaaaaattaactgggcatggtggcatgtgcctgtaatcccagctacttgggaggctgaggcaggagaatcgcttgaacccaggaggcggaggttgcagtgagccaggatctcgccactgcactccagcctggcgacagagcaagacgccaaaaaaaaaaaaaaaaaaaaaaaaaaaaagttaaagccactttgtctgtcttattatgtcttagcttgtctgaggaggtatttgtctatactcagttagtagttttgctacttctagaattatttgaaactgttgtctttgttggtagaaatgggtgacaaacagtactattttcctgtcattaaataatatctgatagtattatatcttctttcttctgttttgcttaaaaaatagctttcaagctcttttgtttgaaccttatttatataagtattaatttatcgatattttaggaatgattgggccactgccaattttcctactctagtttataacagatgttgattaatggatatagccctcttccctggctactctaatcaacaaatatctgcacttggttgaagcctgtttatccacttctcatagatcacatgacctccttgcagatgtttatcccccactgcaaataaaatctgagctcattaacgagttcattttagcacttattaagatgcctgttactgtttttgtatcaattagataattctccattataggcttaaactcatgttacatattattttcaatgttcagaaggtcttaaaattcatggtgtcatgtcttttttagttttgaataaaaattagtttttcaaatgtttatattctgtgcattggtcttagtctagaacttctcttagacttaccctagaaacttccaatttatccccaatatcttttaactactgcaaattttaacaggtttactgatgtataattgatatacattaacatatatatttatataaagtataatttatatatagtggtaaattttatatatgtacatattaatatatatcaatatacattatactatgtttagatatttaatctaatatattaatattaacttcaatatatttattatatattatattttatatattataaatttatatgaatatatacactgtataatttataaatatgtacgtgtgtgtgtatatatatatatgtcaacatggaaatattaccttttagctcactaattatttcttttcaggctggagtacagtggtgcaatctcagctcactgcaacctctgcctcctgggttcaagcgattctcctgcctcagcctccctactagctgggattacgggcacccgccaccacgcctggcaaatttttgtatatttttttagtagagatggggttgcaccatgttaggctgatctcgaactcttgacctcaagtgatccacccgcctcggcctcccaaactgctgggattacaggtgtgagctaccatgcccagcttagctcactaattatttcttagattatatataattggtagcctttcctcagatgagtttattttcctatcaaccaacttttgcatttctaaaactacttcatagtttcttttagtatccatctataaatgttttatttttccctgttgtaactgataattactgctatttttaatgaatagcattacctattttatatttttgagaggataaagcctatttatctccactagccctcaattgctattacttatggaactaattggtgttgaacttttgactttgttgacttcgtggcattggatttcattcctgtcatttgaaattttcatttgcatgttcttcttgacagccagtctctctctttctggtctctctttctctttcttctctcttcctatctcctctcatctcccctgttttttgtgctttatcattttgggactttctctactcaagtcccagaatgtccagtctgaaagtgtaccttacattactcgcccgatgcctgtgcctggcagtgtttttagggaatcatgtgtctagtcaccaagccagtgaatgcctttactcagctcagatatgcctatttgctaacctctttgggcatacagcctcatataatccatatgtttaagtgagtaatcagctttcttcagtctcttttcacaaccaggttagccgagggccagtctcggtttgcaaccttaaagcaagctttctgtagctgatacacacagggaacttacattaccaatattccgtagtagtcaaatgcccaaatgcctttgtatgtccccagatccggactctgtctggcctcggcttcagccccactcattgctttgcatgtttgttgcatttcttgtgcatagagatgtttatcttattttttgatcctggctatgtcttttcaattttcttcttatctatcttatctaaaaatacagtgtatttgaagcagaagggggtctcaaagcctgaactcataatgcaattttgcctggagtctccttttcaatttatttttttcagctgatacttatttctcagccagttattaaaggtagttctaaccctaattgaatttttttttcaccttgtatttttgctaaattagaatccaggcatatagtctctggtggtgttaaaaccaccaacttgagtgccgcgtttcttcaggagccatttatcactacaacagaaactccatggcctctctaaaccacccactaaattcctcttttgtctgacttactgaattacaaattacaaagcaaaaataactcatattagtccagagtactagtttcttcaattattcagattctctattgtaatggatcactctaggagcccacatagaatggacacgtagaatacaaacactgtatatctttacagcatacgtgtgctcacaccatatactacacacacgcaaatacacagggggaggaatatctgtgtatgtgtgagaataaagagaagagtgaggaaggaaagacagatggaggatgggaggggtgggaaagggaagagagagcacagaagaagagagagaaggggaatgaagaaacagcattcttattgtttcgagactagcaagagttccataacaagtatacatctttcaagttacttcaacaatacactagttatttgctagatgttttaggcactattatctctaggcaagtgttcttcttaggaactaagagtttatgactgttcagcatctccacttcttctaactcctctttgacgtccaaccactttctttgagctgctacaatacattgggaacttttttgccctcttatataccacattccagaggtggttgtgatgaaagaggtatcattattaatcctcggatcaatagaggttacacatttcacaagccaagtaaacaaagtaataaacttccccgaattgcattgcttgatagaccaaagagaaaaagggaacttttcatcgatctttccaccatgttcctcatgaaagactgacttttgccctccccttgaggttaatcactacagtattctctccacatatatttctgctaagaaatacattttgacttatatttcttctgattttagatttttgctttccttaaagttaacaataaattctattttgctaaaagtaatgagataaatgggattaagcagctgtatgttagttgcttgcttgctgaaagactggaatgcagcaaacaataagtaactgaagaaaatttattctggagcattcattagcaaaacagaggaaatagtctaagtttcaccaatcaatcagacattttctcacctgttacctcattgtattaattgctcgttgacttgagttcactcaatcactctgttgcttttggtaatacatagaactctgtatgaaattggctataaaatttcttcaaggtttcgaactgtatatctaacaggtaagaaaatatatttgttaccccacaataactgagtatattgttgtccccaaaattaacctacagctctttcaaaattttatggaattctaggtaaaataggaagatgaatgatatatgacaataaggaatattatatattaacactacaataggaaaaaaataacatataaaaaacacactacaaagcaggtataagtaactcattgttagtaaacagattatcaggaagtggtcccaagaggtactgcagactagaatctccaggatacacatcctgagatgaaaaatagcatctaggaagttaattaggagtgttttggggatgaaaacctgtggaagagaaaggaatgaaacagaaattagttacagggaggagtttaggtgaaatgcagtttcaatgaagtctttgaccaatccctgcagggagctctgagactgtgaagacacctcagagtttctacaggttggggcagggtactggctttttatagccccaggttgaccagtcgttgcagttgcacaaccccatgaaggtataccatctacatgtgcctctttttaacccaggaaattcctgaagaggaattacagctaagtactgtatcatagaaaaaatattcttgtaaaagtgtgaattatatgataatagaaactgagaagtagttacatcgtttgcacatatattccatagatagcacccatataacctatgcaaacacatacactagatacttaaatttttccaaatgttttgtgagatatgatttcgatatagtgaaaggtacagattttaaatttgtatttttttttaagagattaatcttgggcagggatcaacaaacttcaaccctctgtccagctacaagcttttgttaataacacttcattataacatggccatactcttttgtgtatgtactgctcttcatactataatagaatttggcagttttaacagaggtagtatggtctacaaagccaaaaatacatagtatttaaccttttacagaaaatgtttgctgacccttgatctagggtttgctattttcaagtaataccacctcatatgtaaagttaagaccacagcataacatatttcctgtccagactcctatcctttgtactattgtagttgcatatctgacttccacatttattataaaccctgttattcatcattactgtttgtaagcactaaattatcttttaatgaaatttaaaaacatgaacaaatattttatatgtacttaacatgtttagcattttaagcactcatttcgtcatgtaaatatgagtttcaaaatggtaaacttcccttaaggtgaaaaacttatatttttatagtatacacataaaagtgatgaattctcccagcttttgtcttgaatattacgttatttttatatttaaaatatatttttgctggacatagaatttcaggttgccagctttttttttatctttccttttcatcatgtctgttaggttgtttcattgtcatttggcttgcattatttctgctgagaagttgtaaccctctgaatacctttaagattttctctttagcatcgtctttcagcaaataattataatgtgccttattgtattttcccttgtatatctcctgcctggaattcaataaacttctcacatatctgagtttatatatttcaaccattatttcttcaaacatattttattctgacccaatctctgtcatctctgcttgtagtactccacttgcatgattgttagggcagttatcaatgtctcacaacttactggaataactgtttattttttaagccttgtttttcctctctgagcttaatttagatgccttatatggccctacattctagtacaatgatgttttcttctgtgtctcatctgctgttaagcccatccattaaattttctatttcagatgtaattcttactcctaaaatttccattttgttctcgtttgttgcttttctccttcaacattttgcatttttaaaaaatgtttatatgttttattttagataatagaattaataattactgtttttaaagtcctggtctgctaatttcatcatttctgttattttggggatacatttccattgatttttttctctctggttctaagacatattttcctgcttgtccaaatgtctagtatatttttcagttgatatacttgacattatggatgcaatgttgttcagtttctaaatgtttatgactttccttaatggagtgtcaagttttgttccatcaaaaaattaatttttggtcagatttatctttttcagtaacctttgctcaggtgtgtccagactagccctcatattaggactaaaatatccctacatataatgcatgacttttatgggatgtctactgaatgcctggagggattcaacaaggtctctcaattttgtctagtctgaaatcaaatttttcccagctctgtgcaacctctggttattgttgacttcagaactccctttacctggtcttgtgcagtcttgatctaaaagtgcacagcatggtgtttcttctgagtccagattgcagagacacattcatgactcccttgtagatttctaaagcactttacacagctgtgccctctctgggactctgtcctgttaattccagcttctttagtagctttgaattgtaatatgtttccgtttcaatgacactactgcactgctgaactctgtttgggatcatcttccatatgccatgatccagaaagtgaagctagcagaaagccaggaagttggcagggctcaccttatttgtttatcttattttatggatcacgtactgcactgcccattgtccagtccctaaaacagtgattttttaaaattttattttattttattttttgagatggagtcccactctgtcactcaaactggagtgcaatggcaccatcttggctcactgcaacctctgcctcccaggttcaagcaattctcctgcctcagccttcccagtagctgggattacaggcacctgccaccacgcctggctaatttttgtatttttagaggaaatggggtttcagcatgttggccaggctgatctccaactactgacctcaggtgatccacctgccttggtctcccaaagtgctgggattacaggcgtgagccactgagcccagtcagttattttatatattttttagttttgtaattttaaaaaaagctattctatcatagttttaagcaaaaataggccatgtaaccattattatttgaatatctgtgatgatttatgaaatgattattatgaacgtcctcatagaataaattattttgccagcctttaaattccttatttaaaaaatagtacacacgttttgatatactgtacattggataatctattgaatatttttatatcattctctttagtagctgaactcactgtaaaaattatagtgcctcttagcactaacattatgccatattttctgtaacttattttgtgtacaaccctagttattttaaatattactgtaaattaagaatattgatctatatgagtgccatttttctaacaaatgtttttacattcttactatttgctgagcaattcttatattttgccaaaagagatttaactttgtttagtatctaatttttctagaaatatgacttacaagaggtattgactgtatatcttctaagtgttaaataaacattcttcctgatttcctatatacttccctgtacctctcagtggtacaggaaattaatgtaagattaggttcattttaagaattgcaaatatttttctactttacttcacaagaaaaatatattttagaattgtgtataattgcttgtttttaatttataatttattaaatgataaagtttacatgacagaaaaaattggatagttacatacatttttctcatgattttagctgaagagtttatggtaaattggtcaaccctcagccaattagactttgacatgtactaataagatctaattgaggaattatgaagacatttgctcaggagaaaatgagcacataattacaccataaagaggttaaagaatcaatgttaccagctggaagaatattagttgaagtcccaatggcatctataaaggatatttcataatatatctgtgaaatagagcactgccaagaccaattaagatatgtagaatattccattgtcagttgtacaagttcaaatttaaatattcattttcccatcttacctctgcccatcttcaggtgctgggggatggtctccatcagacagcgaccattatcaatggcttcaggttgactttggcaatcggaagcagatcagtgccattgcaacccaaggaaggtatagcagctcagattgggtgacccaataccggatgctctacagcgacacagggagaaactggaaaccctatcatcaagatgggaatatctgggtaagtcattggcaggaaagcaaagacacagaattggattggaaatattagaaaatggtacaggatttactaagcatatatagttatcaatatttatgtattcaaatcattgggaaactatttattcatcattgttgatggaagaaagtttcttcaggctgtaatttctatccaatggttaaagcaatgattctagatctggactatgaatttgaatcacctgaggaagttttaaagcacgtagatgaaaggcaaacccggatcaataagaccagaatcacgtaagttgaaatagtgattaatgatactgataacttttctgaagacagcgatcttcaattgaaggaaaatattgaaattatgaagaatataatttagagaagtaagagcagtgatagatgttaagaaaagaacttgtccattttataatagtgtcttaaacacttattacagatctatgttcactttattcctttattatgaaagaagagaataaagcttaacccatttgttcttaaaatgtctctattaacttaaaaagttgtatatattcaatcaaatattcaccacataataatttgaataaattatttaacagtaaaatttaagtgttctactttgtttaattattttaaaaagcaggcatgaccaaaatcaagtgctgtcatcaatattaaaccagaagaagaagaagaaaaagaagatgaggaggaggaaagggagaggatgaaagggaagggggaaaagaaggaagaggaaagggttcacttttaaaatcatgtccttcacagtattagttggagtgctggatatttttaactttatcatgaatcactcttgtagactttgtattttaaaagtccccaattattttttctaagtaacaagagtttataatttctagctaaagtggatgttcatttctacagcagtatgtgaaataaggatataatgtcctgataataaaaaatgtgtctacttaagtagaactttagaaataactcctttcaagtcataattatatggaaagaatatttgtgtattaggatgtataagttacggaaagcaagtagtgggaaaaatgcctctttctaaaatgtcttcatctcgcaattgagataattcaaatcctcaggcataatttatagaaaagtgcttatcaagcctgaatacacagtagaattagctagagaactttaaaacatatagacccttgtgtcccaaccccagagacttgaatttagttggtctaaggtgcagcctgggctttgggattttaaagctccgatggtgatgctaatgtacagtgaacaccgaatacatagtttagattggttttcagtctacagttaagaaggggatagaggaagtatatgctgaaaatgaagaggagaacagaaaatttgaaagagttgcccttaaaatttggcagagagagagaggggaagacggaggagtaagggggttgggtggggggaaggggagggagaaatcaagtggccaaccaaccaaacagcagaccaaacaactgagagtaaacagtgaaggcttggatcacagacccttctaacacccagagcactcattattttctaactttctatggtttctaaactaagatcaaatgagcatgttggtaaaattgcttgaggggtttactttctgtgatttctaaactaagatcaaattagcatgttggtaaaattacttgaggggttacaagtcagactctgaaatactgttctctatatcagaacagaaatactgttcacatttttgtatttgtaaagtcttcatctcaaaattaagagtgttcaaatctcctctcctctcataatgtgccaagatagtaataaagatagctgctaaaatacttgaactttaatgtatctgtcaaatactgaacagttaaggacggctaaatgcagagacataaggaaaaaaggctaaggaggataaaattgttcagcttgtcttggagtcttttttttttttgagacggaattttgctcttgttgcccaggctggaatgcagtggtgtgatcttggctcactgcaacctccgcctcctggattcaagccattctcctgcctcagcctcccgagtagctgggattgcaggcatccaccaccatgcctggctaatttttttttgtatttttagtagagacagggtttcaccaggttggtcagtctgctcttgaattcctgacctcaggtgatctacttgccttggcctctcaaagtgctgggattccaggcgtgagccactgcacctggccttggactcttgatattacatagaataataatggttgagtcggggagacaaggatgtcatgtagtgaaaacatcacaaattatgaagatatgctgggtctacttatagggctctccatcttaaggtgataaaggtgcatttctattgtcttctccctttctggtgttcactttgtttcttcctttcaaatattgtgtttcttattaaaaatcagtatgctacgtgatgagtgattattagtagtgagctcattataaaattttaaaaatcaaaacaagttggagactatgttagtctgttcttgcactgctgttaagaaatacctgagactgggtaatttacgaagaaaagagttttgattgactcacgtttccacaggctgtataggaagcatggctttggaggcctcaagaaacttactatcatggcagaaggcaaaggggaggcaggcatgtcttacatgccgggagcaggaggaagaaagagacgggggtgtcacatacttttttattttttctgagacggagtctcgctctttcgcccaggctggagtgcagtgacgcgatctcggctcactgcaagctccgcctcccggtttcacgccattctcctgcctcagcctcccaagtagctgggaccacaggcgcccgccaccacgcccggctaattttttgtatttttagtagagacggggtttcaccgagttagccaggatggtctccatctcctgaccttgtgatctgcctgcctcggcctcccaaagtgctgggattacaggcacgagccaccacgcccggcctgtcccacactttttttttttttttttttttttttttttgagacggagtctcgctctgtcgcccaggccggactgcggactgcagtggcgcaatctcggctcactgcaagctccgcttcccaggttcacgccattctcctgcctcagcctccccagtagctgggactacaggcgcccgccaccgcgcccagctaattttttgtatttttagtagagacggggtttcaccttgttagccaggatggtctcgatctcctgacctcatgatccacccgcctcggcctcccaaagtgctgggattacaggcgtgagccaccgcgcccggccctgtcccacacttttaaacaaccagatctcctgggatttcactcactgtcaggagatcaacaagcgggaagtccacccccgtgatccaatcacctactatcaggcccctcttccaacactggggattacaatttgacatgagattttggtggggacacagacccaaaccatatcagagacacaatctaaatattgcaaaatatatttaagtaccagtaagcctgccacataatgattacattatttaataatctgtgacagaaatgttttaatccttactaatacaaaaaaaaaaaaaaaagagtccaatcctttgacgtattctaaaagagttaaagttcgttgacttctaaaaattcttgaatattttagggctacgtcttatcattcattaagtgattaaaatttagcatttacaaatttcaaaaaaaagtactcttggggattaagtttattaaaaatgatattaaatactagagttttttaatccactactgcttaacattatgtatactggacttgaagagaattctgatatagagaagattggatggctttttgatggaaaacaccttacaagatgtaaaaatttatgtatttttgaaattgtttttactatccattttataatgattgtttacctgagaaatatagaagataatgtatattgaatcacatgaatataattttaaacaaatgtccatggttatgtttttctgattgttggggaaatggacaacataagtaattttttatagtattcttattaaatgttcatatggacattccgagttattttatcactgttggataatatattaaaataagcaaagaacaagtcatatataagcaaattatgacagtttcacaaggttttagagtcatgaatcttgcattagggagtgagaatggctcctgaaaagattcctaaagaatggtttatctgaatatttaatattcaaagatctgagtttctaaatgggcttaactagtcaaaccttccattcctctttgatgatactgagcataatagaattctttatattttacaatataatttccttctatttagaacctcttttccaatgtaataggtaaataaaattgcccaaaaaatcattacatctacatactccaccaactctaatttgcatgattatcttgagatgttttcaagtttcctaagtataatctgttagagagagagagaggaagtattctgtataagcattttgtatcagaagtccattaaacattatattaaataagaattccagcaggcttttgctaagaggcctgttttgcttgggaaattcaattactggattttgaatgcagatattcggagccaaaataggaaactggagtaaaagcagtggatgccttctttacacaccactattattttgtaggataggaacatactacaaatttaccagtcatatgagcgcagtttttgtttttctttaaaaaacacttcctaatcatgaaaacatgcttgtatattctcagttatttttaaaaacagttttgatccattttgttaattttaagtaggtgttagactgaaatttgttaccactgcatctattaaatggagaattctacagaacacagctgttttatcatatttaaattatatggttagatacttatcaagaatatagggataaacaaattcatattatctaagaagtattaaatagattacttattttcaaaacctagatctccttgtcacatatacgcttttcccatgtacaaatgcatacacataattgtttcaataaatttaaaacatttcaaaaatctagaagacaaatacaatagttggcagtttcatttatgaaacatttggattttctgaatagcaaggcataagctggaccacgtattccctactttctttttaattacatattccatcaaccagtatttataaaataaaagttctcaaaaacatccttttgagttagcctgtaattagccatcaggcaagtgaaagccaagatatggagtcgaaaggtctgaattcatgtatcttgtttcatttgtttgttttataaacttggagatctgactttatttctctgttcctgaaatcctaatctgagaagtagatataattcctattgggatatttaagtgagattatgtaagtaaagaaatttttcaagctattaagattagaaacatgtgtgtcatcaattcccaattttagaagcattctccaaatctagtgtagtatgttttttcagtgacaatagtcagtaatgacaattttcagaatttttagtcaccctctatgtttttcagattccctttacctctttttactcttattcatgattgaaaatatctgacaatattttagattaaggaaatgttacttaaagttggaggtagaatgtatgcaaatctctgtcataattttcgattaacacatggtaaatacatgtttagatagtgcagtgcaggctgggtcagtgaggcatgacaggtagacctagctctgtgccaggtgccattgcagtgcttgtaacaaattatctgttaccatcatgatggccttgtgtccaatgagccatttaaggggacactgtttagaaatgaatggattgttctgtcctttcttttcagccatttgttatagtggttgcactaattttccaaatcacttaaaaatctgttcccagtataaatataaaatataaatgccattctgttacagttcaatggtgtacttagattctttcaaaatatctagaattttgtctgcatgcgaaagtcaggatgacaaccatcctgtcgcctgcccctacatcttccatcggataataacttctacttcacttaggacatgaatgtgattcttttccccaaaagatgagtattacccttgcttctttatgtaaacatctacattcctgctgccatcagttatttgggtaaaggatcaggcagacatattcataataattttatagatagcttattgagaaataaaacacatcagaataatctgcatcaaacaaacactttctaaaattatctttgatataaatggggtaaaaatcttcagaacttgtatagaaaaaaaaacaatttccaaggcgatttcagaataagctccttatttctgtgaaatagatttttctgtttatactcctcttaggctggataatatttttaaagtctcatgaattttaataagttgagtggatattccagatccttttgcatatactgtaatgcatctactagtgaattttgatcacctttctaaatacacatttgtatggtgagattctcattttcaaaggtcatgaggtttcttgggacaatttctgagactcaatattgtacataaatagaactgttctaacaaatatggttatgtgtttaatatttttctaaaatttggaagataaaaataagatgctgttgataatattgaatatattattggcatatattatgagataaaggaaaatgttataatctcataagatttcttacaggctgtaaaataacagtatatagttcttcacagtataatgtatttttcatctatgagataaaataggatatatgtaattattcttctaatgtttaaagtatccatgaaacaagatttgttatcaattatactaatattttcaggtgttttattttacattgaactcaatgctaattttttttacgttgaactcaatgctaattttttttacattgaactcaatgctaattttttttatcgtgtcaaggttggatttaggttacctgaggctaaataactccaagtaaatacatagttatataatgtgttgataaatgggtacctacaaataatttgaataagatatcagttccttcttttaagatgtatgtttctactctgctcaagtggtaacttagaggaatactagtatgcttattttgggaaatttagggcacagtaaatcatgcttcttatgtgcctggagacgcctgagaggccgtggaatgagtaattctatgttacactctggaatcagaccacctaggcagattatacaattttggtaacatagatctgtgtatcttcacgcagattctttaagctttctgtgcctaaagttcccaacctgtaaaatgggtctagtcacttacctgaatagtatttacctcaatggaggttgtaggtattaagagaaaaagtcaaacaaagggtttagagcaatgtctggaacatattaatcactcaattattttatacatttgtgatttctaggtgcattaacatagtatattggctcttttcttgaaaatttaaaatagcctgttacttccactttataataacgtttttctattagtgtattggtgtgtgtactgtattacatacatctgtgtttcccagcctggaatgacaaatgactcatttggaagtataattgagaatgctaatttatgccattcaaatcttgggcctacttattatcacatcgagtcctatgccttgtcatatgaattgtgcctggaaagttttttcagatatatattttttaatgaaacttcagtgaaaatatgactaggatgttttcattagacttagtttaataaattcacttgataaagtgcgttaacttcggaaagaaataacccatttttgtctacagtacttctctgtgtcttcttaggccaactgaaaagggtaggataagaagacttgaaaataggcttataagtattaactaaaacagtttatgctggttagccatgaaaggacaaatcagctgcaccaggaacatccaggagcttgtcagagatgtagaatctcagaggcttaacccagatctactgatcagaatctacagtttaggaagactcacaagtgattcatatatacctccaagatagagtgtgttgcttttgatatttgaagaactctcacgagaaagaggaataagcatcagcatttgtgtttccaaaccagaaggtagaattagaataactggaatttacagtgcaaattgcagacagatttatcgtgaaaaaagagtgagctttgataaataggcactcactgagcacctactacttattgaggctagggataaacagaccaaaacacaagcataattgctgtcttctaggggtcaataaactggtgataaggctaaacatatacaattataagtatattgtatgactgttcaaatagagaggtgcttgcctaggttgttttgggaacactaggaaagtggtcttattcagagtggttgggtccagcaaaggcttctttggagctacctactattggctaaataggtaaggagttggtcactcagagaagaggggcaggaagtcattccaagcagatgaatcttctgctgaaataggtaggaatggagagtgggattctataaataactgcgtttttcctgactttctgacatgcaacaaaataaaaagctgacctttatctatttatttagagacagaatctcgctctgttgcccaggcttgagtgcagtagagcgatttcagctcattgcaacctctgcctcccaagttcaagggattctcctgcttcagcctctcgagtagctgggataacaggcatgcaccaccatcccatgctaatgattgtatttttagtagagacgtagagacggggtttcgccatgttggccaggctggccttgaactcctggcctcaagtgatacacccacctaggcctcccaaagtgctgggattataggggtgagccactgcacccagcaaaaagctgactttttaaaataaaaaaaactctgaaattatatcctgtgaatcagtaatgcttaatttatataatgtaaatatctaattttggaagaaccttggagtttatgcagtcgcctagggcacatttttatctctgtgccattcatcatatagagctcactgcagagcacaaaacagatgtttatgagtttacaactgaactgaagtatctcattctgtagatgaataagctgaggctgagaaccatgatgtcccttaaactggaaccttgaatccaggtatactgacctcactactgaatatggagccaaatacttattttggttcagcaagaagttccattactataatgaacccctgctcattttgagtaattgaaaatactattgaatacatacacgatatttatagaacaagatagcatgggctctggaccggacctcaaatatctgaactctgctccaacactttctcgtggtgtgtatttaactatgttaatcaacctactatgggtcttagttgccttaggtgtaaaagcgatataattgtatttaccttatgcgatttttgtgagaaataaattaatcaaaaataaattgtttagaacaatgccccataaatatagtctcttcttatcgtcctcttgtttcactttctcctatttatcagtattattacgaatgctatcattaatgtttctcaaatactatattcaaagtgatataaagaatgcaagtaagtagttaatagtaggtctagccttgagaataatatattttaattggaaggacagcaaaaatcactacaataactttaaacaaaagcccgggtcatcttgcacagctttcaggatgcttatgcccctggacaccgtgaagatacccattctatgtgtttcacttatgcatactgttttccaggtagctaatttagtcagtgttgactttgggagagaactactagaatgttaaaatgtcttggcaaataaatttggtttgcttgagttaaatagcttaattataggctgcagtgaaatgatcattctggcaaaaagatatagtgctgacaggctgtctgaaaggttcattcaccatctatgccttttcagaagtctagagcaagagtagagaatagactttggcttctagaaaaaattctgtccatttccaaatgaaaataatgtttgagataagtatctgcatttctccgatgaacttcaccaatatattttgatgagacagtgaatgggcctattgtaattgcaatttaaatgctttataatgatattaatatgcagcttggaagatgtctgtgaaaactcctgtgatttagcagagaaattcagaaaacttcagctgcacaaattaataaataataacagccaaccaacacttattgggggttccttaagtgtttaatgtgctttatatcatttaatcttaaaaacaactaatatgtgaggatatagattattatttttatgattaagccctatttttggctgcagaaattgaggattagagaaagtacaactttccctggggtacacggtgggactgggtaatggatgtgttaactaacttattatggtaatcatttcacaatatatctctgtatgaaagcaaaaaaaaattgtaatggttgaataaatatcacatttcctgttttaaggaacatacccgcaaaataaaatacaaataaaaataaaaaaaactaaactaaactaatcaaacagtggagctaggataggaaaccaaagctacctaactaaccagcctgtgttccttgccactatggccctggtcagccattcctttcacaggcaatgtgaaacttagtgatctctgcatttaaactgtaatatagcgcttgtatataagatgttggtattttatttattttttatttttatttttttgaaacagagtctcgctctgtcacccaggctggagtgcagtttcccaatctctgctcactgcaacctccgcctcccaagttcaagcgattctcctgcttcagcctcctgagtagcttggattacaggcacctgccaccacacccggctaatttttgtatgtttaatagaggtcgggttttgccatattggctaggctggtctcgaactcctgacctctggtgattcactagcctcggcctcccagagtgctggaattacaggcatgagccacggcacctgggcttttttctaattttcaatacaaaaattgaggttcaggatcttacctaaggtcacagagcttaaaagttagaagatcttggtctttaatgctattgttggtgttgctgttttcaatttttaaagaaagtactatttacctactgtattagtttgctagggctgccatcataaagtaccataaactgggtggctcaaacaacagaaatttactctctcacagttctggaggccagaagtccaatattgaggggttggcagggttgactcctcctctgagggaggtgagggaacagcctgctccaggactctctccttggctcgcaggtggttatcttctccctgtgttgctttatatcatctttcttctgtgtgtgtgtgtgtgtgtgtgtgtgtgtgtgtgtgtgtgtgtgtgtgtgttttgatggtattgctctgtcacccaggctagagtgcagtgatgtgatcatagcttactgcaaggtccaactcctgaacccatggatcctctgtctcagccttctgagtagctgggactacaggtgcatgtcaccatgcccagataattttaatttatttattttttgtagtgatgggtctcactttgttgtccaggtgggtcttgaactcctgagctcaagcagtcctcccacctcggcctcccaaagtgttaggattgtaggcatgagtcactgtggctggccttgtttttcattttatatggcattcattttacaaaaaatttatttgtttagaatccactttactctggtatgacctcatattaactatacatgtaaagaccctgtttccaaatatggtaacattctgagacattgggggttggaacatgaacatatgaattttggggggacaaaattaaattcataacaactagtaggcaagtactttataaagttatgacattaaaagttatttgctattgctagggtgttgataggggtgtgtctggtaagtaagaataaggatgatcttgtaagaaagacaatatcttctaggaagagttgtgcatcaaccttcattaactcagaaaatatgcttgaatcaaacgactacttatatatgactctctgcaatcatttatttacattcaaaactccaaggaaacattttcagaattattctatcctagatagcaaatgaaccaaagacactttaagaatcaatctcccaccccgtccccaaagaaatgtttggccttaaaaatcatgtcctactttcaaactccatacagtagtttattctgcactaggcaccatttaacactatcaacatcatgtaattctttgagatatagtaattatttattaaaaactggattccagcaaacatgcattctaaacaatgatggataatttttctatcagcaaagaaaagagctcgcccagagccaaaacagctttccccaattaaaagttgaggttgaattgctaatttcatttggattatactagtatctgcttgaaaatggcaggtttcattagttctcccagtattcttcagagaaggttaagaaacacattccctccacttcagatatgaaaactgagttgcccagggtgaagtcgttgtttatcttatgcacttagcaagcacaattgttcattctatacgcacagtgactgtctcgtttgtgtatttttcagctttgttacagtatacaaattggaaaacagagctgtgtatgacagcctagagcaagagaaaaagactgtgaatttatcataaagtcattcaggctctttacattcagcctggaacaaacaagtatttgataaaagaaaccagaccaatacaaaagaaacgtccagtccctttggaaagattttgtgattatgacatagcaggaatatccaatgagtttttcacatgatatgttaaataaaaaggtatgattacatatctttaatatgacagcattttcttgaaatattaatagaagtattgcactttagctttacttaatgtaagcaggaatgccaatgatgttggtttcaaattttaaaatcaaaaccaaaatatgattattcaggtatattttatgttaggatttgggataactgattgtgaaataagacacaggcacatgtacacacacactctctcaactcttactacacactaactattaatctccccccaaataatatcaaacctatggatatttaatggaatttaacctatttcttagcttattcaattgaagtgcagagatgtttggcatttttactaaaatcaaatatcattgccaatagtaatcaccatgcactgagtacttacctggtaagcactttttgtgtcaattactgtaacaagatcctgagaggtaagagaccaggctttttccttggctttatgtcccactagtctttgctttctctattataccatatttaagaagatatcatagtttttgattataggtgagttgtctgaggggtttattttgtcctgttaaatgctgggtctcatcagctaggaaagtgccttgactattgaatgtatttagtaagtacttgttaacagatccaccaaattgtggaatttagtgaacattggaatatgcagctataattaggtttacaatttataaacaataatgtttattatcttaatttatacttaataatattgagaaatactgcatgtacctacatctattagaagtcaaactgtccaaaatggcatgtgtgggaacacatgaaaagcctaggatttctataggagagaaaacaacagagtttgcagcaacagggagatgagaaggaggctgggaatactgactgtagcagcaaagcttatcctcccttcagacctggaggcagcttgatgctgctgagtgtaatggcaaggaactggtgccaaaggcatggatgtgtggcaatctccaatccaagctggaccagggtccatgtggttagtaatctagatggtggtttcctctgttgaagggtcatggctagaagaggatacaaagaaattttagaagtgttgataattctttgtttcttgacttaagtgcttcttacacttgtgcaaatgcatcaagctgtatgtttatgtgtgcttttttcctatgtgtattaaaattcagtgacaagttgtaaaaacaaattaatcagacttggaatcaaggtacacctctgatggaagaggaatgaaagaaaccaggaactgttattggaatagctctctagtaccaaagataattgtgggagaaaaccagtgggccaggtgaaatggtaaccagagagcttagcaaagggtctttaagagcctacttgcaacatatagggacattatgttactctttatgtaaattcagcatgatataagtacacgggatctactcacacttagtacatagatacttagtatagcacatagtattatttgctgatgaagagggtatttctaaagaaatatgtttggatgtcattgcctctggtttgaaaagaaatgaatgtatatgaaacaggcatcattgtgtgcagttggcatgcacagggaatgacaggtaaaccaagctgtggctactcctacttgcttttgattttgtgtttgttagtattatttttgttgttgttgttctatttgcaggatgaatgcctaaatttattaatcttatttttgtattataattgccatctatgtataattgatgctaacagagaaaatttccatgtctataatatctaccaattaaaattgagaaaatatagaaacaggcaaaaacatgaaaaggaaactcaaacaaaatatataaaattgtgtttacatgcatacaaatgtaaaatgaaaagagaaatacaaattaatcctctatggggatactatatctcaccaatcaggttggcaaagaccgaaaaggttgtttatacactcttttgggaagaatctggggaaacagcattctcatatactcctgatgagcatgtccaatagaacaatagctatagagggggattggcaatacccagcagaactaaaaatgcatttattcttcaacccaactatctcaatactaggaatttagtctaattatacagctccaataacataaaaagtcatacgcacaaagttatttcttgccattgtatttgtaattacaaaatattggaaactatctttatgatcaaatatagattggttgaataaactaggctacatatttgaaatagatacacagcagctgtgaagaaaaccgataaaatataagttgacatggggtggatttgctggatatattgtttagtgaaaaaaagaaaagtacaaagagcgtttattgtatgttaacttttgtttaagaaagaagaaatgaggaaacgtatatatggttgaagcatttctgaacatatttaaatgtactgtaaattgagcaaatgagtgatatgtcaattgtgttgggggccaaggttctcaccatgaaggaaataagaaacatacgtggaatgagagaagacaagaatgaagcctacttaaaaatatatgtgtgtgttaatgagtatatatatatatatatatatatatatatatatatatatatatatacacacttacatactacatgctaagtagctctgacagctggatggatctagaaacaaaaatattgcagtaacactaagcacacctaagatagactttaattattaatacaattatcatctaaaagaaatcagatctagttagaaaaattttaccaggttgtggtcgagaaagaaacttgttaaattaaacacaccttgttataccagaaagaaaggaaaaatgatggttaatacaaaattacataagagccaacttgaaataattcatattggtcaaacctggacaatttgaacaccaaaatagttaaggacagtaatgcattgcacacctttagagaaaaatagaaatgcttaagtctatagagatgataggtaggtaggtagacagacagatagatagatgatagatatagatagatagatagatagatagatagatagatagatacatacatacatacatacatacatacatacatacatacatacataggcaggcaatagatagataaaatgaggcagaagagaggcctcttgcttatagtagaatacgaacttctgactaggaaacgtggaagggtgctggaggtgggaactcaagtcatcatttgcaaccatcatagtaaatactagttctggcataagacattaatggtaataaaagtagaggatacggagagttttgatggggagaagtaaatttgtatagtcttaaagtgtctcttacaaatcacttattagttgcaagggaaatgaataatatttacacaagagaaattaaacatcttgagtgggtaatcaaaataaaaattacagatgagaagcagacactgtgcgcctccagaggcagtggactgagaaggacccaacaccgtgcatgtagtgtcccatgaagaatgtaagtggatgtaaacattatgagaaaacaaaagtcaaaccaaaattgaagaatattctatgaggaatgttctactaaaaagataaaggagaatacattgtctatgtatcagtgtgataagagacactaaaaggctaaggagttattctaggtaaaagaaaattaaagggacatgatacctacctgtaatacgtgatcctagcctggatcctgtcttggataagaaaagatgccctaaagacataattgggtcaatggataatattgggatatggaaggtttattcgatgtagcaatgttaaatttcctgaaattgataactatatacttacctacatatgtccttatttgtatgaaatgtacactatttggaagtaagtgaacatgatatgcaacttattctcacatggttcagaaaaaataatgtgtgtgttggggtggtggaaaaaggagagagaaggagagggagagagagagagagagagaatgataaaccacatagcacagagtaaaatagaagaataagaataaagagtaaaaggacaagtgttccttatactattattgcagcttttccataattttgaaattatttcaaaagaaaagttaaacagatttaatatttccctgaaaatccagcattagaaacacattaccacagcttgtattcgtttgtttgttttaacagggtattctttcaaaaccagattgccttatgtgagtatataaataaacatactaatcttaaaccactaattgaaatctgtattagtatatttaattggatctttccattaactagctaataagtggtgttctccagaaaatagagatttgacttgataaggcagaggaaaaagaagttagaccaagagaacgactgagaaacaatgggaggggcaatgagggacgagagagcctccatcccgtgtgggtgtctgaattgacaggagcacgtggaatataagaaaaaagacacaccaatctatcaatagacagtgttatctaggactattcctgatgtaagtgatgagtagtcagctgctgttttgtgtttggttctatatcatatgttcaaagatactaccaaagatgtacacatagaacactaaactgtggaatcatatttgtttcacaggatttgtaaggtgaagggggtgataagaatttcctgaaagtcaataaaactgtgaatatgctttcaggcatggagaactcaaaagcaccaacaagtcacacttatcagaataagtttgaaagtggaaagaaagaagacgtgacattagcttaggacaattggatatttcaaaacatatgtaggaaaaggtgctaagggccttgacagaaggaaataaatcacaattagatcttgttctggaaaaatctgctaagatctacggtggcaactcaagtctgaggaggacatgaaggttttctcttgccagaggagtacttagtgttccttggagagagttgtcaggcaaatatgatatacagattctctgcactcatttgttctgtgaagatatcaaaaagaacctgcctaaatgagaaagagatttttatctagtggaatgggcttgcactaaatgttgtctagtttccctgccaacactgacattcttgcattcatcctaaggtaaactgttttaaaaagtttgcaccaggcttcgtggctcatgcctgtaatcccagtactttgggaggccaaggcgagaggatcacttgagcccaggagtttgagaccagtctaggcaacatggcaaaaccgtgtttctacaaataatgcaaaaattagccagacatggtggcatatgcctgtagttccagctcctcatgaggctgagatgggaggatcacctgagtccaggaggtcgaggctgcagtcagccatgatcacaccattgcactccagcctggggcaacagagtgagatcctgtctcaaaaaattaatcaattaatgaactataaaatttagctaccccatatgtaatatcagttgctgaaaggtagtcatatttataaatcacatttcatttttttgcatttttattataatgtaagcttattatttaatattcttctcctttagatataatttgtcctacatcatttatttgaagtaatgttgtacatgtcagcataaatgcctttctttcatccttaatacattcagaataccagggagaatctggcattggagaaatgataatgtaagggttttacatgacacatcaggaaattcccaaactttcataagaaaggcccaagtgctgacactatatgttgactcaggtcctataaatgaaatcttaataaagcaattgagattgagaataaaggtaaaattttgaggcaatataggcaataacattagaatttcagggttacttcagcagagattagaaaatgtgtttcaatttcctcaacagagaacaagtcaaatcttaaaagaagagcagagtcaacttttattttaaagagcatcactaaactgattaatggcacttaaatgtgtctgttgacagaacaccagtaacagtattatgcattagcccctatagttattgaaggagctgcatattttttaaaattccagctattaaagtcaaattataatccttgttgggtgcagtggctcacacctgtagtcccagcactttgggaggccaaggcggttggatcacctgaggccgggagttcaagaccagcctgatcaacctggagaaaccctgtctctcctaaaaatacaaaattagccaggctgtggtggtgcatgcctgtaatcccagctacttgggaggctgagcctggagaatcgcttgaacgcaggaggcagaagttgcagtgggccaagatcgcacaccgttgcactccagcctgggaaagaggagtgaaattccgtctcaaaaaaaaaaaatatatataatcctaactctgagtctgagacctaccctgactctaagcttaattccacctccaacccaactcaattgaaaacaaaaatacaggaaccacaaatcataagtgattgaagaagagaaaaatattgcacgtggtatctcagtgagtaaatagaaggaaagagaaccaaagatagagtaaaaggaaatgtctaaattcagctgccgggctaggaaaatatgaaagagaaaaatttaaagaaaaccaatgtggtcagcagtaagaggaaacctagagtgggggaggaagaggatcaattgctttaagaacaagagacttgagattacctttagaggtgggttcagctcaaaatgtgaaacaagattttaaatagagtggtaaaaacagaatgacataaatacaaaaatgtggtaagacttttatttaacaaatatttatcaagtttatttttattgttcagatgttacaatgagtaatggatatatatagactccaccatcatgaccctcatggagattagagctagatagaatataaaggtgtgattatgcagtatgtttttaaaaagtggttgagggtggtgagacagagggagagaactaaggcagtggtagacaagaagcttgcacaccagggaggttgctttcttttttatcttttataggccaggcaaaagtggaacatgtctgtaggtaagaggaacagtgaatgcaaagtctctgagggtggcagggtgtgtggcctggagctgagaggacaaaggcatttccattgacagagatcctgctatgtggcaggcagtgtgccaaataccatttggttttatgaaagttctagaacagcccctgcagttcaataagtacacaaactagatagggacatatttatctgaaagaaaaatggatcatattgatctactcatccctatgaagactgaaaagaggatagtctattgtggaaaaattattttaaaaattaatgttagtttaaaatgtattgtcttaacctaaagaaagcatctacattcatttaaagtatttatcaaatgattgaaaaaaaatttcttggaacagaaaaaaaaaacgcattattgacattctggttttatgggtccaagctgttaaaatatgtataccagggtcttaaggatagaatgagccctagaataataataacctcctttggattaagataattaataaccatgatgtctatttgtttgtctgcttttgtaccccttcttcctactggatgccagctctcatatttatcactgatagaacacaaatggtaaaattataggctagaatttttttcttgttgtttgcttcttttcacattatatggatttccgttttaatttattttcttttttctttgtttgtttggttttttgttttttgagaccaagcctcatcctatttcccaggctggagtgcagtggtgtgatctcgtttcactgcaacctccgcctcccgggttcaagcgattctcctgcctcagcctcctgagtggctgagattacaggctcatgcccagctaatttttgtatttttagtagagacagagtttcaccatgttgtccaggctggtcttgaattcctgacctcaggagatccacctgcctcggcctcccaaagtgctgggactataggcatgagtgtttttccttaccctttcattttcttgaacacattttaaaatttttaaaaatttacaattacaatgaactgatgtttaggtgctcaacaattttgtacagttgtcttatttaataaaatcgatagaaaacttttagtgaagaataaagtattatactaatgcatcataatttctattaatctgacacttagagattgtgaatccaattcacaatccaagtgtacattgctgacacttggagattgtgaatccatctcttagcagggggtaaccataaaattcccctcctaatttaaaaactatcattataaaaaatcagcattcagtgagataggtctacaaacataaactgcttctcagtatcctacaggcctgattttcttcatcagccttgtcagggttgtgttacatcgcttcatctgactacatgaatggctaaagaaaaaataattatatgtaatttgctggattttggagccatggcgccttataaatatttaaaagatatcgtatttagcaatctgaacagagatgtatactgataatgcttgagaccttggcaactcaattaacctctgggcattggatttggaatggagggattattattcattggcaattgtataaccactgtaattaaaaagcacttgccaaccttttaattattaatcctgtggttcatcctcttgtataaaggctaacatgcccattttaccagttagtggattggggaaaatgaagggaaaatgatagatgcaggcgcggtcgatggcaatgttaagactttagaatgcaggactttttccacctgccagttcgttattcattctgattagaatcatttattctatcttaattaattctgtattttgagggttaaagtacttagcgtttgatatattgaattaattctttacttaaatctcatgttgcattccaaatacgttcaattttgtaacataaaaagagctgtagcatttggacctttcttaatgacaacaaaaacgaaaaaagtgtagttttggcaacttttggatcataacatgctatttcctgaataaatagtgataaatcacttcttacacttccttgttaaaaaaagaaaaagaaagagactcaaatgtccatcctatgacatctgggcacaaaaaaacaaaaaacaaacaaaaaaaacgctaatgacactcaatgcaaaatattcagcctccttctgaatgagaactaatctttatgcatactatttgaatgtgtaccctgggggaaaggcataatgttacttggctgtctatcaaagatatcacagacaactctcaaaggttagagcagatgcttttaatcagatgctgttttcattttttatctgagttttcttaaactaaacttggctaggaattcaaaattctgtgaaacatacatatgcactcatatttttgcacttgtgtgcagccagacacataaacatcgccctgtctgtatggttctttatggtacagtgttatagcagccactccagggtgtaatgtggtcattctggttcccccagttattaaaagtgttttgaacagattcagtaataaaccagtgttatagtcacttttgtgcttgagtcaaccttcatgcatatagatttccacttaatggcaattgtattggatttatatgttcttacagtgacctcagatacagaaataatgagtgatcttattaatttgggacctgtctaatgtgggttttgaaaaataatgatttgataacttaaaaactcctttagatcagtaattatgtcaaagtatagaatgaagagtgaacctgtatttaaagaagtgacaaaaaatttttcatatttaagtctttaaatgtatctcccaatagtaggcatttatgactgtactgaaaagtttaatgttttctcaaagaagtaaatagcataagaaaatagttttaaaaaggagctttattatagtattaactaattgtttgtttataagccttatctgcttcaacataatcatgctaccaagaactttattcaattgagatgaagagttatcaatagctgataattatccaagataagaggtatgtctttcatatgactctatgctttaattataacattagtcaaatgtccacatggtatttccacagttaacttgtaaaatgagaatagccttgattcaaaataactaattaaatacagaatgtgattcaataaaagtcactgattgggtaattaagagaagaattagaagacttgaatgaaaatatataatacttgtaatcctaattagtactatgctatttgcttccccttccattactagacatttaccaaccaagtatttaaccttgaaagaatcaaagaagcttttctgagctcatactagttcccaaatagaagctaggctatttaagatttctaaagattgaagataaaatacttgctagcatgtccttgaaatggaattatggacaaaaagtgttagttgctattatataatgaaaacacaaatataaggagtaaatccaccttaagcaaaatgtctaaatgcttagctgtatttatcaagtgcttttcaatattttttcttcctccttttctgccctctttgctattgatagaggttgttgttaaaggtatagttgttttcttcttcagttttatttttagaattaaaatgctctaagtaaccttttttggtggccattatttgacattttaaaatatgtacctttctatatgtataatatcattcagtgttttattcttctctttaataatgtagagcattagcatatttaccaagacataaaaattacaaaagaataaaattagagatctatatttataatgaatatagacacaaaaattaattagaaaagtaaatccaataatttttatataaagacaataccttatgaataagtggtatttatcccaggaaagtaagtttggttcaatattttaaaaaatcagtaatgcaaatcatcatgattatggcaacagatataaaaaaatcatttgactaaatctgacattcataaaatgacaaagtgttcttaacaaaaatggactggaaggcaactacctcaaattcataatggtcaactataaaaactcacagctgatggatgcagcacttaatgttaaacaatagaatattattgatttttgaatgagaaaaagatatgtttttacattttatttaatattacattggagattctagccaatgcagtaagaaaagaataaacagaagcataaagattggaatagaagaagtaggcctgtctgtgttcatagatgacataataatttatttaggaaatcctaatcaatcttaaaaacaaaactactgaaagtagtcaggctgggcgcggtggctcaagcctgtaatctcagtgctttgggaggctgaagtgggaagatcacttgagaccagccttggcaacataataagacctttcctctaccaaacaaagcaaaacaaaacaaaacagaacctgcagggtggcaggctcctgtggtcccagctcaagtggtcccagctcaagaggctgaggtaggaagctcatttgctcccaggagttcaaggttgcagtgaggtatgatcttaccaccacactccagtctgagtgacagagtctatctaaaaaaaaaaaaaaaaaaaaaagtataaatttaacaaggcaacaggttataagattaatacaaaaaattctatatgctagcatcaaatattcggaaaatgtaatttgtaaaaggaataccatttaaaataggaccaaagacttgaaatactaacagttaattataataaaaattatactgacattctttactgtaattaaaaatactctgtaagaaactaaataatagctaacacaatggagagatacataaggcttattaattgtaaaatatgttaacttgttcactatcttcaaattgagtaggtttttaaatttacaaggtgattcaaagtttacttgtactgcaaaaggcctaaaataatccaaactgggtttgaaaaaaattggaggaaatacaagaatttcaaaaattactataaacttataataaagatagtcttgtatagctgtaaatataaatatatagatgaagagtccaaaattgagtccacaaatagactcacatatatatggagaattaaattttaataaagccaccaatatgattaaatgcagaagagaatagtcttttcaacaaatggtgttagaaaatgatatccatatggagaaaatgaacactgctgcttcacattctacacaaaaatggatcatgtacctaaatgtaggcaccactagttttaaacctctagaagaatataaaggagaaaatattcagccttgggataatcagccatttattaggacaaaaaagtattagccataaaaatgataaaagcataacacagagaaatcaaaatcttctattcttcaaatgacacactaagaaaatgaaaatcaaaccacatgctgggaaaattcattcacaatacacaaatacagtaaaagccttgtatacagaaacacaatgacccgttttccttgaaaaggaatccttgtactagtcatactattgtctttgcgtctgcttctcagaagatctaaatgaatacattcttcttctatttcttatcacatatattattctcagaagatccacccatttctgttattattcagaggtgccatccaaacataataacaaaatgttttacctactgaattcagtgctatttgctgtatcattccaatgttccccccgacagtttctcatctgcctgttttactttttgaaacattgggatccaggcttcaggttgatgtatctaaagtacatatacacatgcacggaaagtccaagataaaagaaatattatcaataggaaatgaaaattccaaacctttaatattaggtaattccatataagcctttataataaaatatttatctcattgttttccaaaataatttttatttacattattttttacatttcagtacatggtaaagtttagaagatttgatatttgagaaagggtaaacagtctttagctcctgcatattaataatttatttaaccactgacactaaatatgatgtgccaaataagaaaacaattagcaataatattaacattcccactgttttctcatggttaaaaataaaaagttgtgctttatttctaatttgtgatggaaaggtatgtccatgacttcacatatgattgtacctgcataacacatttggctggcacggcaagtgggagctgaaatcctttttttcaccatgtttcactatgtcaaatttaacttttgacaatttaattggaagaaatccatgtactttcttaaatatgtcttgaatattcagggaacattatttgtaatagagcagagttggaaacatttgtctatcagtacaatatttctgcaatcaattacagtatactcacatgatggaaaacaatgtacctgataaaagtaaacaagatagatgtataatataccacggtagaaacataacttcgatagggtctttcttctaaaacattgtaatatcatatatattacatatcattttataaacatagattatttttatatgtagatgcatataacaacctagaaggatatatggaaatctcttttttaatcttttactttaggtttggtgggtacatgtggaggcttgttacataggtaaacacgtgtcacaggggtttgctgtaaatatttgatttcatcacccaggtattaaacccagtgcccaatagttatcttttctattcttctccctcttccaaacttctgtcctcgagaagaacccagtgtctgttgtttccttccttgtgttcataagttcttatcattaggctcccatttctaagtaggaacatgtggtatttggttttctgttcttgtgttagtttgctaaggatgatgacctccacctagtccatgttcctgcaaaagacatgatcttgttctttttcaatggctgcattatatttcatggtgtatatttagcacattttctttatccaatttgtcattgatgggaatttaggttgatttcatatctttgctatcatgaatagtgctacaatgaacatcacgtgcatgtgtctttatggtagaatgatttatatacctctgggtatatacctggtaatgggattgctgggtcgaatggcagttctgttttttagctctttgaggaatcatcatgctgctttccacaatggttgaactagtttacacccaccaacagtgtataagtgtttccttttcttcacaacctcatcagcatctgttattttatttactttttcattgtagccattctgactggcgtgaggtggtatctcattgtggttttgatttgcagttctctaatgatcagtgatagtgacttttttttttcatatgctcgttggctgcatgaatgtcttcatttgaggagtgtctgttcatgtcctttgcccactttttaatggagtcgtttgtttttctctcataaattttaagtttcttatagatactgggtattagaccttcatcagatgcatagtttgcaaatattttctcccattctgtaggttgtctgtttactctgttgatagtttcttttgctgcagaaacgctcttaagtttaattagatcccacttgtcaattttttcttttcttgcaattgcttttagtgtctttgttgtgaaatatatgcccattcctatatccaagatggcattgcctaggttgttgtttaggtgtttatagttttggattttacatttaagtctttaatccatcttgagttgatttttgtgtatggtgtaaggaaggggtccagcttcaatcttttccatatggctagccagttatcccagcaccatttattgaagagggagccttcctcattgcttgttttgtcatctttgtgaaagatcagatggtcgtagatgtgtgggcttacttctgatatctctattctgttccattggtctatgtgcctgtttgtgtaccattaccatgctgttttcattcctttagccttgtagtatagtttaaagttgggcaacgtgaggcctccagccttattctttttgtttaggattgccttggctatgcgggctcattttggttccgtatgaattttaaaatacttttttctggttctgtgaataataatcttggtaatttgacagcatagcattgaatttgtaaattgctttgggctgtatagccatattaatgatattgattcttcctatccatgagcatgggaggttttttaatttgtttgtgtcttctctgatttccttgagcagtgttttgtaattctcattgtagagatctttcaccatcctggttagctgtattcctcagtattttcttctttttgtggcaattgtgagtgggattgcccttctgatttgcctgtctgcttagctgttgttggtacccagaaatgctaataatttttgtgcattgattatgtatcttacaactttgctgaagttgtttatctgctggaagtgcttttggtctgagactatgtgcttttctagatatagaatcatgtcacctgcaaacagagatagtttgacttcttgtcttcctatttggatgtgctttatttctttctcttgcctgattgctctggctaggacttccaatcctatgtggaatacaaatattgagagagggcatccttgtcttgtgtcagttttcaaggggaatgcttccagcttttgcccattcagtataatgttggctgtggttttgtcatagatagctcttattattttgaggtatgttccttcaatacctagtttattgagagtttttaacatgaagtggtgttaaattttattgaaagccttttatgcaataatttagataatcatgtgttttgttttttgtctttaattttgtttatgtgatgaatcacatgtattgacttatctatgttgaaataaccttgcatcccgggcatgaaacctacttgatcatggtagattcgctttttgatgtgctgctggtctcagttttgtattagtcaggattctctagagggacagaactgaataggatgtatgtatatttgaaagggagtttattaaggataattgactcacatgatcacaaggtgaagtcccatgataggccatctgcaagtagaggagcaaggaagccagtagtggctcagtccaagtcccaaaaactcagaagtagggaagccaacagtgcagtcttcagtctgtggccaaaggtccaagagccccttgcaaaccactggtataagtccaagagtcccaaaaccaaagaacttggggtctgatgttcaagggtaggaagcatccgtcatgggagaaagatgaaggccagaagactcagcaagtcagcttcttccaccgtcttctgcctgctttttctagttgcactgtcagccaattggatggttcccacccacaatgtgggtacgtcttcctctcccagtccactgactcgaatattaatctcttctggtaacactcagaaacacccagaaacaatacttcgcatccttcaatgatcaagttgacacttcatgttaagtttatcacaaatttgcaagtatttttgctgaggatttttgcatcatagttcatcaatgatattggcctgaagttttcttttttgtgtgtgtttctgccaggttttggtatcaagatgctggcctcatagaatgagttggggaggagttctccctcctcaatattttggaatagtttctgtggaatggtaccggctcttctttgtacacctggtggaattcggctgtgaatctaccaggtcctgggctttttttttttggttggcaggctatttattactgattcaattttggagctcattattggtctgtttggggaatcattattcctggctcagtcttgggaggctgtatgtgttcagcaatgtatccatctcttctaggttttctagtttgtgttcacggaagtgatcccagtagtttctgatggttgtttttatttctgtgagatcagtagtaacattccctttgtcatttctcatcatatttatttggttgttctctctttccattagtctagctagtagcaaacattatgaaaatgaatttagacaagatactaactttcaatgtgaatacttctatatattcaaagttttaaacaaatatgagtttacttataatcaaatatatgttttgtaaattgctgtgtggaaatcagaggctgctcatttctcattcaaactaacttaaagatactatgttaaatgttctacaatcataactttaaagttgttttctctaagagtttgaaaaagaaccagtatttttgaggttgtgtcaatagagtcatgattaataacaagcataataaaaatttttattaaaaataagcaattaaatattcttcttttactatattaatgctcctgagaattataactttctaaacaatttaaatgaaacatgagcttttaagcttatagtaggtgctcaaatgtttaggaaaaatgaatgccaaaaatagctatattgtttattcagtggaaggaaaaaagactaaacataatttttacacattgtctgtttatacattactttgctaaaaacttacaaatagatggactcatttattttagagatctgtgtgtgaaatgtattgaaatggattataacatttcccaatgggacacatctaccagcaaagcatttcaggagtgattttatgtatatgtgacgaattaggcaacttatgcttgaaaatatcagaaatattaaacaggcacatctaggggcatttaattcttaccaattttgttttttcctgtctcttaagaaataagagcagggtgtggtggctcacgcctgtaatcctagcactttgggaggccgaggcgggcaggtcacctgaggtcaggagttcaagaccagcctggctaaaatgatgaaaccccatctctactaaaatacaaaaataaggcgatcctaatggcaggtgcctgtaatcccagcgactcaggaggctgagataggagaattgctcaaacccgggagatggcggttgcagtgagcctagattgtgccactgtactccagcctgggtgactgagcaaggctccgtctaaaaaaaaataaataaataaattaaataaataaattaaaaaatgatatagctacatgagctcagtcatcaatgataggctagaaagagtaaattacaaataacaaaaattactatatttaacaattattgtaaactttgacatccatcttcttataatatttgcaataaaatatattttcaatgagatagtgacatggatgtatttttggttataaatcatatgatttattatttcaaaaaaactatccttaatcattaacagtaatgtctttacattgagaaactatgcaaatctcagaatatttgtctcctaacatgttttatgagcataacaaattcaaaaaacacagaactataactcttttgttttacaacttgatacatcacatattgctattctccaaagatttccttcctaattatgttttcttctacataatattaaagttcattgacattctcataatacacaacaggatgtctgcatgaaaattgcctgcaagcaatgttggctgatgggagaatgctagcttatattaaaaggtaactattatggttttatcaatagaaagaaaaagagttaattacattggtacttatctctttcccttttgggccagttaaattattgaattttttttttttttttttttttttggtaaattgaattcttcatgggaaggtacgtcatccacctgtatgaaaacagatatcacaagaaaaaagtatatatagaccaccccccaaaaaacaaacttaataaaactatgtatttcaaatagaattatttttttctggttgaaaaagaaagttggaaacaaaatctgtgacaaaacccaggctttgcctgtactttaacgtaaaccaatgctgcactttatgcttactattttgttgtcttgtaaggagaatttctagagggtggttgggttccatgcaacttaattgtaagtgtcagctgaaagacctacaaagacattgtcagttattgagtttcttatcaagccaataatgtggtacggctgttgtactaataatgaagttttaattagttctcaaaaatactgagagcttatttaaggcctccaaattggatagtgcatgcttagcttgaaggcatcaatgcatcccaaacatatcaaaataactgtcaaacacattgtatacacattaggagataatagctagaaggcttaacatctatcttagaaatactgtatgcacaaattgttcaaggaagttctttctacacttaaatgattgtcttcagaatattgtattttataatttaagcaaattgtcatgcaaatggttcagtgttatctgtttatctgagggtcagtatagttgagaaaattcattttagccaatgtttatcgttattccaaatgggagcattctctattcataactatcccaacatagcacctgcatttttacttataaatacttattgcttgtttccaatattttactgcatgagaaattgtgccagatccctcttccctaatccatgggtagttcaaagatactaacatttaagaaacagttgatttaaacttctaccattggagaattgttgatgtcttttcaatgcattgggtggatttagaccactgcattcttatatgcctgtctattaatgctatacaagatgtctggtttaaactaacattactggaagtaaccctttctaccccatcccatctccacccacacgtctacaaaaagaattttatgcaagacagattttgaagcacatagaggaggagctaacatgagttgctgctagaaaaataatagctgtgttatttgtactgacagtttgtatttcttctcaaatcatttattttcacaaaattggtctggctcttattttttcaaaggacgtaagctacttcattgttgttgttatggatttctgatataatgacattaattacttgctgtgtgccagggacttttttaggcttagagggtgaaagtgtagaactggaagtgcatgcgattcagaggctgcacagtgaccctctgtgggtaagaagtgggctcctagagtatttgaattatgaatgcaagtgggtcaagggaatgaggaatggggtgtatgagaagaataataagcatggagaataggacatatggcttgtttcggggaactacaagatgtttcctatttctgtatcacaattacatgaggataaagggagaggcccaaggatataatgattacaatttgagggggaagtgtttactacattcagagagcctgggtcatattctgttagtacatcatgtttttcgtcaaattttgagtgactattatgtggaggtggaggatcttcttttgatattgatttaaaaatattatttacaaagatattatatattttcttccaagaaaatatagcttatattatacctacaagagttcatgatttgtagggggcaccaaattaagtcggaaatgctaaaatgtcacacatttcaggagaaataaatcagaaagaggtgggtttattggtgaaggatcaatttgatgcatcaaaaagagggttactcttaaattctcgggagaagtgaactcaggaagaaggaaatatcaagtctgacgttaaaatctgatgccaggaaataggaacttgtatataaaagatcctgaatatagctgatgtttaggaaaagtttattaaagtgaattcacctaggatagaaaacaatatggtataattagtagttaaaatgaggatctattagaactttgtctagataaacaaaagaaattaattcatgtttattttttatttttattttattttatttttttgagatggagtcttgctctgtcaccaaggctggaagtgcaatggtgcaatcttggctcactgtaaccgctgtctccagggttcaagtgattctcctgcctcggcttcccgagtagctgggattacaggcacctgccatcatgcctggctaatttttgcatttttgtagagatggggtttcaccatgttggtcaggcttttcttgaactcctgacctcaggtgatccgcccaccgtggcctcccaaagtgctgggattacaggcgtgagccaccacacctggcctcatgtttctttttataacagaaaattgtaattgtgtgactgtgtaacaaaattgtaattgcagctatacttcagttcttcacttaaattgtttgtcaagttttgacatgattctttcaataaaattgtatgataacacgacttctcattctgcttctgtggcattatcacctgaaagtcatttctgcaaagaattatttcagagtcttatcagtttcccaattagcgcttttgtttattttatattcaaaccattttatttttaaaagcctattgtgcaatcattcttgccaatttctcttgatcagaataggtctaactgctttgcacatgttttgaactgttctacatcaacgtcattaactttggaaagacctccttcttttgtaaaatttgcaatttcattattcaatttacatttatttgcattataagtagcgaataactaagaatatattgacatgaaagacagacataggctgaaaggcaaagacaggctctagtgtaaaaaggcagaaaaggatgatttaatggcatctgagattgtaagtggcattttgttatacatattttcatgagaagctgaatttggttctctacacaaacttataactgaagggattcagataaataattctcctatatggagggcctctggaataaacaagattatatcttaggatctgactaaaatggcctcaatgttccccacagcttgattaaactttacacaagctgctgcttaaatctaggccctgacctcccttttcttagagcattccctttagaaaactagtaattgtaaatcctttctctgactctttgagatgtaaatcttttttgaaagtgctttgccagttttaaaacacgaaactgtctttctcaaaagacctggaagccagctcttcgaaatgtaaacatcaatgaagacagagcccctgtcttccagcttctgtgggatagcaggagcctacatttgaaggatgctttgctccaaggtgtaaaactacctcctaagaggcagtttgcttttggcgggggggcaaagccagttaggaaatactggtggcctaaaacccaggtcctttatgacctaattctagctttataaaaatttttcagcttggccaggtgtggtggctcatgcctatgatcccagcactttgggaggttacagcagaagggtcacttgaggccagtagttcaagaccagcctagacaacatagggagaccttatcttaaacacacacacacacatacacacacgcacacacacacacacacacatacacagcaaaaaaaaaaaaaaaaaaaaaaaaaaacaaaaaacaaaaaaacgagaagaagaacaaaaacatctttttgggggcaggagttgcagtacagctcactttgacttttggcttccctcctctcttacattaaactcctggcctgtttaactttgtttggcagattgttttggttttttgctttgacagatccaaataaaataattaaatcagtcaggactgagagatctagatgcatgttgactcttagggagttcatgggatcgtcaccaaatctattcttgcatcacctgaatcttcccaggttgaagatgagagcagacactgaaggtcatattcttgctgctggcttgtatttgctgccaagtcccccagggcatgttctttttccttctgtgaatcaggtcggatttcatataccattttgtgttatttattttggaatttttctcttaaaatagctcctccgtaaagaaagcatattgttcatatcattgtgattatgatttcagcaaaggagataaaactctataataaaataaatgtccttcctagaaaaatatttgagttgaataaaacttcagaatactgccaggaatattgtaactttcgtttgcctcaaaatgctattctgatccttcatctttcattattaatccattcaacaaccatttattaaacccttacatttgtgccagaaccttctagacatactgatttaaaacatgtattctcaagttgcaaaatcgccctccagatcaccctgggtcattggatcaacgatacaataatgtgtattgttgattatcaggtcaacaatgatccaatacacattattgggtcaaaattgttgacctaattcacattatatgtgtttttcactcaaaaagtctggaaggctcagaaaagactggaggaaatgcacattttttcctctgtcatacccatgcatattggttgttctagattagataattaagtagacttagtgcaaaaatcattttattttcatatttcactatttaggttattggtatatttgtaactttttacttttaactactgctttaagcgtttttcattgatgacattaagcatgtaagaaatgatcttaatggttattttgactatagatatcagtgtctttctcattatgtgctttgtataagaaaggacataaatatcaagcaagaaataacaaaagcattgcattcagaaacaagaacatacaagttaatgaaaagaaggtaaaacataattttttcgaccattaaaaacataggaaaggggccaggcatgatggcttttgcctgtaatctcagcactttgggaggctgagaggagaagatcatttgaggctaagagttcgaaatcagcctgggtaacatagtgagacccccccatctctataacaaaacttaaaattagcctagtgtggtgccatgtgcctgcagtcttatctgctggagtggctaaacctggaagatgggttgagcccacaaatttgaggatgcagtgagctatgattgccccactgcactccagccagggtaacagaacaagagcctgtctgtaaaatatatatatatataaaatatgtgtatatgtgtatataaataatatgtgtatactatatatgtgtgtgtatatgtatacatatatacatatgtgtgtatactatatatgtgtgtgtatgtatgtatgtgtgtatatatgtgtatatgtacatatacatatatgtatacatatatatggacttttaaacttttttagcagctctatggctttcagtgctatttggatatttactttgaatgaagcaagattatttgagaactgtttatatttcatgatgtcaccttccatgatagtttttctattataggagattctcagttcattacccgaccatgatgacaagtgaaaactatgaattattttcactaaatcaagtaatcgactttcataaaatacagttcattaatgtttcctcttcagcatattgttttaagatagtcctaagtcattttcagttctttaacataataaaatactcaatagaatacattaaaagaggattcagaacttgtattctttcattttaaaatgtctcctggaaacacaatttactttattttggtgtttattcatgggccaacgtcccctaattatgatagctgtatcttgaatactgttaatgcaaccacttcaatttgagtggtagatatcttctatttattcttctagatccactctccacattttttaccatagtatttggcaggctgctgacttctgtcagtgacattaattgacttcttgtccttgatcttcttcttccatttggccagtggcaaaccctgggaggagaggggaaggaagaaagtgatgatgtattatcttttttttttttctataatgctaacttcattttgctagtcacttaggaatatttttttacagctgaattgctgagtaagactctacattttccctttcccacaagtactcttgagtttttttttttaataagattataccagccctatgtttatgttagaaaagatgacctaaggtaggagttagaaaaccatatctttttaatatcataaagcagacgctgtcattctcttttgaaaaaattatttcactagtttaacttcactctctgaatgaagccctaactcttttaattgccaggaggcccttcataaattgacagcgcctgtttctctgaccccatttctgtggacctcccctgccctcactccactctaagtacatcagctttctcgctgcttctcaaaaaagatgagcttttccttgcctcctgacctttgcaactgtttgccttacctgccgatcttcttacgctttcttccaccctctccactccccattgaaatgtccaactcaaagcagctctgaccactttcaagaactcctagtatctctctaaccccttattttgttttactttgctataatggacacttaccttttgcgaactttatttgctcatttgtttaatgcctttcttcaacaaaatatcagttgtgagggaaaggactgtctgggttgctttcaatcacattttcaaaccaagaaacactccaggcttgtagtaactgctccataagtatgtgtggaatgaaatataatggaaagcagatgccttcataggttgactgaggcagtgtctgtgctgccatttcattgccctgtggcaggcatcattttcccatcactgcatacttgatttgatttactcttctgactattaattctagttactattatcaatagatgttggcatagatgataaacttcctttccactctttctacatttaaaaccattctggattttttaaaattagaattaaatgcatccagttatataagatattcccaacttttatatatcatgttagtaaacatgttttaaaattattttaatgttacatttgataagctgtcaagaggcagtgttgaacaactttatattgttctcttttctattaattatccttcattttctacaagatttaaataaaatatataatattaaattagcatttactatgttacagacactcttatgagtgttttacaggaattagttcatttaagtctcataacactccatgaagtcagtactctcacttccaagatatgggaattaaggcacaagtaatttgtctgacaaatgcctgggtccagaacctggcagggactgtggagctgagagccttctcccaaaatgagaacagcttgtttctacatcttagctcatgagctcacggtcagtgctcagtgaatgttatttttctttataataataaagaaaataaagattgtattagtctgttttcacactgctgataaagacatactggagactgggtaatttataaagaaaaagaagtttaatgggctcacagttccacgtggctggggaggcctcactatcatggctgaaggcaaaaggcacatcttacatggtggcagacaagacagaacaagagccaagtgaaaggggtttcccttttaaaaccatcagatctcgtaagacttattcactaccatgagaacagtatgtgggataccactcccatgattcaattatttcccacctggtccctcccacaacacatgggaattatggcagctaaaatttcaagatgagatttgggtggggacacagccaaatatatcacagataataatgaaaagtttatgtcctccacaaattcacatgttgaaagcctaatacctattgctatggtatttggaaacaggagcctatggtgattaggtcctgaagttggagccttcgtgatgggattagagcccttatagaaagaaattcataaaagctcctttatgctctctctttctgccattcgaagaacaccaagaaggtagccacctgtaagccaggaaaagggccctcactaggaacctgaccatgctggcaccatgtcggcaccatgtcttagaattccagctttcagaactgtgagaaataaatgtttgtttaagccaaacataaatacaattaaataaaacttaaaattaagtaaataaagatcttacctgagtagaaaattctacacaacagtggagttgaaatatgaacccagaggccacagatgggagctttttattacttcattatgttttccctctttatcatcccaactaaaccatttaaggagtatattttctaatactttgatgacaattaggtgtgcaagtacaaaactctgctgtgctgtgcttggttttcccatttatatattagtagaaggagaaaaacattttgtcatctctttggaaactcaaacttacagagggctgaatatttgttttattatcttttaatctgttgtctacaaaatctcaggggatgaaatattatcctcattagattcacaaggacttactaacttcagaaatgtcttcagagatgtgtttgcagaattgtggctttgtgtttgcataataaaccagcagcatttaaatgacattcctaaatctgttgaagctataatgtgagcaaaattaatatctgagagatgtttataaggaattatttttgttaccagccaagtaattattggcattgagtagattccaggaaagtcttttaaaaatccttccagaattttgagccaagtctgcattctttgcactgccatccaatagaaccctatcacatggaacaattctaattccacacacgttactctagatcttaggtattttaacctacaggaaaagccaataaaactgtattggttttctcaagaataaactgaataatctcaaatatgtaaaccaaatttttcatgttttatttgtaaaagcaggttatagaattggatgatctctaatttttcttagagctttaaaattgtgggatttattaggatatggcaaatattttcatcaaatacagtatcttatggaaacccagacatcataagaagtcctacttacaaaatcatcttaaggccctgcctgatttttagcccagtctttaattattcatgtgtgttccatttatttatttattttgggtgaggaggtgggggtcaagaccctggattgggatgaaacttcaaatgctactattggttatgttttgctaaaaatggatgttttctgaaaacatgaaaaatttatgattttttgacacaataaatggaaaatatggatatttcaaaaactaagggaaaaaatagcaaaaaatatatacaagttttacccccaagagttatgatctctgtcacttgtgcttggtgaactgatccctataattttttttttttttttttttacaaaatataaaaacacattatcttcttttattatttttctaccttttattttagagtcaggggatacatatgcagctttgctacaaaggtatattgcatggtgctgaggtttgaagcacaaatatattcgtcgtctagatagtgaccatagtacccaacagttagtttttcaactcttgcctcctccttctctccttcctctgctggtctctagtgtctgttgttgccatctttgtgtccatttgtacccaatgtttagctcccacttataagtgaagatacgcagtatttggttttctgttcccgcattaattagcttaggataatggcttccagctacatccatgttgctacaaaggacacggtttctttcttatggctatatagtattttagtggtgtatataaaccatatttccttcattcaacccacctttgataggcacgtgggttgattccatgtctttgctatggtgaatagtgctgtaatgaacatatgaatgcatgtatctttttggcagaatgatttattttcttttgggaatatacccagtgataaggtttggctgtgtccccacctaaaatctcatcttgaattgtaatccaaattataatccccatgtgttaggggagggacttcatgggaggtgattagatcatggttccgccatgctgttctcatcgtagtgagtgagttctcacgacatctgatggttttataaaggcctttcccccctcttcaccctgcatttctctctcctgccaccatgtgaaggatgtgtttgcttccccttctgccatgattgtgagtttcctgaggcctccccagccatgcagaactgtaagtcaattaaacctctttcctaagttacccagtcttgggcagttctttatagcagtgtgagaacagactaatatactcagtaatgggattgctgagctgaatggtaggtcagctcctagtgctgtacaaaaataagtagcatttctgtacacaaataatgttcaggctgagaaccaaatcaagaatgcgataccttttacaatagctacaaaaagaagaaaatatctaggaatacaactaagcaaagagctgaagaatctccacaaggagaaccataaaacactgctgaaagaaatcagagatgatgcaaataaatggaaaaatattccatgttcatggattgaatcaatattgttaaaatgaccacactgcccaaagcaatttacagattcaaacctattctgatcaaactacaaatgtcactttttgcagaataggttatgtactttttaactatttggtgtgttacataggtaccgtaactgtaaatttgttttatgtagttgtttatatagttctaaataactaatggacttgaattattttagccatggatatgcatttgtacattgtatttttcaaaatttttatttatttcaaaactgaaatacagcatattattctttacaatgttatttcacaatattccctataaaggtgtttccaataatttcagagataacttttaaaattatatttaagctcctggcacatacttctgataattgcattgcctttctcttttctttagttgctagtagtaattctcaaaaaatacgtttttttctatgtgttcaaatttgcagttattgaggttttaaagggaagatttacacatgtgtgtgcacatgcatatttaaaagaaaacagtttttattttcattggaatattctcataagaaccaaataaactttagcttagaaatttaggacaacgaagagaagattttgcgagaactcagcaaatttaagtgtttctgtctctgctccattcctttcaaatgcataagtacatacagccaatacacacacattatcatttgtgaaatgccatcttgttaggttataataaatgtactaaagagttaagaacatcaggacagaatgtttaaaaataatggctctaaacaattgatcaaaacactattttagtataaaaaattagtttctccaatttctccaaaatcatcttatagattatttagaataatttcaagctgtttttttaacatcaaagagaatgttaatgtaagttgttccactttctgctaatatataaaataatcatattatgtttgaagtgtcatttattagtttttttggaagaagccatagtttatgacctatcttggttactattgatgttcaatgaattttaagcatgtaaatagggcattttcaatagaaaagttcatctgatttctaactattattttaccagtaacaaactccgtaatataattgtccctgggtatatgcaggggatgggttccaggaccgtctgcctataccaaaacccaaatattcaagacctgcagttagctctgtgaaatccaggtatatgaaaagttggtgctcctgatatgtgggttttggatccagaaaatactgtatttttgatccccacgtttggttgaaaaaaatttgcatataagtggacctgcacagttcaaatttgtgtgtgaggttcaactgtgcttcttttcttgcatattatttatttgcaggtacattgcagctaaaattggaggaagaataaatttgacaggtagcaatggaatagtggaaagagtggtccctattttggctgttactactatacagctccttctcttcttgggcatctcgaaacctcccagtgccatcttaagaactgagtgagatgtttcctactcagtatgtattgagtatcagctatgggttagatgctgttctaagcatggagagtacaatgttccttgaggtagatgaggtcccatacatatgggatttacattcaggtgatgaataggacattgcactacaggatggggctggagggcccactggagcataagtagagtgcaacagaagacttcgaggagaaagcccatgtctaactggggccaaaatgctgatgagcaggaattagtcaagcaaaattagtcaaggaagggaggggaagtagagagtaaattactttgtaaatgataggctgctactcaaaataaaaagtacaataattattatcattctaaaaacttgtagacaaaattataatttgcttttctagctcccttaaaaatttttacagctctcaatgtcatatatgcctttaaaggtaagtctctacaagcctaatcactgcatttgataagttcaagagtttataatcaatggtggtctaatgaaattttttaaatgcatgtgtatctcccagacccccaaactaaaaatttcatggaaaaatatgtttacatgttagatgagttatgttaactacttatgtttagccaactagttgtgtggtttcttggaaaactattttcagaggacatagaaacaatgtaaataaaatgaaattataatttgcttccgaaatgttaagttactcttaacgtctttggatatttacattgttgattccaataaaataaaaaacctgcagcttacatcaaataaatcttttattttttgcataagaaaatttttaaaaaatgaattattaacaagttagtggcaagaaacgagaataccagggatccagtagtctaatgtaaataataatataggggaatgtcacatgggtaattaactttgaggcatttcctgggatttaaacagtgttaggaaatttggcaaaacaagctcttatatagctgatgtaaaaatgcacacacgttggcattgtttgaattctgccacttcctctagtttgtccttaaaaaagcaagagcaatacatgataattatagttaatataaatggatatctttaattatttaagattttaatcttacagagaaagtttcagcaattatttttattgtcttcagaacttctttttgcaaggaaagcaattagttggacatggattgaaacgagccaataagaaaacttaagtgattctatttgtcatgttttcaattaccgtattgtcttggagtgtgctctgccagtattttaacaactgacttatcacttgaagtcaaagattcttttcagcatgaattgtaaactaagcatttcaataatatgtgagtgtattttgcacaggatagaacttgtcgtgtttcattatgctctttaactctgaatatatgtaagtcggtgtgtgtgtgtgtgtgtgtgtgtgtgtgtgtgtgtgtgtgtgtgtatgtgctttccctttacatttttaagatttcaagaatagactaattctagtacaaattactctaaaacgattccttgtaaagttaacccaattgtttctctggctgcttttataaaaatttgaaggtttattcacccctcaaccctgcaatcaaaactgattttaaaagagcatctgaagcctagagctggaggaatgttttttcatgtgttttattttggtaattactttcttaatttgtcaggatttttctgactctaaggttttcccttatgctatcaattttttgttcagttttcttaaaaaaaaaaaagaaagaaatatctttataccaagatagcaccaatctcactttcaaagctgccaaaatttgccctcctacattcttttattgtttttaatgtttaattctaaaacagacaaagaaaaaaattgcagcactataattctttttggtagatatctccaatgattcacatttgtgccctggtatattcaataagactactaatctttgcctcacagatccatggaaagaataacatgggaggctattgggactgcctggactgtatgtttttttctgtttcttaatctaatattctaccaatctctctttaaaaatgttaattgatgatcacatctttttctttttaggcatttcaaattttgtaacattagtattctgtatgcttagtgtgccaagtaggaatctgcttaaaatcatcaggaaattttcataccaacgtgttcctcagtaccaaaattgtacaatcatcacatggaataagtttatctagtatagcctcctatgtcatgagtgaattctctttatgcgtgaacacgaaatggatttttctgtatttgcttgactaacacaagtgttataaactcatcattttcaagcaactcttcttgctggaaaacttttgctaaattcctgtaatttgccagtgagtgacgtctgccctgctgctcagtggatcataggaaatagacctaatatttctgccatgtaaaaacccttaactcctttatggtgtgtctgtatcccctcatgcttctctccattccccagtctccttatttactcttctatccatcagactaagtattcataaaaatcttcatttttttctatctcagatatctagatatctacatagtttttttgtttgtttgtttgtttgcgacagtggagttttgctcttgtggcccaggctggagtacaatggcgcgatcttggctcactgcaaactcgcctccccagttcagacaattctcctgcctcagcctcccgagtagctgggattacgggcgcccaccaccacacccaactgattctgttttatgttttgttttgttttgtttttttgtatttttaatagagacaggtttctccatgttggccaggctggtctccaactcctgtaatcctagcactttgggaggccgaggcagcggatcacctgatgtcataagtacatggtttttatttatctcatttaattgtaattattttacattaatatcctgcagcctgaccttcattattaataagtatgagtaaagccattgaatcagtttttctttcacattaccatttatttttctgtattttttttctaaaatttctttcagtaagaaattttgttgaaatccaggcatacggtctatattcccctgtattttctctaattgccttgtcaaaacaaacaaaagaattaagttgagtctggccttaataaactcaggctggcttcctgatatgctttttttctaaggtgttaatgcaaatttagcattttattctagatgagattgtattcacagatgtacacttcacaggtcatttccttgaccaccctagcatttcttgtataacctacaattagtcaaaaagaatttatctaagttcttttcttatgttagggtgtccacttttagtcttagagatataaactgacttagggttgttctgtatatgtttatgttatctttgataaccttgatttttagctctgactaccaagtatttaagtccaaaatttatttacttagaaaatctagccaatgaattaatctatcatccattgacattagatcattagcctcaaggaccaggtttttgtgtttttttccctcttcttactcaaacagagttccaaatctttgaaaattatataatatttctttaaacaatgttatttacaacatggtatcattttatttaaccttcattaaatatactttggttttattttgggcagaacctgatgatatctgaatagtagaactcgtgtggaaattttctcaattttataacgtttctatttttttctctccagaatattttatacatatatggctaacaaattaattttaccttactttctatcacttgttaattaactttcatttaccttttattgatatattggtaacaattgtattttactctatcatttcatatgtaaggtaacttccacatcatgtgtttttccttatcaaaaatttaaatttaactatattctaatgctttcctttttagttatcattaaattgaaataatcaagaccaccatttcctaggacctttttcacttctattctgcctacccatttttttttcatcttgataagaatttggtccagattatatagtatatacatacactgaaatattattcagctttaaaaaacaaggaaatcctgtcacttgagacaacatagatgatctggaggacattatgttcagtaaaataaaccagacacagaaagacaaacactatatgatgttacctacatgtgggttaaaaatagtaaaactcacagagagtagaagagtggttgccaggggataaggggaaggggaaatggggatatgatggtcaaagggggcaacatctcagttatgcaaggtaaataagtcctggagagctagtatcaagcacagtgcctatagctaatgatactacgttgcatattacaatttcctaagtagatagttcttaaccacagagacacacagatacacacatgcacacacagaaaataatagagtgggaggaaacattgggaactgatagatatgtttattgccttgatggtgatgatggtttcaccagcacacttatccctaaactcattgcattgtttacattaaatgtgtacagctttttctatattaattatacctcaataaagcagtttttaaaaaagttttaattagttgctttttctgtttttcaaaaaatgttataagtatagctttcttatatatatttagatatttcttcctagggtcattgaatctaaaatatgtgtaaatcttctttgatacagagaaactccagaaatatggtagaatacagcaatagacttcaggacggaggccaagtgtaaatttaaactctactgtttattaaatttgtggtcttgggtaagtctccttaactctcagatgcaagtcattcatctgtaaacagtgagattcatagacgtgtcttcccaatactaagctgtattgtgatatgacttaaacctctatattaaaaatgagctgtaatttgctttaatttactattttattctgcatggtcttcttattttaaataaaatgtacatttccattattgttttttagttgaatcgaaaccactgaatcttgatcatatctaaaattttacttttacatcttcttgttaaaattacaataccttgttcttcatcacttattcctagtgtatagactacggagaacacagaaagttttctgaagctccttcctattatattatcatataaattaccaggcatgtctgtcttgatcatactttcttcatcaatccccatgtctttcttggtatcctgttttataattttatctaggacttttttctcactccgattctaatttagatttgagtattattgatgagattggaaattctccaggcaggcattttctttctcgtcctcattaggagctctcaggtgccctagccaagcgtctatcacttgggtatattcatggtacagaaagccaaatcacattatgtgctgccagccagcaactgagacagagatccaagctccacagcatcccttatcttccaaatttccaactttcattggaagcaaagatgaaaatgccacctgtgtcccaaggtccttcatatttaaaaagtgggaaaatgtattaaagatatgccctgattttgtcttctaccacgacacactcataggctatcttcagatctcgacagtattttatgtagaatgttattttatttcactctcttcaaagtagtcagttgaagctggtatcgctgtcctgaccacaagtgagaaaataagcagagttgtgaagtgctttgcccaaggacccacagatttttaaaagtagaccagatggagaatccagatcaggtttcagccttcatttccagccagcttttcaacatagacatggcaccactttttaaaattttcctgtcagctactgattatattgtgtatttcaaccagagatgccatgttttgaaatatttgtctatcaaacaaaccacatctgttgagttataatttattttccacttttgctaatcaagcatgtatagcttctcatcatcatttttgatgatcatgagctaaaaaacaagttattaaaaataagttaaataaacctaatcaaaataaatgtatcttggtatttacatcagtcattatacaagtaaatgcaaattttctttaggcttttaaacattttgaaaatgacaatggctttgtttccaacatgagtgaaccagtttaactgtggtttacatcagcctgtgtaactatgatcatacatcattacttgatattagccctggaattaaaagacagattacccagcaatcccatttctgggtatatacccaaaggaaaataaatcattctaccaaaaagacacatgaactggtgtgcttatcacagcactatcacaatagcaaagatatggaatcaacccaggtgcccatcaatggtggattggataatgaaaatgtgatacatacatatatatctcatagaatactatgcagccacaaaaaataaacaaaattatgttccttgcagcaacatggatgcagctagaggccattatcctaagtgaattaatgctggaacagaaaactaaataccatacactatcatttatacgtgagagctaagcattgggtacacttcaacataaagaagggaataatagctagacactgtggactactaagtggaggagacaggaatgggttcaagcctaaaaaactacttattgggtactgtgatcactatctgggtgataggatcatttgtacccccaacttcagtgtcacacaatatacccatgcaacacatctgcacgtatacccccgaatgtaaaagttgaaattatgaaaattaaataaaaataaaagacaaatttgcacgatgttttacccagtatgttagctgaaaatatgtaatgttttaggtgaaaaaagtcagaagttatgcaaaagataaattacacagaaattacaggcatacatgaaatatcagctctgtgtatttttttggcagtcccaagtacctgaatgaatatgaacagtttttgttcttattttctggtgaatgattttttacaataatatgacattatgaaggatcttctaacatgaacataacaacagcaaaaatgggcaaatgtctcaaggttgttaatgacaaatacgtggtggtaatcaatcagtgtcagctcccactgtcaccagctggcatagcaggcctcgtcaacacagcactctaagaaactacaatttacctatgaagttggcacaagaaatggtatccatttttttattcttgttataacttttgtatttctgacaatgtttgtgatatcattttacatgaacctcatacacattctactactcattggcacctcttcccacctattaatgttttggccaacataaaattactggttatctattgctgtatcatgaaccactgaaaaacttagtagctttaaacaacagcagcaatatttattttactcatgaatttacaacttgggtagagttggtggcagcagttcatttgtgctttgtgtgccatcagctgaaatggctcagcttagattgaaggaacttcttccaagacggcccactcaatggctggcaagttgatgctgttatcagctgagagctcatctggggccttactttctcctcatgtgggcatttccataggttactgagactttgacagcacagtgcctgatcccaagtatgaattttccatgacacaggaagtgaatgcagccaatcttttaggtccagagccaagaaactggtaacctgtcacattccaatcattccattggttgaagcagccacaaagccagctcagttttaagaggcagagacagacttctcctctcaatgagaagagagccatagaatttgtagccatcttaatttattatgataatgttatttttatctcaagtcaagagataagagacaaggaagtataatcggttatggtgactgcctatctagtcttcaaatatttagccaacatgcatcaaatttcttgccctacaggaagccaagaattatatcttagctgggcgtggtggcacatgcctgtaatcccagctacttgggaggctgatgcatgagaatcacttgaacctgggaggcagaggttgcagtgaactgagactgcaccactgcactccagtctgggtgacagagtgagacactatctcaaagaaaaaaattatactatatcagttctttaatgatttattttttacattcaaatgattcaatgttactcaataagtgaatgtttgcaaaattattccagataggtataaacttctgatcgtaatcttcttgaggactccaacttgatatttaaatctctatatgcagagacaactcatgtttttgtaaacatatataaattcataggaaaagccatgataaataatagtgacagtaattggtaggaaaaaatatatattgtttgtaaagatgttttatacatatggacttttgtggtctgatatgcatacagttaacaaatgcatttattttatatctcttgcattgttatctatttctgtgtcagaagaaagaaggcattttgccccttttgttctttctacctaaaaccagtatataatgagctatttcattttttcctagtcacgatcaaagcataatttcagtttaattttgagttttaaattttatacctttgacagattccttctgaaaagaatttatcgtgctgaagagagttataaaatgcagtgattaaatatatataggtaaatagatattttaagataaatctatcatatatctctatatagagatcatttattacatatatacatatatgtatatatacatatgtgtgtgtatgtatatatgtgtgtgtgtatatatatacatacatatatatatatggagagagagagaaatattttgtttttccctcaggagggaaatgcattttctctcctggagcagaagcatgtacaggttaagaaaaagatattctaagtgggtagaatagatgactgactattcatctgttctagcttccggtcctgcaagaagtttggtgaatgatagctgaatatttgaagactggatagaaagctaccataatcagccatactgcctgtctctttaggatagtcttcaaggaatccagccatttttcctacccactgatgttgccaccttcagcaattatatgtgtgtctatgggttgaggaataatccactaagcgcacatcagttaacaaatgggtgactttagaggaagaagtttcaatagaagaagtaagaagatgtcaaagatgacatcctgcctcttgtggaagatgggtacaaaccgagctatgtaaaaacctaggagagtaatattctggctatcctttaagactatgttcttgaaatatttgttaattagttatttagagaagacagtggatactgcctatagaaactgtgaaaggaccactggttgctcactgcagaggtgtcgagccacctgttgtccttcacttataacacacctgccatttcctggccatttcctaccatacaccaagcaacttttggacaatttcttccaaatacttatactgtttactggaaagggcgtaaaggaaacaatatattctctgtctcctatgtttccaatgacatagtaatgccttagaaatatttcagtgttttaggaaattgtttcttaacccaggttagtatacagaataagggccaaattcctttatatgggaaacaatacccttcgaaatctgtggcttatatttccaaattaatcttttgctcctcttcatctggcactctttgcttcagcatttttaaaactctgtgtgttttttgttgttgttttgtttttcttgtttttgttttgttttggttttctcttgttttaactagttgttttcttatgcttcaatcttttgtacatgaattcctaagcttgaaatgctgctgcccctgtggttcgccatgaaaaataattcaatttaaagtgataactttaaacaatttccttgacctgtgtatctcttttgttgggtgcttttgccttttggtctgcatttttttattaacttgtacatacctctgtaagaacagatagtgtaaaatgttctttaatatttaatttacttttctaattctttgaagaaaactggtgtttcatgtaggttaactttacattcccatcagctaccatacaatcgatatccaataaatatgaatgaacagtgtttgctgatggccgaccttgactgaagaatatttaataattgagtggttgagaattctgaaaaactttttgaaaacactatggaaattgtcagcctcaatgctggccttcataagcaagtactctttgcttaggttactacattctcccaaccatttgaaactgctgtaagataattatttagcatttatattatgcatgggatcccatctacagggacagtttttccttcttgtactgcagtatttcttatgctataatgaaagaaaaaattattctaaacctgtacgtttagcttaagattaatgtgtctttatcttatctaggtgttttaatccccttccagccttctttccctcccttcctacatccttcccttccttccttccttttccttccttccttttttctttccttccttattcttacttccttccccttccttctttccttccttccttccttccctcccgccctccttccttcctccgtccttccctccctcccttcctttctctctctttctctctttcttttttcctatttccttgcattgcaaagccttccaaataaaactaaatttaatcatgaaattcacacaggatatacagttacaaataatggattaggatgtaattagctatatgtgtgtgagtacaataaaatctcataatcaaattatgtgtatctgtagttgtaaaaacataacattgaaacaccatataaattaatttagagccatttttgatatttttgttagtatgtaataattgttcatatttatggggtacatctatgggatataatcacgtggaaatacataaaagtattgctagcttactgatggctcttagacaattacatggcaccatggacacataacttctccgaaaaaggagtttctcttttgaaatgtgagatgcaatgggagaccctcaaatggtcatatctccaaagttaactcattatgtcattgtctcaaagtacctgaataaagctattttgagcttcagtccccgacggcataaattctcattttcacatgagtggttgcaactattcatatgtactaagatttactaaagtatctttctgtggaggattattataaaatattgcattttctcaactactggcaatctaagtacaccatacttaagaagtcaagtaagagttttggataatcgttttccttcctccagaaactttatttttcttttaaatttaaggtgatttattgggatatactattatctaaaatgtcaaatgcagacaaatttaaatctgagaaacaaaataagcttcagagtggtgggataggatgcagaatcacatgaatccagaatgattgatttaaatacccagcataacctcatcttagttttgctataaatacaacaattaaaacaggctcatttattatcacccccaacccattccaaacttgcatacacccttttaggcaatgcctgattcctggtcttgcaggaaagacttcctcttcaactcttttacttgggtgatgcctactaatccttattatctccactaggcagtctccctaattccccaaccacgtgtacatttttttttctgttccccgtagtatcttgtgaatatctacctctacatttaacagtttgcattataataactattttttaaatatttctcagtcactatactctgaactgttgagagctatactgtatgtctttataaatagaatcaatacaattttgttggctgatcaacaaaccaggcaatatcaaatattatgttggtgcaaaagcaattgcaaatttgccattatttttaatggcaaaacccacaattacttttgcaccgacctaatagaatagaaactaagcccaagcaaagtacaataagaaaatataagcttttgcttaaataattctgataattagtttattttcttctgttacaatataattttactttagtaagtaattttactttaataaaattataactagtaaaattataatgtttaggcaaatataaaatatttttaatgatgatttatttaacttattaattaatgagggaaattttaagataaccaaactgggctaaattgcaattaaggatttagataaagagtatttaatatataatgtaagggcaatattttgaaatttcatacaaaactgaatgatgtctgacagagaaaccgtatttctctgcatattgccctggacagaaattagtttcatattgaacacaagtaacctcattttatgagggcatctctcactagacaaaagtcaaaacgtcactcttactctctgccccacagaggtgtaacataatctagaaattggaaaatcaagcccatcattacactgagatactactcagtgtctattttacctgttttcaacttttacgtaacttgtctgacatttaagttgaggttctcgaattcaaatgccaacacatatcagaaggcagttgaagtgcaacaataaggtaggccatgtttgaacttggaggccagcatattctggtgctttaggaaaatcctgatatcagaattctagtgtaaagacttgtgattttaagatttggtcagtaatttaaaatattttaagactctaggccaaacaaagctctttatggttcgtggaggccaaaagccaccagctcgagacctacgttgtagaatccaacaggcaatccagcttccctacagaaactggattttatacactgatttcttgctcagtacgcagattttttttttttcttggcctttaggaaacacttctgctgtggaaaccttttgagagctaaacttttcccttacaaatttgtctctgccctttcttagtacacatcagtgatgatatttttctctagagcagtatcttaaaaagtcaatagcctaccacccactctgcagaatcaattgaccatagttaaatttttaagttagcctcattttttcaagactatcagagatatatttgtctaagtttaatgtgtttttttaaaaataattttgtgtttccttaggaattagataagaaaaattgttggagcatgcctcatttatccccctagaattttaattaaggaatgtttatatatatttttaatatctaaaaacaattcagtgaatgccgtttacaaatggtttgtgatatatacatttcactagcattccagaaatgtgttaaagcttctcttaatgattcctaaaataatcatagaataatatacatggacatcatagtatattattttgatcttttgaaaagataatggaaaaattgatatgcaaagttaactacaaacagtatataacttattgtcaattctgcaattatcttctggattttaatatataaatacacaataatttctgaagttttagaaatttacaaattaaaaaatagagatcacctgctgtgacagaattggccaggaaggtaaaattttaaaaatagttttattgttttcaattggtttcttagtgagcacaaaaatatggagcaaagacatcactcaggaaggatctaagctatatatgtattgattaggattctcaaaatacagaattttctgaacatttgctttccctagttaaatgagagtttcaaccactttattttaaattagttgtgcaactggtatttaaaaaaacaataataataataaaaaaaaaaactcttcttactgcctaaggaaatggcatctattgtgtgtgtgtgtgtatgaataatctaattgagtgtataaactaccacattataaccgcaagctgtattgaaaaataaatatcagctataagactatgttaacttttgtctttgtggtacctaatctccaaagatggcctcagtgacagagtcctcacagtcttcatgtttttgtgtggtttcttccgatactcaatttgtgacttgtttaaccgattgagtacatgcaatgaaaaaaaagacactttgactcttgcaggtgtagaccttaaaaggggccagccctctctactttttaacataatgtctgatctgccactttttttctcattaaaaaaaaaattgctatctctaccttcttcctcccattgcaaacgccactgaaagtgatttttgtcaaatttacctgtcatctccttgttttaaattcaatgaaaccatttaagtgcataaattattcaacctttgtgtggcactggaaactttcttttattcccagtttcttaaaatagcctctttagtttcttccagtttttgtctttgtccagttgttctcaccctgtttgtggattaccctcttccagagaatgttggtattctcatagatccactatctgctttctcttcttattccacacattctcaagtaattttatctaggcccatggctttaatctcatgttgctgacttcccaaattccatctccattacaatcccatttgcttagttccagaatttcttacccagttgccaacaagacaagtttattggacttttcttcggggtcctgaaaccagcatactcaaatcgcattcattcctgtcctcagcacattccaggtgagagccccgaaacctcttcttattctagaaatagaacatctagttgaataagccagaagccaagattcattcctggctcttctctctttcactttccctgcatgcattgaacctgtattttgtgccctttgttttaaatttcactttaacaattcagtttatttctacctaacaacttgtaataaaacaggttggtgtcatggcagagaatgcagaatagtcagtagttgagttctgctcaaaccaattccagatagataggctcacggaagaagaaccaggaaatccaagggataggacaggtcctcaaatttttctctgcctcagaattgtctcagtaatatgcattcaccaacatctggaggacccaaagttagctaaggagcagataatctcaaggaatctttgtcagaaccatcctccaaaacaagtgcttagcaaactgctctatgtgacagtgcattatgataagagcaagtggccctgtttatgggagcttttggatattaaccagtatctcatcccttaaagatagatgtccctataagtgattgttgaaggtggaaagttagaagtaagcaatagtttgagactattttaagtttaccctcaacgagctggaaatcagttatattttatttggtatttactcatttttcaccattatgtaattcaagctataatttcagtactacttgttgttaactacttgctatagacaagtagataagtaaaggcctaaacagtatctcaaaactaaaagaggagatttcctaagtatactgtcaggagcttcctggccatcgggatattttttagtgttgtcctgtagcatagtcaatcaccaaattctgtcagttctgtcatcacaacatctctagagtaaatgtaatacattattcatttttctgttttagtttaagccttattacgatccaactcaaattactcgaataattttctaaatagccttcctgcttctagtcctgaccatctgcaagtcaattcatttgaaagtttttcaagagggaaagcagtttacttaaccatgtctccactccacagcttcaccccatccccaactgttctaaaccttgctctgctctctaagataaaatctaaatgtatttgaatggctgatagggccttatccagtcaagccctggcctatcttgctagtcccatctcctgccactatttctattcccacttcatcatccactcctctcccactcccagtcccatacctcctgattcattctgcttaattcctgtgtttctccccagactccaatgaggcagtacctctgtcagctttctctgaacctcattaggagtctacagagttacctattcatattgctatccgagcgcagaatacttactgaatttcattacactcctatgctcacttggctctctcttctacctgcaccgagtctcttgggaatccagaccatcttattcattcactgcttagcataattcctgtccctagtggacacgtaataaatatcagttaaatattcaatgaacaaatgaatcctctgtcctcataatatactgctttattttatattctaagactatgcttcagaaaatatagaaatcaacaatgctattctgattaaagtagtaataataataataataataataataatgtttctttatctctggacctaagatgtcaacacaggtaaaacaaaagctattttttaagatattaaacttaggctaaaaaacagaaaaatccacttaatgcaaacagcagctacttatcaaaatataaataaaggaatattatggagaaaataattctctagtgtgcttaattcacccgagcctcaacagtttctgctgagtaaaagctataatgcccaatgaagttttacatttccatagaaaacaaaaattatttccagatgtttgctaagaataaaatatctgtatgtatgcataattggtatcaaaaagctagcaaaagcaattaaaatagctttctgtataatttctcagatattatgaatacatggatgaatacacagggaaagaattaaagagcattacactttgtcaatgttctaaataatggaacatgcaatatatgtcctagaaaatggaatttgacttaaacggcaaaataaaagccaaagaggatgaaataaacagaatcactttctaaaatttcatctctgttctagattccttatggaatttgcagtaggaaaaacttaaatatgcaatgagtatattaaaatccaaaggaaatatcagtacttacttggattggatatcaaaaactaaaagacaaagtcagttgtattagatggctggggaaatatcaggactctgaaaaaaattatttttgctaacaattgtattgtttattcttctacttttactaatgtgaactttgaaggagtatatttgttgctctttgagccctttacagtttttcttgcatatatgctcctttttttttttttttttttttttgagacggtctctggctctgtcacccaggctggagtgcagtggtgcgatctcggctcactgcaagctccgcctcccgggttcacgccattctcctgcctcagcctcccgcatagttgggactacaggcgcctgccacctcgcccggctaatttttctttttttttgtatttgtagtggagacggggtttcaccgtgttagccaggatggtgtcgatctcctaaactcgtgatccacccgtctcggcctcccaaagtgctgggattacaggcgtgagccaccgtgctcagccatatgctccattttttactttatcttcctcaggagcagtggctggcagtgagtgtaggggagattgtggctttcatcatatgctctcctgaactactcataatttctcacttttaatccctcttctgaatctaaagaatgcagtgcttttgaaatatactttgtttcttcatccatatttcaaagaagctatattacagtaacgtacatttcttctagtacttaaataactggaacttatatgacacttgggacaaaactggttcatactgaattttgctataataagaaaagagttatggcaagtttccaccacattgtaatcttatatgtagaaactgtataaagggtatgcaaaaacagtatgcagatgaaaattttcacaattcatatgcaggacaaccacctgtggctttcatcactttctcttcatttaagctaacttcccttgcaaacttccatttccactaatgccagagacagtttaaacgagccagtgaacgttaacctagtctcttctggttaactggagccctttcttgtaaatgttccgtctcatgagctgctcctcactttcttatccccaccaataaagtagctgagagcatgtggctgccattgcagcctcagggcagtgaggatgaaatctctgtttcccgagatgggccctcgatgacatggtttttccgacgtgtggtaaggtcatgaaacacatgcccagcaaatcacatgatgtcattgtctcctctctaaccacactgactcagtgactggtcagaactactcgagtagagcatgcagactgcctctggactaccagctgattttactggtcctcaaatgacatatctaccgatattgggagcaagagttggaacacatttttatcaacttcacgttggggcaacattcaagactgtgatctatgggcttgtaccattaaacagggtattgttcagttcaggtaatgccagactcacttctgtggattacacactggccatgcacagtgcgatcaaatatcggaccttgaggggttggataaaatcctgttttgtcaccagagatagcttgagaatcattttcttatgagatatacccattttcacagctgtaaacaccattactatgctgaaaactctctaatttataactctaccccagatctgtcttctgagctcccaactcagcaaattgcatactcaataatttcatttgcatgtaataagctccccaaacttaatatgttaaaaaccaaatttctgacccccactccaacaaaataaaacaaaatgaaactaaaacctgatccttctcagtctttccatcttagaaatgacaactttgttcttttattcatacaaaattagtgaattcatcaagaagatttttatcttttattaccaccctggtccagatctgacctctctctatcctcctgttgcaatctcctttagaaccttaggcaaaggaatcagcggatctcacagacctagagaggagaaaggtggtcaccagaggcctgcagagagagaggaaaggatgggcaaagagaagatattaatcaaaggttacaaagattcagctagactgggggaataggtttggctgatctcttgccccgcatagtgactgccattagtaataatgtatatctccaaattgttaaaagaatagattgttaacattttcaccccattaaaaaagataaattggtgaggtcatagaatatgttaatttgagtttttctctactatatatgtaaatcaaaacatcacattgtacaccgtaaatatacataattattatatgtcaatttaaaataaagttaaatttcttttaaaagtataaattagataacgttaattcaacactcacaacccttcattgctttccatgttacttattaaatagctcaggttctcaaaatagcccacaatatcttaatgatttcaccaataagcaagcttttcagccaccctgcctctaacttactcgtctccattcacactggcctcctggttgttactctagcatagcaagcacacctctgctcaggaaccttatatttgctgttgcttctccttggacctctatacacgtcaccttttcagatagaacatccctgaagaccctctatagaattgtggccccatacctgtactcggtccctgtaatctcgccacgaaatgtggcaggtttacataatactgtacccttagtgtctagaacaatgtcaggtatttattgagaagacattcaaactttgttgaatgagagaattcatctttgtttgtttgtttgtttgagacagagtcttgctctgtcacccaggctggagcacagtggcgcgatctcggctcactgcaagctgcgcctcccaggttcacgccattctcctgcctcagcctcctgagtagctgggactacaggcacccgccaccacgcctggctaattttttgtatttttagtagagacggggtttcactgtattagccaggatggtctcgatctcctgacctcgtgatccgcccacctcggcctcccaaagtgctgggattacaggcgtgagccaccgcgtccggccgagaattcatcttttgagcatggggctcagctcttgtcactgactgtgaatcgtattgtgctgctcacaaagttcaatggttttcttaatgtggaataattttatgtatgagcagatagaagggaaccaagagtaacatctcaagctcacctaccttgaaaagtccctttgtccttacaccttaccaccgcatactggatgtggcaatgaagtagaacaccagcctagtgttcctcaacctcagcactatgacatttggggacagataattccgtgtagtgggagattgtcctctgcattgttgcttagccgaatccttcccataggcctaacaggtgccagatactagtaacaatgcctacctccgcccctactcacgttgtgacaatcaaaaatgtctcctgaacttatcaaaagttccctggagtcgggagggggaaattgcctctggcctagaagatcttggatgcctccttagcctttgagggatgtgaggatttcatcaggagttttataatttggccttcacctaccacacctttctgcctgagactcagagaactgggaatctgtcctcttaggggctccggttttatccacattctcatcacctcacctttaatttccttgatacagaattctttctacattctcttcctatttggaaggacttcccctttcatcctcttacgagttggttccagcagaagtttggagtaaaattctttgatcagagttgcctgagtctggctcttgatttataaagaaagtgtatagaatttagaaaatattttgatcttccacagagactagctttccccaagtctttttcattcagagactcaaagaagtctaatgtgacagtcaaacaacttttctttgtagctgtcatttgccctccttctaaagcatgggacctcagtgggcaatgagtgataagccagtgggtgttactgtattagcagaatgaaacctataacaatttttaacttaatacaataaaatttggtttacgaaggaggagccaagatggccgaataggaacagctccgggtctacagctcccagcgtgagcgatgcagaagatgggtgatttctggaaatcatctgaggtaccgggttcatctcactagggagtgccagacagtgggcgcaggccagtgggtgcacgcaccacaccgtgcgcgagccgaagcagggcgaggcattgcctcacctgggaagcgcaaggggtcagggagttccctttccgagtcaaagaaaggggtgacggacgcacctggaaaatcgggtcactcccacccgaatattgagctttcagaccggcttaaaaaacggcgcaccacgggactatatcccacacctggctcggagggtcctacgcccacggagtctcgctgattgctagcacagcagtctgagatcaaactgcaaggcggcagcgaggctgggggaggggcgcccgccattgcccaggcttgcttaggtaaacaaagcagccaggaagctggaactgggtggagcccaccacagctcaaggaggcctggctgcctctgtaggctccacctctgggggcagggcacagacaaacaaaaagacagcagtaacctctgcagacttaaatgtccctgtctgacagctttgaagagagcagtggttctcccagcacgcagctggagatctgaaaacgggcagactgcctcctcaagtgggtccctgacccctgacccccgagcagcctaactgggaggcaccccccagcaggggcacactgacacctcacacagcagggtattccaacagacctgcagctgagggtcctgtctgttagaaggaaaactaacaaatagaaaggacatccacaccgaaaacccatctgtacatcaccatcatcaaagaccaaaagtagataaaaccacaaagatggggagaaaacagaacagaaaaactggaaactctaaaacgcagaacacctctcctcctccaaaggaacgcagctcctcaccagcaacggaacaaagctggatggagaatgactttgacgagctgagagaagaaggcttcagacgatcaaattactctgagctacgggaggacattcaaaccaaaggcaaagaagttgaaaactttgaaaaaaatttagaagaatgtataactagaataaccaatacagagaagtgcttaaaggagctgatggagctgaaaaccaaggctcgagaactacgtgaagaatgcagaagcctcaggagccgatgcgatcaaccggaagaaagggtatcagcgatggaagatgaaatgaatgaaatgaagcgagaagggaagtttagagaaaaaagaataaaaagaaatgagcaaagcctccaagaaatatgggactgtgaaaagaccaaatctacgtctgattggtgtacctgaaaatgatgtggagaatggaaccaagttggaaaacactctgcaggatattatccaggagaacttccccaatctagcaaggcaggccaacgttcagattcaggaaatacagagaacgccacaaagatactcctcgagaagagcaactccaagacacataattgtcagattcaccgaagttgaaatgaaggaaaaaatgttaagggcagccagagagaaaggtcaggttaccctcaaagggaagcccatcagactaacagcggatctctcggcagaaaccctacaagccagaagagagtgggggccaatattcaacattcttaaagaaaagaattttcaacccagaatttcatatccagccaaactaagcttcataagtgaaggagaaataaaatactttacagacaagcaaatgctgagagattttgtcaccaccaagcctgccctaaaagagctcctgaaggaagcgctaaacatggaaaggaacaaccggtaccagctgctgcaaaatcatgccaaaatgtaaagaccatcgagactaggaagaaactgcatcaactaatgagcaaaatcaccagctaacatcataatgacaggatcaaattcacacataacaatattaactttaaatgtaaatggactaaatgctctaattaaaagacacagactggcaagttggataaagagtcaagacccatcagtgtgctgtcttcaggaaacccatctcacatgcagagacacacataggctcaaaataaaaggatggaggaagatctaccaagcaaatagaaaactaaaaaaggcaggggttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacttagactcccaaacattaataatgggagactttaacaccgcactgtcaacattagacagatcaacgagacagaaagtcaacaaggatacccaggaattgaactcagctctgcaccaagcggacctaatagacatctacagaactctccaccccaaatcaacagaatatacattcttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccactcaactacatggaaactgaacaacctgctcctgaatgactactgggtacataacgaaatgaaggcagaaataaagatgttctttgaaaccaatgagaacaaagacacaacataccagaatctctgggacgcattcaaagcagtgtgtagagggaaatttatagcactaaatgcccacaagagaaagcaggaaagatccaaaattgacaccctaacatcacagttaaaagaactagaaaagcaagagcaaacacattcaaaagctagcagaaggcaagaaataactaaaatcagagcagaactgaaggaaatagagacacaaaaaacccttcaaaaaaatcaatgaatccaggaactggttttttgaaaggatcaacaaaattgatagaccactagcaagactaataaagaaaaaaagagagaagaatcaaatagacacaataaaaaatgataaaggggatatcaccactgatcccacagaaatacaaactaccatcagagaatactacaaacacctctacgcaaataaactagaaaatctagaagaaatggacacattcctcgacacatacactctcccaagactaaaccaggaagaagttgaatctctgaatagatcaataacaggagctgaaattgtggcaataatcaatagtttaccaaccaaaaagagtctaggaccagatggattcacagccgaattctaccagaggtacaaggaggaactggtaccattccttctgaaactattccaatcaatagaaaaagagggaatcctccctaactcattttatgaggccagcatcattctgataccaaagccgggcagagacacaaccaaaaaacagaattttagaccaatatccttgatgaacattgatgcaaaaatcctcaataaaatactggcaaaacgaatccagcagcacatcaaaaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccgctcctattcaacatagtgttggaagttctggccagggcaatcaggcaggagaaggaaataaagggtattcaattaggaaaagaggaagtcaaattgtccctgtttgcagacgacatgattgtttatctagaaaaccccatcgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaactcacaagggatgtgaaggacctcttcaaggagaactacaaaccactgctcaaggaaataaaagaggatacaaagaaatggaagaacattccatgctcatgggtaggaagaatcaatatcatgaaaatggccatactgcccaaggtaatttacagattcaatgccatccccatcaagctaccaatgactttcttcacagaattggaaaaagctactttaaagttcatatggtaccaaaaaagagcccgcatcgccaagtcaatcctaagccaaaagaacaaagctggaggcatcacactacctgacttcaaagtatactacaaggctacagtaaccaaaacagcatggtactggtaccaaaacagagatatagatcaatggaacagaacagagccctcagaaataacgccacatacctacaactatctgatctttgacaaacctgagaaaaacaagcattggggaaaggattccctatttaataaatggtgctgggaaaactggctagccatatgtagaaagctgaaactggatcccttccttacaccttatacaaaaatcaattcaagatggatcaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagagctaatatccagaatctgcaatgaactcaaacaaatttacaagaaaaaaacaaacaaccccatcaaaaagtgggcgaaggacatgaacagacacttctcaagagaagacatttatgcagccaaaaaacacatgaaaaaatgctcatcatcactggccatcagagaaatgcaaatcaaaaccactatgagatatcatctcacaccagttagaatggcaatcattaaaaagtcaggatacaacaggtgctggacatgatgtggagaaataggaacacttttacactgttggtgggactgtaaactagttcaacccttgtggaagtcagtgtggtgattcctcagggatctagaactagaaataccatttgacccagccatcctattactgggtatatacccaaaggactataaatcatgctgctataaagacacatgcacacgtatgtttatcgcggcattattcacaacagcaaagacttggaaccaacccaaatgtccaacaatgatagactggattaagaaaatgtggcacatatacaccatggaatactatgcagccataaaagttgatgagttcatatcctttgtagggacatggatgaaattggaaatcatcattctcagtaaactattgcaagaacaaaaaaccaaacaccgtatattctcactcataggtgggaattgaacaatgagatcacatggacacatgaaggggagtaccacactctggggactgtggtggggtggggggaggggggagggatagcatttggaggtatacctaaggctagatgacaagttagtgggtgcagcgcaccagcatggcacatgtatacatatgtaactaacctgcacaatgtgcacatgtaccctaaaacttaaagtataataataaaaaaaataaataataaaatttggtttacaatcttcaagaacattataaccattatatataatacatggtaattttcaagtatctcaaacacacatagaatttcatagagaggtataaatatttatgccaaaacacatggtataatgatttctttcctttgattaagaggcatttttatagtgatcattattaaatgaaataaatatttgcatgtggtacagtatacaatcctttcattacgaaatgttattttaaaagtatgtattgggtcctgaatcacgatgttttaaaatgtttgattttaatgagtcattgaatatgtattagcttttatgagatgcacatatttggaatatggctgtattcgtcagcataaggatgatttaaattttcttaaaatagactattaggatgcagatgttcttgctgacaggtgcttctaaagcattaaaaatacatgtaaccacagtgcttttgacaatgtaattctgttgccttcacacctattaagttgagcaatttcccttatttttctcaaacatgcatactaataaagtcatctatcagtgtttacatatatctaataattggaaaattacattttttatccataataagaaaaaagataaatacaattttgtgggaaatgctatgttagctctcaaataatgtaagtttagcagggcctcagggtaacaatgttttaaattaatcttttggtactatacatcaatttatattgaaatcatcaatttatattcaaatacctgtagtgctaagaccatgttttatttgtaatatcccctttaaacctcaagaaagagtccttattctaatctcataatttagtgataaaatgtatattcactttcccatttgtggcataattttcttagatgtcaaacattatttttctagactgtgaaaaacaaaggctttagtactatttatttgactgcgggaatgaaaataacattgttgagtatctgccctaagccaattactgtgctaatgacttttcttttagaatattgttgcctctttattctcttaatcattttaacattctttattttgacccactgcagtaacatttgatatactcatatgttatacgacaagtaaacatttcatttgctcccttcctttgttgatttcataatttcatgttatatgtagatgatgtcttcaggaaaattaatgactcctttattggttaatggagtttatcacttttcataagacaagtttaagtaatgtctatagattctgggttagataaatcagcaaagtttcatagagaaagagggcctgaacctcgaaagttaattatgctttagaaggcaaaaatgagcagcgggtcttttcagaagcgcatagggaatatgtaggattccctaggtactagtagttggccaggttagctgacgtgcatggtatctgtaagagagctgcgaatatggaaagaggatgaggctgcaacattggtgccttcttcattcagagaaggcactggaatgccaagctaaggggtttgtgattttcctgtaggtcctagaaggtgaaaaagtttgatgaaaatttttacacagagaagagaaagtgagtttgttatttcaggctgctataacaaatgatattagactgagtggtttataaatgagagtaatttatttctcacagttcttcaggctgagaagtctaaaaccagggtgccagcatggttgagtttttggtggtggccctctttcggcaaggagactgccaacttcttgttatatcctcacatggcacagagctcaaagaagcaagctttcttgggattctaaggtcttaatcccatgtgtgaaggctctacccccatgacttcatctaaaccctattacctcccaaagcccctctcctaatggcgtcacatagataagtggggtatcaacatatggattcttttttttttcaataggtttttggggaacaggtggtgtttggtgacatgaacaagttctttagtggtgatttctgagattttggagcacccatcacctgagcagtgtacaccgtacccaatgtgtagttttttattcctcaccaccctcctaccctttcccctgagtccccaaagtcccttgtaacattcttatgcctttgcatcctcacagcttagctcccacttatgagtgagaacatacgatatttgattttccattcctgagttacttcacttagaataatggtctccagtttcatccaggttgctatgaatgccaatatttcattatttatggctttttaaaagtaatgtttttttaaaacattatttatgctttatggctcagtcgtattcatatatatatgaatacacaccacattttctttatccactctttgactggtgggcatttgggctggttccatttttaattgtgaatggtgatgctataaacatatgtgcaagtatcttttttgtatagtgattttttttccctctgggtaggtacccagggcacgattactggatcaaattgtggatccacttttagttctttaaggaatctccacactgtttttcacagtagttgtcctagttttccttcccaccagctgtgtaaaagtgttcccttttcaacacatccacgccaacatctattatttttttttaatttttttattatggccattcttgcaggactaagagggtatcacattgtggttttgatttacatttccctggtcattagtgatgttgagtattttttcatgtgtttgttagccatttgtatatcttcctttgagaattgtatattcatgtccttagctcactttttggtgggattgtttttttgtctagttgatttgtttcagttccttgtagattctggatattagttctttgtctgatttatagattataaagattttctcccactctgtgggttgtctcttcactctgctgattatttcttttgctgtgcagaaagaagctctttagtttaattaggttccatcaatttatctttgtttttttgtttttttgttttttttgcattttcttttgggttcttggtcatgaagtctttgcctacaccaaggtctagaagggttttcccaatgttatcttctagaatttttatagtttcaagacttatatttaggtttttgatccatcttgagttaatttttgtataaggtgagagatgaggatccagttttcttcttccacatgtggcttgtcagttatcccagcaccatttgttaaatagggtatactttccccactttatatttttgtttcctttttcaaagatcagttgactataagtatttggctctatttatgggttctctattctgtggtctacatgactgtttttataccagtaccatgctgttttggtgactatggccttatagtataggttgaagtagggtaatgtaatgcctctagatttgttattttcacttagtcttgctttggctgtgcagattcttttctgatgccatataaattttagaactttttcttctagttttctgaggaataatggtggtattttgatggaaattgcattgaatttgtaacttgcttttggcagtatggtcattttcacaatattgattctacccatgcatgagcatgaaatgtgtttccatttgtttgtgtcatctatgatttctttcagcagtgttttgtaattttccttgtagaagtctttcacctccttgattaagtatattctaagtttttttgttcgtttgtttgtttgtttttgcagctatcgtaaaaggagttgagttcttgatttgattctcagtttcatcactgtgtatgtatagagctactgatttttgtacattaattttgtatcctgaaactttgctgaattcatctaccagttctaggagctttatgtatgagtctttagggttttctaggtatagaattatatcatcagcaaaaacagtttgacttcctctctactgatttagatacactttatttctttctctcgtctgcttgctctggctaggacttccagtactatgttgaatagaagtggtgaaagtgggcatccttgccttgttccagttctcagggcaagtattttcagcttttatccattcagtataatgttgactgtgggtttgttatatatggcttttattaccttaaggtatgtccttctatgccgattttgctgaggattttaatcataaaaggatgctggattttgtcaaatgttttttctgcatctattgagatgatcatgtgattttcattttaaattctgtttatgtggtatatcacatttattgacttgttgatgttaaaccatccctgcatccttgttatgagacccacttgatcatgatggattatctttttgatatgctgttggacttggttagctagtattttatcgagaattttttgcatctgtgttcattaaagatattggtctatagttttccattttgttatgtcctttcttggttttggtattagagtgatactggattcaaagaatgatttagagaggattccctctttctctttctctttctctaaaaatattgtcaataagattggtaccaattattctttaaatgtctgattgaattcaactgttaatctatctggtcctggacttttgttgttgttgatgataactttttaattaccatttcaatcttgctacttgttattggtctgttcagagtttctatttcttactagtttaatctaggagggttgtatatttccaggaatttatccatctcctctaggttttctagtttatgcatgtaaagattttcagggtagccttgaatgatcttttgtatttctgtggtagcagttgttttatttctaactgagcttatttggatcttttctcttctttttttggttaatctcactaatagtctagaaattttatttatcttttcaaagaaccagctttttgtatcatttatcttttgtattttttgtttgttttgatttcatttagttctgctctgatctggattatttcttttcttctgctgagtttgggtttggtttgttcttgtttctctagcctccttgaggtgtgaccttagacagtctatttgtgtctttcagactttctgatgtaggcatataatgctatgaatttccctcttgtcactgcctttgctgtatctcagaggttttgatacgttgtgtcactattatcattcagttcaaagaaatttttaatttccttctggatttcattgttgacccaatgatcattgaggatcaggttatttaatttccaggtacttgcatggttttgagagtttcttttggagttgatttcaaattttattccactgtggtctgagagagtacttgatataattttgattttcttaaatttgatttgtgtcttatcatatgatctatcttggagaatgttccatgagctgataaatagaatgtatattctgcagttgttggttagaatgttctgtaaatatctgttaagtccatttgttccagggtatagtttaagtccgttgtttgttgactttctgtcttgataacctgtccagtgctgtcagtggagtattgaggtcccccagtattattgtgttgctgtcaatctcatttcttaggtccagtaagtaattgttgtataaatatgggagctccagtgttaggtgcatgtatacttaggattatgatattttcctgttgcactagtgcttttatcatgatataatgtccttctttgtcttttgatatggtttggctgtgcccccacccacatctcatcttgaattgtagctcgcacaattcccacatgttgtgggagggacccagttggaggtaattgaatcatggggtgggtctttcctgtgctatacccatgatgttgattaagtctcacaagatctgacggttttataaaagggagttttcctgtacaatttctctctttgcctgctgccatccatgtaagacatgactttgcacctccttgctttccaccatgattgtgaggcctctccagccatgtgtaactgttagtcaattaaatctcttttctttccacgttacccagtcttgggtatgtctctatcagcagtgtaaaaatgaactaatacgtcttttttaactgctgttgctttaaagtttgttttctctgatagaataatagataacccagtgctcttttggtgttcatttgcatgaaatacctttttccacccctttaccttaagtttatgcaagtccacatgtgtcaggtgagtctcttgaagacagcagctacttggttggtgaattattcattatgccattctgtatctttaaagtggagcatttaggccatttacattcaatattagtattgagaggtgaggtattgttttattcatcatgttatttgtttcctgaataccttggtttattttcattatgttgttgttttataggtcctgtgagatttatgctctaaggagattctattttggtgtgtttcgaggatttttttcaagatttagagctccttttagcagttcttatagtgctggcttggtagtagtgaattctttcaaaatttgtttgtctgaaaaagattatctttctttcatttatgaagcttagtttcactagatacacaattcttgcctgacaatgtttggtttaacgaggctaaagataggactccagtcccttctagcttgtagagtttctgctgagagatctgctgttaatctgataggttttcctttataggttacctcatgcttttgcctcacaacttataagattatttcctttatcttgaatttagataacctgatgacaatgtgcctaggcagtgatccttttgcaatgaatttcgcaggtgttttttgagcttcttgtatttggatgtctagatccccagcaaggtcagggaagttttcctcagttattccctcaaatatgttttccaaacttttagatttctcttcttcctcagaaacaccaattattcttaggtttggtcatttaccataattgcaaacttattggaggtttgctccttttttaaaaattcatttttctatttctttgtcagattgggttaattcaaaagccttgtctttgacctctgaggttctttcttctacttgtttgattccattgctgagacttgccagtgcattttgcagctctctaagtgtgtccttcatttccagaagctgtgattatattttattttttgctacatacttcactggagagttttccattaatatcctgtatcatttttttgacttctttatgttggatttcacctttctttggtgtcttcttgtttagcttaatagttgaccttctgaatggtttttctggcaattcagagattttgtcttggtttggattcattgctggtgagtaatgtgatcgtttgagggtgttaaagaaacttgtttttgccatattaccagaattgttttctggttcattctcatttgggtagactatgtcagagggaagatctgggactcaagggctgctgttcagattattttgtcccatgggggtcctcccttgatgtggtgctctcctcttccccttagggatggggcttcctgagagccaaactgcagtggttgttatttgtcttctggatctagccaaccagtagagctactgggctccaggctggtactggagagtatctgcaaacagtcctgtgatgtgatccatcttcgggtctttcagccatggataccagcagctgctccagtggaggtagcaggggagtgaagtggactctgttagggtccttggttgtatttttgttacatgctctggttttgcttttgctcgcctccagccaggaggtggcacgttcaagagcacatcagctaaggcagtataaggaggatcaggcagtgggcggggcatacagctcccaagagattacatcctttgtcttcagagttccttgactgtcccatggagcctgtagcagcagtctacctctttcaaagggtctgtggattcttttggctttcctggtatgttcctgcagtagttcttggagcacaagtttacaatgtgggtctccacatgctgctctgtccatctaagtgggagctgcaagttggtccttcctcctatctgccaattttcctccattctcaacatatggattctgaggagatgacaaacatttaatacataataataagatttaataaaatcatgattttataagcagatagaaaagcctgacaaggggaaatattactaagagagtacatctcaaatgttaccataaaaatgtgaaatactggccaggcgtggtggcttatgcctgtaagcccagcactttgggaggccgaggagagcagatcacctgaggtcaggcgttcaagaccagcctgggcaaggtggtgaaactccatctctactaaaaatacaaaaattagtcgatcatggtggcaggtgcctgtaatctcagctattcaggaggttgaggcaggagaatcacttgaaactgggatgcggaggttgcagtgagctgagattccacgccattgcactccagcctggaagccaaaaatgaaactccattaaaaaaaaaaagtcaaatactgaaggtgataaataggttaattaccttgatctaatcatgccatattgtattgaaaaataataacatcactttttgtcccataaatatacacaacaataatttgtcaatatataattaaaaagaaaaagtgatttctagaagatgtttggaaggaaatcagatggtaaatcatatttactatgtctttaataatttcacactgtagccgtttcatgttttaaaaattgtaataaaaataaaaagtatagttctatacttaaattttttcattgaatgttgaactgtccactatgagggttgtggattttagttaatctttcactttggaaatgcctttgcagactaaattttgtttaagtgcacgagttgtgagtaagcctgaaaatagtttccttttttctaattttgcataaaagtgacataaatgccagctgctgcagctcagagcaaagaaaacagataatagatacaggaaccagtaaaacaatgctttcagagaatagtgctgtaaagaaaataaattaagataataaatggtagggcatattttagggcaatgttatgtaattagtaaaaaatggacattccactgaagctcaaagagctacatgttgtatgattccatgaatatatcttctagaaaaggaaaaattataagaacacaaaacagatcattggtttcctggggcatgcagcagcagaagaggtggactaccaagaggcacagtgaggtgttatgggagattagactgttctatgtcttgattgtggtggtaattatattatgtgtttctcaaaacttgcagaattgcaacataaaaagggtacatttttactataaattaattaggaataaaaactaatgaaaaggaaaaacaatgtcctgagaacaggatatatgacttgagatgcgaatgatgaatcccaggcagatggatctgcaagtgaaacctaagccagaacatccttcgtttgtttgagaaacaggaaggcaagagtcgtgtattagttctcatgcggctaacaaagatgtacccaagactgggtaatttattttaaaataggggtttaatcgactcacagttctgcatagctggggaggcctcataatcatggtggaaggcaaaggaggagcagagtcacgttttacatgacatgagagcttgtgcgggggaattcccatttattaaataatcactactacgagaacagtattggggaaatcacctcacgattcaattatctccacctggccccacctttgacatgtggggattattgcaattcaagatgagatttggggtggggacacagccaaaccatttcaggtggcctgagtctcctaaggaaagcaagggtgggaaataatgagatcaggtagcagatggaaactgaacacgaagacatagtactgtgcctgaaataagcttctgtgaattttctgctaatgtagaaggtcattctaggtcctagacagccttgaatctagaggaagaaagagatgacagaagctagataaatggagtaaagaaaaacatccgttgaatataaatccttccttccatggatgccactgccacccataatagaaaatttcatctcattgtaccctttcagaatgatagatatcacatcagacccacccagtaataatgccagtagtctgtttatatgacatgcacaatcattttaaaatcatacacatatatatataaaacaattgtctgtttaaacttaaagataatattgagatatattaaatgtacatttctgccctgtaattccttcacatgttatatgctatgggcaaagaaaacttaataaaggaaaaaaaaaaaacgccactttcagccttttcagttttctcttaggacaaaattgattttgcttttattgacattgtatagattgtgtcaaatttgcatagtaattctaagcctttccagttaattgacttttatatacaatacaaaaaagtccccccatgtcctgaacgtagtggtgaggcaagtcatttgagtgaacacctgcactcctgtatcaatatatatggttgttttgggaggttaatcaatcaatattttaaaataaaaaggtaaagaaaacaatgataaatatcctaaagacctatgaataggtgagaattgaagagaggcagtatggaattgcagtgtatagtgagaattctaaagttagaaaaacaggattcaactttcatatgccacatattagctctgcgattgtaaaaatgttacttaattcctctgattctaatttctcatttgtaaattggaagtaataataaaactatagggtttctttttgaaaataaaatgagatgcagcatttaacacattgcctggaacaggttaactgttagtttctattacttagagcagcacattgagataactcattaaaatatatctaatattttttactctacgggaaatgggagaaaaaaagacgagtatgtaaaaggttttacttcttaagtgtattactagagtaaagaccacaggaatgcatgcttgacaacataagggaaaaatgttttcaatcacattttaagacagcatagctgatgtagaagggtctagaaaagtcatgcagacaaggtcatgcagaaaattccagccttgactcttttggctgggtgatctggggcaagttgcttaatcttttaaagctcagtttcctctctgtgttttaggaataataaaagtactttccttaaagggtggttgttgagaattaaaagagaggatgtttagcatagtgtctggtacactgtcaaggtttaggaaatacagggataagcagaacatgctggtatgcatgaaggtagcatttacttaacacatgttcactgagtgtttactatgtatggggcattgtgatgaagtttgtaagaaacatcaagatgcacaaggcatcatctctgctattatacagcattcactactttagaaattgatcttcctgacagaagagattgggtttcgttctctgtattctcattgcttggcacagtcgctagcatataatatgtgcttagcaatatttttaaattgagtaactgtaatgataaatacacacacctcctttctaatgaaaactgagtttgaggaaagaaaaattgaattcccttcaagggagaaagagatctcactctttagtggctgttttacctgcttccaacagtattattgtttggctgcttttatttgttgtccgctactcctggtggattttgctcctgttattatcgcattcgtcattataattacttctgacccaaccacaaataggtcctctaatttgatcaagatctctctcgatctttatgcaccaagctcatttatttagtatattggctttcaaagtgtagtgcctggataaacagcatcagtatcacctgggacttgttagaattgaatattcctgggacctatcccagacttactgagtcagaaactcaggaggtgggtcacagaatctgtattttaatgagccctcccagcaatcctgatgcactcaaacatttaagaactgctttcatagcttcccccaactgttgtctctctcttaaagtatatgttttttttcttctgccgcggttcttggaataaattatagaacttgagctgaatgaattcttgtaactaaactgaacaatgacatccctgccatgttctgtcccaatagtgggttccacagagtgccaggctgacactcaggccttgtcaggtttcttgtctctagatccatttctgacctttccaagttgtcacctataaaattagattttttttaaatttttatctttctttaagaaagttgatcctggtgtctagaggtctaattctgcaccacagatcagtttcactgtctggtgacttaaagagtcttaatgctgttggactctgttatgttattccattcactgaggtaggcatggaatccctacagcctccctctctgattcacaaatcacaaagtatttagcaatatatggtagatttataatgttcataacagttagtcaatgtgagacattcagcagccagagttcactttccttaggaggtcagcagaggagacttcttggtgatgtcatcacacttgtcttgaaagacctttgagggccagccactattactaaagaaaaaagtataaggtgataaatagagtaatagtgagataaatatatcactctattctcaggagagtaggaagtcagatgatcttacctaactatttgacctgacactattttttgaaaaaaaattctaatcttaattgtagttctcatttaaagacctgaagagttttttgtttgttcatttgtttttgttttttatatttgtgcttaagctatttcaaagcttatgaatggaaattattttataaatcttttgattcatagaagtttcaacccataacactgaaggaaaatattggcatgccaagaattgtgattccatacaggaatagaatgtcatgcaaaaaaaattaaaaatgtatgttttctgattaatatgccatattcttattttcctggacctttaaaaatcataagaattgctatggatcagcctcacacaccactctttggatggttgtaagttctagtagaagtacatagtgctgacccttttaaaatttctctgttttacacagagaatataataatatatgcacccatattgacttctcttacattttttttctgaaaataatgagtacatctactgttgaagcaaatgcaaagattaatcacttgtaattttcccatcatatatataaatcgcacctttatttctggctttcacagaaagtaagtttcaaaatgagtttcaataaatacatattatcaaagttaaacatgagaatgaatttactttcattaaaaatcaatgttggacattattattaagaagagcaaggtgacaaaaatgtagtggaaatcaatgttggacattattaagaagagcaaggtgacaaaaatgtagtggaaacatccaaatagtcaaatgatctattgttatgaatttacctacgttaaattgatcatttgttaattatgttgttatgttaattatattatgttaattatgttgttaatttgatcattagtgagggaggaagatccagtagttaaagaaggcggggatgctaactgtccttgctatgtagtatgtcacaaggaaaactggtctcagagcaaataacattaaaagcaggcataacaagtgtcataccactctctaagctctattaaattccagatcctgttctttttgatgctctgacaacaccttgaatgtttacttgagatataattcataatattgtagcagcaacattcagctaaccttttggtcaaaatcagggcacatacaaaatctccaaataagcttccgaacacactgacaattcaattctcaaggttaaggtgacaatccagagggctgtaagttattgagatctctgggtccctctacttcattcttttgtgcagaagcaattgtatggcacttctatcttgtccaaactggaagaccagccgtttcactattcaatttgaaagtatgcttatgttatttatcaagcctctagccttgattggagataataatactcaaatgcttatagtagctgactgtggtacatggcctttggattacaattctttagttgctagctaaccaatctttcagaatattttattattaaataactaaccatgaattcttatatttctgattagtacgtttcaaattgtatattaaaaccaatctgctgtgtacatttgtgtgtgtgtgtgtgtgattcattgacaatataacaaaaattttaactttcttgaaaaggatactcttctcctctaacagtactcttctttagtctgtttttagctgtcagtactttgtgtagaaaaatttcctctgatatttgtttataattccaactgagtttatgtctgaatttgaactttttaaacttttccatgaattagactgtgagtttcctaggtagtaagcttttgagcacttatcgtgatgcctgacaaattacagatcctcaataagtagttgtggaatgaatgaatgaattcttgaacgggcctccttccacaattttagtactcagtctattacccaggcttgtgatctctgaaatattttgtagcttttgaatgttatctaacaaaacaatttttaaaacaatcaaaatatttaagtgacttttgttacagtaggaatgatataaagtctatgaattaaatttcacctaaatataaatattacaaagttgtaagggagctcttctagaacaaaaccaaacaaaaaagtagtttatctgtatacaatccaaaaatatggaaatcacttttcttgttcaaagataaatacattatcaaaaaatgtgatacattttagagcttctattgctcaatggatatgggaataaaataagaaaacacaaataacttcgattcagcctttaaccccgaagccacatgtttccactaacaagaagaaatccttgagagaaactttcagcaaaaagaatgttgacagaagagctttgagttagtcctgggtctttgcttaatgagataaagaagcaatcttggcagacaacttactgtaaaattccaacagtctttctcttttcatgtcatcaaaactttaattttctaaatctgtttactgggaagggcaaagagttctcctgtaagacttagatgtgtattttaagttccaagaactgatgagttataaccttgaaactgggaaagctttcacatttcttaaaatgtattgtagaaaactgttttttagtctcttaaagttgaaaactgtatttgctgaaagaggttggttttgcttaccatcatgtggcaatttatcattgaccatgacccagtgatctagctatgattaagtaaatctgatttaaaaagtctgcagtttctccagaattagaaatatatataatgatatttcccttgaaaaacttattttgtaagtaaaagcagtatctaatagattaactttaaaacataatgtaaaatctttttgtgtaaatacaatatacaatttgtataaagatatacaatatacaatttgtataaagatatacaatattactcctggaataatagcatgcatgcactgcctttttttcgttaaggtaacacatttctatgacatttttaagaagaaattgttttaaaatatctatgctaaaaacatcattacttttcttggtcctaaccctgatcaccagtctctggaagcaatcactttcactttaaatgtgtgtgtgtgtttgtgtgtgtgtatgtatacatgtatatgtcttgggcactttcttcagagaatttcacaggtgtaaatggaataatcaggacatatctatatctctttatatatttctatagagagagtgtgtgtgtatacatatgtatatatagttacagtgtatatatagagaaagttatataatgtgtgtgtatatatatatatatataaatatatatatgtatatgcatataattttccttataaaatatccctcctgtagtcctccatcctcctgtttctacctgcattcttcactgcctgggctggctactcctggtatttctctttgtcattgccctgattatgagaggctaaacaaaagtcatagatactttgtaaaacaatgaccagtgtaaaaataaaaagtaaacaagtgtccaaaagttctaatgggtgaataatattcaactgtattgttttaccataaattttgcaataaaatccctgtcattatcatttaagttcctctttacttactaacatttctctaaacagtcttgcataaaattgatttgtgtaattttctaagcactgtggatatggatatgtttccatggcaaaattttaatgttggtcgttctgggtgatgtgttcataggctattttattttaatgataaaatttgttcaattcgggactcgcagccaagatggccaaataggaacagctccggtctacagctcccagcatgaacgacgcagaagacgggtgatttctgcatttccatctgaggtaccaggttcatctcactagggagtgccagacagtgggtgcaggacagtgggtgcagcgcaccgtgcacgagccgaagcagggcgaggcattgcctcactcgggaagcacaaggggtcagggagttccctttcctagtcaaagaaaggggtgacagaaggcatctggaaaatcgggtcactcccaccctaatactgtgcttttccgacaggcttaaaaagcggtgcaccaggagattatatcccgcacctggctcggagggtcctacgcccacggagtctcgctggttgctagcacagcagtctgagatcaaactgcaaggtggcagggaggctgggggaggggcgcctgccattgcccaggcttgcttaggtaaacaaagcagccaggaagctggaactgggtggagcccaccacagctcaaggaggcctgcctgcctctgtaggctccacctctgggggcagggcacagacaaactaaaagacagcagtaacctctgcagacttaaatgtccctgtctgacagctttgaagagagcagtggctctcccagcatgcagctggagatttgagaatgggcagactgcctcctcaagtgggtccctgacccctgacctccgagcagcctaactgggaggcaccccccagtaggggcagactgacacctcacacggccgggtactcctctgagacaaaacttccagaggaatgatcagacagcagcattcgcggttcacgaaaatcctctgctctgcagccaccactactgatacccaggcaaacagggtctggagtggacctctagcaaactccaacaggcctgcagctgagggtcctgtctgttagaaggaaaactaacaaacataaaggacatccacaccaaaaacccatctgtacatcaccatcatcaaagaccaaaagtagataaaaccacaaagatggggaaaaaacagagcagaaaaactggaaactctgaaaagcagagcgcctctcctcctccaaaggcacgcagttcctcaccagcaacggaacaaagctggacggagaatgactttgacgagttgagagaataaggcttcagatgatcaaactactccgagctacaggaggaaattccaaccaaaggcaaagaagttaaaaactttgaaaaaaatttagacaaaagtataactagaataaccaatacagagaagtgcttaaaggagctgatggagctgaaagccaaggctcgagaactacgtgaagaatgcagaagcctcaggagccaatgcgatcaaccggaagaaagggtatcagtgatggaagatgaaataaatgaaatgaagcgagaagggaagtttagagaaaaaagaataaaaagaaacgaacaaagcctccaagaaatatgggactatgtgaaaagaccaaatctacgtctgactggtgtacctgacagtgatggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcaattcaccaaagttgaaatgaaggaaaaaatgttaagggcagccagagagaaaggtcgggttaccctcaaagggaagcccatcagactaacagcggatctctcggcagaaactctacaagccagaagagagtgggggccaatatgcaacattcataaagaaaagaattttcaacccagaatttcatatccagccaaactaagattcataagtgaaggagaaataaaatcctttacagacaagcaaatgctgagagattttgtcaccaccaggcctgccctaaaagagctcctgaaggaagcactaaacatggaaaggaacaactggtaccagccactgcaaaatcataccaaattgtaaagaccatcgatgctaggaagaaactgcatcaactaacgaacaaaataaccagctaacataatgacaggatgaaattcacgcataacaatattaactttaaatgtaaatggactaaattctccaattaaaagacacagactggcaaattggataaagagtcaagacttatcagtgtgctgtattcaggaaacccatctcacatgcagagacacacataggctcaaaataaaaggatggaggaagatctaccaagcaaatggaaaacaaaaaaaggcagggtttgcaatcctagtctctgataaaacagactttaaaccaacaaagatcaaaagagacaaagaaggccattacataatggtaaagggattaattcaacaagaagagctaactatcctaaatatatatgcacccaatacaggagcacccagattcataaagcaagtcctgagtgacctacaaagagacatagactcccacacaataataatgggagactttaacaccccactgtcaacatcagacagatcaacgagacagaaagttaacaaggatacccaggaattgaactcagctctgcaccaagtggacctaatagacatctacagaactctccaccccaaatcaacagaatatacattcttttcagcaccacaccacacctattccaaaattgaccacatagttggaagtaaagctctcctcagcaaatgtaaaagaacagaaattataacaaactgtctctcagaccacagtgcaatcaaaccagaaatcaggattaagaaactcactcaaaaccgctcaactacatggaaactgaacaacctgctcctgaatgactactgggtacataacgaaatgaaggcagaaataaagatgttctttgaaaccaacgagaacaaagacacaacataccagaatctctgggacgcattcaaagcagtgtgtagagggaaatttatagcactaaatgcccacaaaagaaagcagaaaagatccaaaactgacaccctaacatcacagttaaaagaactagaaaagcaagagcaaacacattcaaaagctagcagaaggcaagaaataactaaaatcagagcagaactgaaggaaatagagacacaaaaaacccttcaaaaaattaatgaatccaggaactggttttttgaaaggatcaacaaaattgatagaccgctagcaagactaataaagaaaaaaagagagaagaatcaaatagacacaataaaaaatgataaaggggatatcaccaccgatcccacagaaatacaaactaccatcagagaatactacaaacacctctacgcaaataaactagaaaatctagaagaaatggatacattccttgacacatacaccctcccaagactaatccaggaagaagttgaatctccgaatagaccaataacaggctctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcatcctgataccaaagcctggcagagacacaaccaaaaaagagaattttagaccaatatccttgatgaacactgatgcaaaaatcctcaaaaaaatattggcaaactgaatccagcagcacatcaaacagcttatcaccttgatcaagtgggcttcatccctgggatgcaaggctggttcaatatatgcaaatcaataaatgtaatccagcatataaacagaaccaaagacaaaaaccacatgattatctcaatagatgcagaaaaggcctttgacaaaattcaacaacccttcatgctaaaaactctcaataaattaggtattgatgggatgtatggcaaaataataagagctatctatgacaaacccacagccaatatcatactgaatgggcagaaactggaagcactccctttgaaaactggcacaagacagggatgccctctctcaccactcctattcaacatagtgttggaagttctggccagggcaattaggcaggagaaggaaataaagggtattcaattaggaaaagaggaagtcaaattgtccctgcttgcagatgacatgatagtatatctggaaaaccccattgtctcagcccaaaatctccttaagctgataagcaacttcagcaaagtctcaggatacaaaatcaatgcacaaaaatcacaagcattcttatacaccaataacagacaaacagagagccaaatcatgtgtgaactcccattcacaattgcttcaaagaaaaaaaaatacctaggaatccaactcacaagggatgtgaaggacctcttcaaggagaactacaaaccacttctcaatgaaataaaacaggatacaaagaaatggaagaacattccatgctcatgggtaggaagaatcaatatcgtgaaaatggccatactgcccaaggtaatttatagattcaatgccatccccatcaagctatcaatgactttcttcacagaattggaaaaaactactttaaagttcatatggcaccaaaaaagagcccgcatcgccaagtcaatcctaagccaaaagaacaaagctggaggcatcacgctacctgacttcaaagtatactataaggctacagtaaccaaaacagcatggtactggtaccaaaatagagatatagatcaatggaacagaacagagccctcagaaataatgtcgcatatctacaactatctgatctttgacaaaccggagaaaaacaggcaatggggaaaggattccctatttaataaatggtgctgggaaaactggctagccatacgtagaaagctgaaactggaacccttccttataccttatacaaaaattaattcaggatggattaaagacttaaatgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctagtatccagaatctacaatgaactcaaacaaatttacaagaaaaaaaaacaaacaaccccatcaaaaagtgggcaaaggacatgaacagacacttctcaaaagaagacatttatgcagccaaaaagcacatgaaaaaatgctcaccatcactggccattagagaaatgcaaatcaaaaccacaatgagataccatctcacaccagttagaatggcaatcattaaaaagtcaggaaacaacaggtgctggagaggatgtggagaaataggaacacttttacactgtgggtgggagtgtaaactagttcaacccttgtggaagtcagtgtggcgtttcctcagggatctagaactagaaataccatttgacccagccatcctattactgggtatatacccaaaggactataaatcatgctgctataaagacacatgcacacgtatgtttattgcggcactattcacaatagcaaagacttggaaccaacccaaatgtccaacaatgatagactggatgaagaaaatgtggcacatatacaccatggaatactatgcagccataagaaatgatgagttcatgtcctttgtagggacatggatgaaattggaaatcatcattctcagtaaactattacaagaacaaaaaaccaaacaccgcatattctcactcatagatgggaattgaacaatgagaacacatggacacaggaaggggaccatcacactccgtggcctgttgtggggtggggggagggggaaggggggagggagagcaataggagatatacctaatgctaaatgacgagttaatgggtgcagcacactagcatggcacatgtatacatatgtaactaacctgcacattgtgcacatgtaccataaaactttaataataataaaattaaaaaaaattgttcaattcaaattttcaacaatggacatgtattcgcatttataattttgaaaagaaaaaaatggacaatggtatttttatactattttaagctccccaatggcagacattattttcactgaatcatgaccaagtcaagttcagtgctgggaagaggggacttacattaaatatataatcagttacttccaggctctgcctcttattggataaggatagacactgtgacatcagagatcaccgtgctgtggaccgaacaaatgccatgtaaacagtgaccatgaccttttatgatcactgtctttctggaatttgacaaactcagagaaaagtttagaggaatgtatagactaaatagtccatttgctattgtgacattgatgatgaaacctttaagaaacttttgatttaaaatgtgttcatgaccttgtgttcataatttcacaattgagaggcgtccctccacattcttggaactgtgcacccattggaacctttaaggtaaatctaaccagggaagtttctcctcagaagaagatggcatccttgatgtgaacagcttttcccaagatcatgaatcaagacttctgtactatcttgagactcttatctttgagtaatttttccccttgtttaggcctctatgaacaatagaaatgaaaagaggtcttctgtgtgcacttactgggtatacttttacttgtgaaggatttggcagccagacttatatgtagataaccttatattttgatagataaaatatgaaagcccaatgtaggtgagagacttaaatggtacatacgttgcctcataatcagtcagaaacagaactttggttcactccctttgacccacatcatgtgttaaagagaaggttgccaggaggccttcactcttctagaagggcatcatttgttaggtactttttccatggtttggagtaaaagaagcaatgattagaaatgtatccctcatgataagctgtctagcaaactctactttaaaggctataattacacagcagattttaaattctcttgtgaaagttatgctaaataatcgaattgctttagattgctgactggctaaacagaagtatctgtgcagctgctggcacttatgtcttgtggagaaagcattgggtattacagacactcagttgtaggggattaagaagaggactacttaatcaagcgagtaaactctttatctagctcattctttgatctatttgattttaagtgatttggtttatggagaccctagtagggaccatactttcaactcttggtgttatcctcccgatagtcataatagaagtctccctggtgtgctgtatgctctcaaaggttttaaatgtttgcattcagacatctccagaatgtcaggtagtctctcttcaacagaaatgacaagagctgaaagaactatgcaaccatgggaaaaccgtaatctatgaatgaggtgctaagaccggaaacccaaaatgatggtaactgagagtagcattaaggccctaaagtttggtcacactctcacctaaatgagaacctgaccaaaaagggggaattcttaaaacaaaattacgggaggctattgtttggactgagctcaatcactaggcaccaacagaagaaactgtataaaaatggagtcacttgtgctaagtgtgacataatcaagctaagactttaaggaaacacatagatcctagaacagacgaggttttgtttttctcctgcaaacaggacgtttctgtataaggaggtaccatctactcaatcctcattcccaccttgcaaaacccactgttctactgttttccagtgggtttcaagaccaaataagtacatttacgatggtgatagtgacatcgatgaataaagttttggccaatctctcaaaattgagaaaatgaccaaaagcggggaattgttaaagcaaactaactgtggcctaagaaggactccttacttttatatctgagtccttgtggatgaaccataacctaacttaataggtagacaagattgaaaacctgacttagaagtatgggattgtcacaatatctgaatcttggcaaatcccagcagccatacttcaaccagtcatagactgctgagtgtttaaactgtgttcaaagagggcaaacactgaactgtaaccaatccagttgtttccatacctcacttccaatttctgtaggccacttcccttttatgtctatagatcttcttccaccatgtggctgtactagagtctctgtgaacctgctgtgattctggaggctgcctgattcacgaaggtttcattgcttcactaaactcctttaaatttaaaataaaataaaatgtgttcatgaacatgagttctaggttggttttggcagttttgtaagatcaataaaagcttcatttaatttatttgaaaacagtgtttaggaataccccaaagtatgttctcacatcgagggatttagaaagtgaaaaccggccgggcgcagtggctcatgcctgtaatctcagcactttgggaggccaaggcaggcggatcacgaggtcaggagattaagaccatcctggctaacacagtgaaaccccgtctctacttaaaaaaaatagaaaaacttagcagggtgtggtggcacgcgcctgtagtcccgggaggtggagtttgcagtgagctgtgatcacgccactgcactccagcctgggtgacagggtgagactcttgtctcaaaaaaaaaaataaaaataaaataaaataaaataaataaaagcgaaaaccgactgttaatacttgtacactttcaaaatgatgaatattttaaagtttaagttgttctcactagagttaactccaggatttctttatttctgttaagaagaggaaaccttgctatgggtagtgcttttctcacaagcttttctcacaggggcacttgcctgaaattatgtggtttattttggtttataaaaagtggctgggacaaggctgcaaaggttggtagtaaagtacctgacacctgccctggaaacttccattggctcttgctcttacttttattttattaaaaaaatgcacgtgtaagagagatggtgttgaatatgttgtaattataaataatgccaacctaaaataattaaaaagggttagaatctagtttaataagagtttattcaagcacaaagtttgaagacagccactcaggaagcacaggttacaaagactaaaagtcagtgttctgatggtagaagcttagggttgtttatagagacaaagtttaaggaagctaaaaagaatttcaacatctttctgtacaaggctggatgcatatttacaatgatctgattagttgagactgtatttttctttcaggaagggtatatttaacattccaccctgaagatgtaacagtcatgaggtcgtttgaaccatctggtctgagttaggtacatgacaataaaagaggtagttaatctataacaaagataagtgaattgaaggggtaagatgtctgatctctagtctcccctagtcatttacagagcaagaacaatgaagaagagagtaaatctataatctaagaagctgaacttgcacacatactatgtgactcatctccaaagcttaactttccccttggcgtaataaattaagagcgtcctaaaattacaatccacagataagtatagatacagcgctttatatgtgtgtgtttatatatatctctctgtatatttacatatataatatataagtagtagaagtagaagtagttttatatattatatatacatatatgtgtgtacatgtatacatgtgtgtatacatatgtacacatatatatgtatatataatatataaaactacttcttttgtacattgtattctgcttctaagaatgacatcactgcaaaaacaaatccctccactccacatccatgttacagtgaaacatttctcattaatgctccatcacttattaatttaaatgttagattctgtttagggtattatgtttataatttttattctgattgccatgtaaaaatatttcgttaaaatattgtaaagtatttttgaaatgtcttgctaatcttattattctgtatattccttattagcccatcagcttctcgagggacaaaaaattacgcatttcatttttattttgtgtgctcaaatctattgtcttattcatcattcaacaaatatttattgagcttacgatataccaagccaagcattagatattggtagtcccagaaatctaacaatcctgatgaattgagtgattattgaaagtgaatttacaaattcatcatccttctatctaagttttagtgcagaaagacattgtcaatgcaggctagcctttactgtaggacaaatggaaacctgacatttacaagaaaatataatttcataatgtatctaggaggaaaaatatttatcactgccaacccaggaaaaaatagaaaacttaacaaatgctaggtattgaccaaagaaacacatgatcaactgtaaatctacccccaaatgagaaaaaatgcattttttcttctactagtagctctaagcaagcggcagtctacaatgttttttcttgttctatagtatgtttcagaaactcacaataggagttcgttttgaattcttctgtgtagctcattttccatttggggaatctatttcttatccatttgtccacatctataactagcaaatagagaattcaatatagcaaatgtgcctacagtaaattcaaaattgcctctcatccatttgtgagcaacacataaataatgaaggcgacattaaaacttcgggtttttttatttttacttctttctctgaaatatcttttccagcaaaataaatggtttgaaataattatctatttagaagcactgcaatagctgtgggaatgtgattgccatttacctttcaggattttacggttcccatgagaagaagaaattttttgattccttgattctcttttccttcattatacttcattcttaacccatcagttttttaatttgcctgtaatagatggggctcagtgtctcaagagcatcccaattttatggttatagaaaccagacttagtagacaaaatgtttccttttgagcaaagacttagtggttttagcacctacaaaaaaactaaaggaataaaatggaaatgcaagggaaaccaaaatgcattaaaggttaaatttttcaatatttgtatttctttcttaacttggcacaaatgagattttttttcagttttttacattttatttttgactgctttgaatagtgtcggcttgccaaagtctcaccggactaatgcttacagcagaatttaacacattgccaaactaaccctgaggtgtggtttacactacagaaaagagtgttttggcacaattgccaatttagaaagtacgaaaggagtggcagaacttattgccatagagttagaattttacatctatactgcctattttttaaaatttaatatttcattgatgtcacgaaaaacattctcatgcgtcatattttggtccctttctttttttatttttattatttatttatttattttttgagatggagtcttgctctgtcgccaggctggagtgcagtggcacgatttgggctcactgcaacctctgcctcccgagttctcttgcctcagcctccctagtagctgggattacagtcgcccgccaccacgtccagctaattttttgtattttagtagagacgggtttcaccttgttgtccaggatgtcttgatctcctgacctcgtgatctgcctgcctcagcctcccaaagtgctaggattacaggcgtgagccaccgcacccagccccttatttttttaacagagtgttaaaggtggagtgtggaaggtcttaataaattatgtgtttgctgtgtgtatgtattaccatattacacatgcagtgataagaagccattctcatgataccttgttggccaaactgggttgaaattgaatttaagctccacagagattgtgactacacattagtgtagtaaatatatatatatacacacacacacacacacacaatatggtgtgtatatatatacacacacactgcactatatatatatacagtcgtatacatacagttgctgtatatatagttgttatatatatgtgtgtgtgtgtatatacatatagagagaaagagagagaaagagagagagagagaattgttatattatcttgctaaatgggccactttctaattatataattaccatctttgtctctttttacagcttttgacttaaattgtattttatctggtttaattctagctattcttgctcttttttaaagtttctatttgcatgagacatctttttccatttctgtactatagttaggtcctatttttttaaaccattcagccacttcttatcttttggttggataatttaattaatttacattcaaagtaattattgataggtaataacttactacactatattgttcattgtttcccagttgttttgaagattctttcttcttctcttactgtcttctttgtggtgattttctctagtggtacaattattttgttgctttttatttttagtgtatcaaagttatttgctttgtgattatcatgaagcttgcaaaagtcatcttacagttataacaggatattttaagcaaaagcaacttatctttgatcacaaaaaagcaactctacactttaactctacttcccctctacatttcaattttggatgtcacaacttttatcattttatattggataatccttaacaaattactgtagtgattactaatttaatagttttgtcttttaaccttcatactaatgatatacatgatttacacaccgccattatagtatgaagatagtctgaactttactttgtattttctcttaccaatgagttttattctttcagatgtttttgtgttaatcttagtgtcctgttctttcaactcatagaaccctctttatcatttcttctaacacaggtttggtggtgatgagctccctcagctttgtttgtctagaaaagtctttgtctcttttttatttctgaagaacagttttcctgggtatgctactcttggttgacagatttttttttttcttcagcatgttggatatattatccaaatcttttctggactgtaagatttctgctgagtgtgtctccagttaggtatattggaacttccttatatgttatttgctgctttagtcttgctgttttcagaattctctctttgtcttcaatttttgatagtttgattttaatatgtcttggggtattcttatttgtatagaatctgaatgaagaactttgaccttcctgtacctggatatttttatcttttcctgagtttggaaatgtttctgctcctatttctttaaatatgctttctattcttttaatatttctctttcctttatttaacttctataactcatatagttgcttttttgatgttgtctcataattcttatgcacactggaatggaatggaaaaataccttcaaaattctatgaagaaaaaatatagatgtaaaattctctacataactaaactatcagtgaaacagtgggttagatgaacaaatttatatatgctggagcctaaaagaaaaaccaactttactcacttactctccctcagcagagagaataagatatgtgaaggcgctcatcaaattcaaataaatgacattacagttattgaaatatataatacatgggagaatgaaagaagattgggaaaaaggagtgaggtacaaggactattacaagaatgtggctgaaaaacagaaaatgtttcaaaatgattgtaactgttattacaagctatatatcagttattattaaaaacaaaaaacttgcataaattaaaataaaaaggccgacactgcagtgggaggaaaaggacaatatatatgcaagaataacttactgaaaagacacaggagtggccaatgaaaaacaaagaatgcatgttcaacctatcattaagaagaataataaatgaaataccacaattacctattgactgagaatcaaatttatgtataatgccaatgttagtgtgttttggagaactgccaatgccaatgttaattgttataatctttccaaaatatcgacattgaatgttgcctgcatcaacactaaaataggcttaatctttgaccttactattccaccttttattataaatgattgggaatagctcttaaaggacattgaaatgtttctattacaacataatttatcacagtaaaaatttagaaatagtgttcatttttacatgttggcttaaaactgtaaaataaaatagagtgtacaattaacccttgaacaatgtgagaattaagggcacagacccccctgtcatgcagtcaaatacccatatataatttttgactcctaaaaaacattatagcctactgttgaccataagccttacttgtaatatagtcaattaacgtgtattttatgtttatgtattatatactgtattcttactttaaagagaaaggaaaatggtattaagaaactcataagaaagagaaaatgaggccgaggcaggtggttcacctgagatcaggaattcgagaccagcctggccaacatggcgaaatcctgtctctactaaaaatacaaaaattagccgggtgtggtggcatgcacctggaatcctagctactaggcaggctgaggcaagagaatcgcttaaacctgggagacagaggttgcagtgagctgagatcatgccactgcactccagcctgggtgacagagtaagattctgtctcaaacaaacaaagcaaacaaagaaaaagagagatagagaaaatacatttacagtactgtactgtatttatcaatactctaagttacatcatctgtttacaaggtgaattgttggtctgaagtagtagcaaccgcagctgcaggcttctgtctatggtacatatcatgccatttagcttttactggtgatgtcatgacttttctctgcttcttgggagcacttcgagcatcactagtggcaccttgtatgggccccatggtgtcattcaagatttacagtattgcactaaaaatgataagaactacaggagaactgagagaaattacttactactgcaatactcaattactggagagataaactgcttacatgaagatgattagcataacacagcattttaggaggatactgacaacaccagctcaccgcaatagcagtaactataaagttattactatagtttaatttgtactatagttaattttatagttatgatttaatactgcacctttacttttgtttatatttctctcaactgcaaatggtaccatatatggtctgcgtttctgtgtgtaagttttgataaatttgaacttttcatactagatttgtgtatcatttatggtagtaaattatgaaatagacgagtatcaacatatattttatatgttcctgacatggctatttttttcttaatttttctatatttctaggctgtgagattcatctacaggtttttttttttcaaattgttgcaaatctccaatcatttttcaatacgtttatttttaaaaatccatgtataatagacctgtgaagttcaaacccatgttgttcaaagatcaactgtagatttttttaattttacagttatcaagcacatttattatgtgttgcatatggtatattgaatcttaattctgtgttatatcttaatttttatgaaacaacctactgtagttataaatatgataataaattagaaaatattcataaaggaataatgttaagtggataaggtaaaatactaagcagcaacgatgacattcctaaacttgcaagattattaatgtagatatacatatgcatagaaaaatcttaaggctgcccaggcgcgggggctcacacctgtaatgccagcactttgggaggccaaggtgggcggatcacgaggtcatgagatggagaccatcctggctaacacggtgaaaccccatctctactaaaaatataaaaaaattgctggacgtggtggagggcgcctgtagtcccagctactcgggaggctgaggcaggagaatggcgtgaacccaggaggcggagcttgcagtgagccgagatcgtgccactgcactctggcctgggcgacagtgcgagactccgtctaaaaaaaaaaaagaaaaagaaaaagaaaaatcgtaaggctatgcatagcaatttaatggtagttgtctcaaggtggtggggttatgaatgatttatgttctgtcttttctgttggcatttctttttatatttttcttctgtgaacacctgttgctataaaaatactcagtgcacgtgataataaacatataaagcattctgtatagtctcactgacatttgaaaaaagcctctaggttttatttctcattgtgatcattgcaatgggcatcagaactgcatgtgtaaaaacgatcttgtctgttcttgttatcgtctgcaccctttatctaacatctgtatcactgcttagctggaagcatctcctttagcacggcactgccatgttttatgttctaatgtaaacttgtgtgacttagctatggttaaatagaaataactggtgtttcagcttgatttttgtaacagattctgaggcacgtttttctgtctcaacccgggaatatccatttctgcaccaggacaaattaattacaatactgatgtttaagtatttatggttagtcaaatcttgaatcaaatcgtaacagaaatggaaaacagaaaataagaagagagaggagaaggggaggaggaaaaaggcgcagcagcaacagctattttgagagattgggaaggatcttaattgaaaaaaattgttctttccccaggcttggtcggcgaatcacttaatccactcatcccttcgtcttttcatagaattaggaaagatatttagctcaggccctagaatcagactaatgctgactcgttcttgtctcgaagggctttctacaatttactgcattcagctccatactattaataataatgttgctgcttttcttaaaatccatgttggaaatgtaagaaaatgtaaagaaaattttatttcatatttcattttacatctccaaagcccccaccatctccagaaagagtacaatgatcattttctttgtctctttatatttgaacaatcatcacaacactaaaactacttcgccgttgtgctaagacctcctcctgcctagattgccaccatggcccaccttctccaatttagaagagggaaaggtggggccaaagagagacctttggtgggttttctaccaataagtttaaaaagatactgaaaaggagacccttccttccttcccttccttccttccttccttcctttccttctttccttccttccttccttctttccttccttccttcctttcttctttccttccttcctcccttttctttctctctctctctctgcttcaaatacactttttattcccctgtagaatcagaaaatatctgactgcttgagtctaaatctaccagactaaggaagcctcggaaaagcttttactatttcctcttccctgtctgtgatttttaaaagcatagaaataaaagttcattgtttttatgttatttgtctaaatatatttccatgatatattttaataaaacattccttaggtatttatagttataggattgatggaacagatataatataaagtaagtaaaaaatcttcatttcaaataaagtatccaaaacaaaaatttgattattgagctttaataacattttttaggtttaggggaggcttaatttggggaactggctattagaaaaaaattatttgaaattgcaatagataatgagctttaaaggtaaaaggttggtgcaaaagtaattacagtttcagtctgtgaatttaaaatcatgtataactaggctcaaacacatctttattaattaaaataggaaccattacaatcaacacattattgccaaggagaagtaaatttattcctgtagcgtaaaaagccatgcttcaggatttgatgaattcttggaaagcattttctacatcttgctggttccaacaactcaaaaactgcaattactttttcactcacctaatattagattagaaaaagatcattatttaaaactgataattgaaaaagagcaaatacaagcattcacaaaatccccccaaaaaagcatctttatagatatttttgttcctgtagatttagactgcatcttctttcattgtcatttcttatgacaattatttgcaataaaaatatcaatttatttatttatttatttatttttgagatggagtttcactgttgttgcccaggttggagtgcagtggcgtgacctcagctccctgtaacttctgcctcccatgtacgagtagttctcttgcctcagcctcctgagtatctgggattacaggcacctgccatcacacctggctaaaaatatgaagttagaaaaaaaaaagtttggtcattctgctaaagtggtggtgtacattttgagttgtcattttttaaatttttttctccagcttctcaaattgtcattagcaatgtcatataaatttgtaaatttttaagataattgacagctttgtgaacacccctatcaagttccttctctctttctctctctctctctctctctctctctatatatatatatatatatacatacacacacacacacatatatctttctatatatattgtatatatatactatatatatacatatatatctttctagatatatatagtgtgtatgtatgtgtgtgtgtgtgtatgtgtgtgtgtgtgtatatatatatatatatacatatatatatatatatatatatgtatatatctttcaaaatatttcaaagccaggcatggtagctcatgcctgtaattcaaacatgttgggaggctgaggcaggatgattgcttgagatcaggggtttgagaccagcctgggcaacatagcaaaaccctgttgctacaaaaaataaaataaaattagctggacatggtggggtgcctgtagtcccagctactcaggagactgaggtgggaggatcacttgaacctattacttcgaggctacagcgagctataatggtgccattgccctgcagcatgaatgacaaaggcagaatttgtttcagcaacaacaacaacaaaatttcaagttttataatatttgatgtagcccttaattttaaatgctttttaaaatttataacaaatttttctcaccttataatagcatataaaaagttttatgttacctttgttgatgttagtgtattttgtcaaatgagcaaaaggtacatttgaatgaaggtattcatataagttactacttggattatcaaaaaaagccaagcagctattctgtttgctatttatctttttctcttaataaatcccttgtttggtattatttaaaacaagggccaaatattttatgccaatttctttgcatattgcatgtgatattttctcctatgactctggggttggatagtggtgacacagaccatgttgcctgcaaagcctaaaataaagacagaaaaattatttttgacagaaaattaagttcatgatgtaagataattttgtggtaatttttgttataatttgttctcaatgttaaaataatttctgttaattttattgcttatctttatttgttgtgtcattttctattaattttgcatctaaatattatctctatacttttataaattaatgttagtctgacaaaaaaaatagccttcatttagggcctaatcaggagtttgaacttctcaattatatttaaatcaaacattccaaaacatatgttcacattacagtatataagtgctttataaaatgtatttccttcagtaaaacaataaattttgagtatataattgtgtatgatacattatgaagtagaagacaactctttggatgaggtgttgaattaaatacattccttgcaattttatacatctgattgttgcaagcattctccacaaattaacttgtggtggtgtacatgacaaagcttttttctttacaacacaggacacagatgttgggcctcatatgacttgttcctatcattatgcaacctcacactgtgtaattcatgtagcaatgctgtatagactggcaggtagacagaggagcaatttcaacattactaggctttaggggaagtgtgatggagaggaagcaggaataatacaatggttatagccagtcatgcttaactatattacttttgcaagttttatgaaaatacctgctatgagaagacactgcaagagctcctcccagggcctttaaccgactgtgtaagtgaggggcttaagcttcattttcttcataataggttcatctttgcatatcaggatacatagaaggaaagataaaacaattttgaaagccaatcaaagcatatataaagcctagatgggcacatattttttattgtgacattaagatagataggataaatgaaattgtcaagatacatgcaagcttctgccccagggcatttcccctatacggaaacagacctcagatcgcactcttccagcagtcttatcccctgatgtctctgaactacatcggtacttcagattctatttttatagttctttgcttttgccacaacctctcgtctgatttctccacgttgcctggtaaacctctatggtcctgaggttttgactctgatctgaaaactgtccctcttctgcaggtcttttttccatcaccatccttttcaaagctgctaatttagacaaatttcctgaggttctagtggaagtggggctacaaatacccttgcattatttagtcataattatttctgggaagaaatctaaatttcttgttttgttttctcagttatatcacaatgcatttgttgaattgaaattgtgatcttcaagcctcgttttcctaatttgtcccttaaagaagggaataggccaatgttctcatggtgccattgctttgatgttgaggcacttacagacctgatccaggactcttaacatttctccctgttcaaggtccattatgtggtgcagagccatggtgaaggatatgagcacaaagctctgtgggttttgttttcctttgtttttgtctttttaatctgtaaattgattcttgctaatcacttgaggaaaacaatgacataataatactatgtgcgaagaatttagcaaaaattggtgctcatctgtcaggaaatgattaatatgattccaaggatgaaatgtggaagcattaacaagagaaacaataacaacagtgatttttgccttaggtatcagaggccccaaaatacaaatttcctaaatccattagaaaaataattgccttaatatgaaaacatgtgcatctaacaactttctgaaataattatattatctgaaagtacatgtagatggtctggctttctttaaagatgtttataaaaattcaagataaatggttaataaccttctatccttgggaatcctaattttgccattctttatgcagacaattacttttctttctttttttataatactttaagttctgggatacatgtgcaggtttgttacataggtatacacatgccacagtggtttgctgcacccattaacccgccatctacattaggtatttctcctaatgctctccctccccttgccccccaccaccaacaggcaccgatgtgtgatcttcccctctctgtgtccgtgtgttctcagtgtttaattaccacttatgagtgagaatatgtggtgtttgttttctgttcttgtgttaatttgctgagaatgatggtttccacctttatccatgtccctgcaaaggacatgaactcattcttttctatggctgcataatattccatggtgtatatgtgccacattttttttagccagtctatcattgatggggatctgggctggttccaagtctttgctattgtggatagtgctgcaataaacagacttgtgcatgtgtctttagagtagaatgatttataatcctttgggcatatacctagtcatgggattgctgggtctaatggtatttctggttctagatccctgaataattgccacactgtcttccacaatggttgaactaatttacgctcccaccaacagtgtaaaagtgttcctatttctccacatcctctccagcatctgttgtttcctgactttttaataatcacctttctaactggcgtgagatggtatctcatcgtggttttgatttgcatttctgtaatgaccaatgattatgagctttttttcatatgtttgttggccacataaatgtccgcttttgagaagtgtctgttcatatccttcacccactttttgatgggcttgtttgattttttcttgtaaatttgcttaagttccttgtagattctggatattagccctttgtcagatggatagattgcagaatttttctcccattctacaggttgcctgttcactctgatgatagtttattttgctgtgcacaagctctttagtttaattagatcccatttgtcaattttggcttttgtggccattgcttttggtgttttacatatgaagagtttgcccatgtctatattctgaatggtattgcctaggttttcttctagggtttttatggttttaggtcttatatttaagtccttaatccatcttgagttaatttttgtataaggtgtgaggaaggggtccagtttcggttttctgcatatggctagctaattttcccaacaccatttattaaatagggaatgctttccccattgcttgtttttatcaggtttgtcaaagatccgatggttgtagatgtgtgacattatttctgaggcatctgtttgttccattggtctatatgtctgttttgttaccagtaccatgctgttttggttactgtagccttgtaagataatttgaagtcaggtagtgtgatttctccagctttgttctttttgcataggattgtcttgactatacgggctcttttttgtttccatataaaatttaaaatagtttttctaattctgtgaagaaagtcaatggtagcttgatggggatatcatttaatctgtaagttactttgggcagtatggccattttcgcgatattgattcttcctatccatgagcatggaatgtttttacatcatcctgataccaaaacctggcagagacataacaaaagaaaatttcaggccagtatccctgatgaacatcgacacaaaaatcctcaataaaatactggcaaaccgaatacagcagcacattaaaaacttatccgccatgatgaagacagcttcatccctgggatgcaaggctggttcaacatacacaaatcaatagacataatccatcacataaacagaaccaatgagaaaagctacatgataatctcaatagatgctgaaaaggccttcgataaaatttaacacctcttcatgctaaaaactctcaataaactaggtattgttggaacatatctcaaaataataagagctatttatgacagacccacagccaatatcatactgaatgggcaaaagttggaagcattccatttgaaaactggcacaagacaagtatgccctctctcaccactcctattcaacagagtattggaagttctggccagggcaatcaggcaaggaaagaaataaaatgtattcaaaaaggaaaagaggaagtcaaattgtctctgtttgcagataatatgattgtatgtttaggaaaccccatcgcctcagccacaaatctcctgaagctgataagcaacttcggcgaagtctcaggatataaaatcaatgtgcaaaaatcacaagcattcctatacaccaataatagacaaacaaagagccaaatcatgagtgaactcccattcacaattgctacacagaaaataaaatacctaagaatacaacttacaagggatgtgaaggacctctttaaggagaactacaaaccacagctcaaggaaataagaaaggacttttcttacatttctaaaggcacataagatcacagagacagaagatgtccagtagatttattttcattcctctagtacaaattttttatagacagaatcataggaatttctgaacctaaaaatattaatcttcatgccacctatttaaaggaaatgcaagcacatgtttattgtaagtgacagtcctctgagatgatagttgatctgtgttcatggcttaagattattatattcagtgagaatgaaattacttctattgaaatcttggaagtaaatgaacagatcatagaatattctagctctcaaggctggtctcagcaagacaatatctgggtagaaaaaacttgatggatagtcaaggatattttagatctgagtaatcaatagcaggtgatggagaaaaagagccatataataagtggtcttataagcatttttgctgctcaagaagtaccagccacaaagaaccaatactattttaaggattaaagttaccaaactatagtagaatgtatgtgtacttaggaatcacatatgtatcatttagtgtgtatgtcactagttctgcaacttgtagtttaaactagttttctcatgtttaacgagatgataaaaaaaactaactcagaagattgtagtataaataaaaagcgatgacatctcgttttacataaattattgcatttgtcattcattcagtaaatgctagctatttttacttttctggaaactagggaaaataacttctatataggtttgtaacgaattccaattacgaaattcgaaataagcataaaacaatacctcttgcatcatatataatcaaacattaaattaccttttgaacaaaaatctttgtttattaattttactggcccccaaatggctatgaacttgttgaaaatggagatatcacattcatctttttattccccatttctagtagagtacctgagacaaagctagcaaatgccgactgattgaacaattccagctctgttattaaaatcatcatataacacaaacttgtcaatggaaaagttaactttcagataccaaaaaaagggaaataagctattgcaaataataatcaggtaaaaaaatatttattctgtttcagcatagtgttataaatattgaaatgtaaattaaaggcagtagggcacacctatatcttgtttctagtttttgctgatagctgtatataatcaactattattgctttgataccaccatataacgtgggttataagattttcagataaaagcaactcttatttcatttgtttttcttgaattactccatataggaagaggctttggaatcgtatttcttgctttgaaattttatttcttgcatttatatgcctttgcaataaaatcgtgttaacttataatctctcacgcaatggtttctcctagtgtttaataaaatggtattaagggtaactgctactattttttctaaaattagaaggtaacattgaatggacacacagcagatacatgttacattctgaaatgtatgctttgctggagcagaatgaatgcaatcaatgtaatggaaatgctgcactaatggctcattaaacatggaaagtatgcatagatgaaaaaagtctgtgcatatgtttcagttcactgaaggaagcaatgaactataatgtggaaagaaaaggaaacatacttctttacgtaaatattcttacttctggaaaagaattgttgaatcagtcaggaatttgacagcaagatttcaactattggagcagacaactttatattgtaattgatggatctggtggacttttaaatattttttttccctattctgtgctttttcacattgtttctatatctttttgtttttttgcaaagttctttaattgatcaatattttcttttgtgatatgtgttttattgctcacaagaaaaaaatttctctatttaaatgttatactctcttacactttctttcaaactgtcacttataccactgcaattcaccccaaattattttagtatatgatgtgaaatccaagtctagctttacttttttcacctttattcaattgtcccagaaacatttatcaattattccacatttcttcactgatttgtaatatgccctttgtcttaaaccatgcaaagctccccagcatcaatagaaagagagaggaagtagatgataaccttttgcagtgggaaacaaaaaagatattttaaaactcttgtttgtgtttggaactgtcacctcctatgacatgtcaaacaaccttatttggcattggatagtgtaagtaattttttgccctgacaaaatatatttaggtacccacttgagcaaaacttataatatagatttaatcatatattcactgttatcatcgacttcattgtgttcttctacctctgcctgatgcacctcttgattattcagcattgttgccaagcatttgctgttagtagctgataacattcatcttcttttgctaaatatttctcatatacaagaagatttaagactgtttatccctgtagttggaagatttttcctctaaaagctgtttatacttttcctagcacgaagacctgcttatatgccacacaagtgtctcttaaaaagttagtcactcaatgccctgctaataggagtgaaaaagacactagaaacaaaaatcttttctaaccagaaaaccacttttgtataaattttgagctccttgcaccacagtgactacagtgtgcctcactaaggtaaacatagaaaatggtatcatttattgtttcaaattaatagggtaattgtaaatatgataagtttatcgaagatattacagaagtatacattttaagacaaccctagaaataattcttttaagagcatgttacaattattattttaaaatgcattactcctaccctaattttagttggaagagatgtatgaaaattacaatgattgtactgcatagaatatgtcatttttgtttgattttttaattagcagtttaatttgtgcagtgtcgaatataagagataattctgataggtttgtcatcacagagtctctggcagttaacatgaatacaaaatattaaatgtattacttaccgcagtaaacggtcactagtcagtaggttgataattcgcatcttgtagaacactggccatgactgatggatttttatcctttcttattatgtatacgttttttttcattaatagtgttccccctccaagtcagtttttatattcaatcctagcacaaatgattttaaaaatgaaagagatgaaggagatcattagattctagcagaggaaaagttgtaatacaagttggtttagaaccaaagtgctttctaactttcccatttgtttgttttttgttttatgtttagacttggtattaaaaaatgaagatgtaaacaattcagttaggaaaccttcagagatattctgcactgaccttcattagagtttgtgtagtgcatgaccgtggtaatatcaaatggttgcgtaagtatctacaaggccctttttcaaaaaagccatcaagttgcatctctctaattattgcaaatatcttgtttactcctatttattcactacatcacttgaagtttcctcttgaatctgagcatgtcctgtaggtctaccttagaagaaaggaaaagtgctgtcttccacattgggtttcagctgggcttacagccaagtgtacattgcaatttgcaattatctccttttcctgcttgtgctggcaaagagagggaaaattttaaatatactctctgtgaaaagagtgtgagatcagaaaacagacagtattatgaatacttaatgtatttcctactcaggacaatttccagcacttttcttttgggatttaggcttctgtgtataatatccccttgaaaactgaagaagtacaagtctccttgcttgtaagcgactaaatggctgacattctggatgcatgttttcatagactattgtgttttgagtaaatataaatgggatcactggataaatggatttggaagagtaacgaaacaagaatagcatgggggaattatctcacaggaacattaaacttaaggggatttaactgtattcccattaagagaaaaagattaaaataaaatatgtacagccacgtgtcatttagtgacagggataccttttgagaactgcgtccttaggagatttctcatcatgtgagcatcatcatgaacagtcatgtgtttctgaacaaccggggtatgttccaagaaatgtgtcattaggcaattttgtcatagtgtaaatatcacagagggtacttaaacagacctagatggtatagccccctacacacttagactatatggtatatcctatttttcctaggctataaaaattttcagcatgttactgtagtgaatactgtgggtaaatgtaacacaatggaagtattaatatatctaagcatatctaaatatagaaaatgtaatgcattgtcctaaaatgttaggatagctatgacttcaccaggtgatagaaatttttcagttcccctataatctatggaatcaccatcatataggcagtgtgtccttgactgcaacgttatgtggcatatgactgtacatctatgtaagttgcatagaccattttagtctccatttcactctgtgagaatgtatcctaaacggtaaatgcaattaagttttaaaaacatgttgcaagcatacacaaaagcatagagtaattgtgcaaattattttaaagttttccaggccatagatgaaaaggtaaagttcattgcttaggtagccagggaaaaggagagtgatagaaacaatggcagtcttggggtagacagtgaaatactgagagcctttgacagtcattgaaaaagaattggagcccgttctccatgtcgtgcttatttcagattgcatgcctgtatcaaaacatctcatgtactccataaaaatacacacctactatgtacccacagaaatgaaaaattaattagaacaatgaacaaagaataatggatttatatgggtgtacataaatccaagtgtgtaatagtttatacacatggacttatcaagaatgataattctttatcattcatgataaatgaaacaatctttatcattctaaatcaatgaaactatcaagaatgatttagatgtacagaatttatagtgaggcatgaccattagaatctagccagaatatagcgtacaatttcactatattaacatattcttgaaattgtctattcatttggtttctactggatggtacaattagagatgaattagggagggacaagaaactagcatttactgggtctctaacatgtgccaaaggcgaatggcacctcaggaaggtgcagctgcctttacgtgacatagggaagaaaacatttagaaaatgatatttgatcttccttgagaaatacaaatagaacctatccagatggaggaaggcagtgagcaatagcatgtttgagaacatacttttgttctcacacatcatgtaccaaacacagaagaaaatgacgcatctaaaattttttttaaaactacgctgatgcttttttttcttcacaacacatttttatggttttttttttttttttttttttttgagacggagtctcactctgttgcccaggttggagtgcagtggcacaatctcagctcactgcaagctctgcctccagggttcatgccattctcctgcctcagcctcccgagtagctgggactacaggcacccgccacaacgcccggctaattttttgtatttttagtggagacggggtttcaccatgttagccaggatggtgtcgatctcctgacctcgtgatccgcctgcctcggcctcccaaagtgctgggattacaggtgtgagccaccacggccggcccatttttatgtcttttaagctccaagttttcttagctattttcatctgtcatatatagcctcaatatattgttgcctggcacatagtaggcatccaattaaaattaattgaatgcatgactgaaacaagagtttctcttcattatgattcttaatttaagcttaaatttagaaatcctcttcttatcatttttcttagtttaactcaacactaataagattgtcgtttctatcatattctgtgtctttccccatgatttccatagctctttgaattaggataatgacttttttattttattttattttatttatttatttattttgagatgtagtcttgctctgtcgcccaggctggagtgcagtggcgccatctcggctcactgcaacctccgccttccaggttcaagcgattctcctgcctcagcctgccgagtaactgggactacaggcacccaccaccacgcctggctaatttttgtatttttagtacagacagcgtttcaccatattggccaggctggtttcaaactcccgacattgtgatctgtccgcctcggcctcccaaagtgagccaccgcgccaggcctaggatcatgacttttataacctgtagcgagaaaagatgcaaatctttctcttattggtatgattctgctcaaactcagatacacaatctagagtcaagatgacaccgtaaaattattttttttaaaaaagaaagaagcctgggcatggtggctcacatctgtaatcccagcacttcgggaggctgaggtgtgtggatcacttgaggtcaggagttcgagaccagcctgaccaaaatggtgaaaccctgcctctactaaaaatacaaaaattacccaggcatggtggcagacacctgtaatcccagctacttgggaggctgaggcagaagactcacttgaacccgagaggtagtggttgcagtgagctgagatcataccactgcactccagcctgggcatcacagcgagtctcaaaaaaaaaaaaaaaaaaaagaaagaaataagaatacgaactgcaatcacatttccaggctgattgtaaaataggaacagcacacttgagccaaagcaaaggtttcaagaaggataaggtcaaatgcacagaatatgggacttagattgtcaagctgaggttaaagtcagtaattattggagagacctagggattccaactttagactaggagcatctaggctgtcataagtaagaagagagcaggggctttaaaacttggctgtcacaggtagcatttcttttccccttgaccctggggcacaggttgtccactcgcaaatgttttcgtgtcacctgacactcaccttctcttctcgccagtcttgcaggccacaccttactcctaccacatcttgccctaggttttccttttcttgcactgaaagttctcctaacttatgccatcctactggggaaaaaaataagtttctttttctccctgctacataactacattacaacacttaataatcccattcaggtccaaaatgcacatctttctctttgcaaatagttactatactttctttaaacattcttattacttattttgagaatgtttctattttctcagttttagcatttcatgagtctttgacagctgggtctcagagagaggccagttaggaattggacaatcgtcttaagcaggctctgggtttcctgtacttttctgtgcagtgcctgtgctgattaaactatgacctgcagtttttctttttacggagttcatagtggtcatttgaaatatgatgtggcattcagaaaaattactctttctcctgcagtttctgtgaatatattttacactgcagcaattgtcatacaaggcatataaggatttattcaaaaatttatcaacaatctgagatgcattggtaagaattacaatgaaaatattagttgttctttatatcactgcaaacaatagacaaatccttacatgcaagaaaacttgctatgatgtttcaatattgtaatttcagccaatctaaggctaaggttctccaaagtttaaatatggtatttttttttccttttagaaaatccccatacatttaatagcccagttataaacatactgcccatgtaggtctcctttacttgtgacctctagctgtgagagaatccttaggttccagagaccagtagttcactgtgtgctaaaggacatgctttagctactcctttgctactccttttgaattctttctccttttctaagtgggcagctctcacccgctcattctctgggctttgcatttagaatgattggtcttccccactattattttagacaattacatttatcatgagaaattaatccttgagggatcaatgatgcgtgcttttctctggctcacaggaacaaaactattattcattttccacttgacataaagtgacccgtgaacccatttacattttcattcccctgctggcagtaccagtgaagccctttgtcagttatcagctagtagtgacccctgcaggcacagccaccactcagcccagggaggactgcttccggggcaggtcccctaggtgccaataaagaatgcaaccattagcccacatgtagggacctaaataacgctggtcagggtcttgggtctacctatgtgaagcaaacaggcaaatattaacaattttgctgtgacctgtatttgagtgataaaggtgtaattcgaagtgaagaactatgagagctggggcatttgtcattggaacttttccattttctctctaagggtaactttctttcatttttacaccctctaccctgaaagttgtcttcagtcttcagtcactgcccctgtattccatgccattatattatgtcatatattggtgactcctgtccctggaaaatttaatgagaaatgggaacgaaaataatatcgtcatggtggaatgacaggcggctgatattgttgagctagggaatgcttgcaatgctgagcacagccacatgtgccagaaatagggaaatgtatgacacaagacacagtcttgaggtgctcatgagctattaggaagttgcagcatgatctcaccatctgaaaatgaaaaatgaatcattctctggggaatgagctaaatttgactcctgaaatcaccatggtgccagggattacggtctctgaatgtgctacagacttggagtgactaatgagctgcttgaggtcatagagagacttaggcaattaaagacaattaatgcacattatcttgcttaaaacatagaaaatgatactccagttacgcagtggttacttttgtgacctgtttagataactctaaacaccatatttctcctagattttataatcttgttgttcattcagtataatttgttttctaacataaacttgatctttactgttgtgagattcttgagaacagagacactgtatgttatttcttctttatattcccagtgcattaagagcttccaaaacagtagatttttgctaaataagataactgttgaacaaatgaaagaatgagcaactgtagagctgtgttttgtgcattttctttaacacagtctatttttactgctgccgatctttactgttgctgatcaacctgagttgagttcatatttgagtgcaaaattcttcttctgactaagtaaggaatacttgagatgatgcaggattgaaggttcctaagtttatcagtaagggagtaagggagtcagcatattttaacccactttgggtaaaatatgacattgaactaagagacaaaaaactacaatgaaattagttaacatagtttttttgtttgtttgtttgtttgttttttgagacagagtctcgctctgtttccgaggctggagtgcagtggcacgatcttgactcactgcaacctccacctcctgggttcaagcgattctccttcctcagactcctgagtagctgggattacaggcaggcgccaccacatccagctaatttttgtatttttagtagagacagggttttgccatgttggccaggctggtctcgaacccctgacctcacgtgatccacctgcttcggcctcccaaagtgctggcattacagcatgagccatcgcgcctggccaacattatagaattttaaattaaggacatctgaaagataattgagttcaacatttcacattcaccctagactgctctcccaagatcaggagctactggagattttgaaggaaaacaggcctattcctaaaatgtaaaaagtgagcatgaaaattgcatctgatgatgacattcaggagaaacagttagtgtgcctatgcaaggtgatccgtgtgggacagagccaggactattacgaagcacttgatacctcaccacggaggactgatgagaaaattcattataaagagtttggctaccgcgaaatgtaagttgacttctaaataaagaattcaaatgaaataaaaatgatcgacaaaagttgactagaagttctctaaaatatatctatttctaattttatttcatttgataattacctaaattactctgaatcctaccttcaattttacttgtctttgtttgaacagtaattcttttgtctcaaatgtcatgtatctttgcttaatgccatgaaatttagccagtcttaaaaatctttgatagaggaaagaaaaatgtcctaaacatgtgttatttattttacttcctgagtctcaaaatgtgttttcatattgtgcttcaagtgtcatggtttagtttttgccttactcatttttaatatatctcatttaatagattaatattatattcccttgtaacctgcttatttcaagaataaaacacaatgtcttaaatagtaacacaattaattcagatttttttgacagcacgatgtatagtgcctaaatatattcagccagatttaaaacagggcataataagtaaaaaaaaacaaaatttcatagtgttgaaaaatcgatttggtgtttaatatttatttagatttataaaaattgtttcatattgtcccttgttatcactaagcaattaaagcattgctatctgagtagaactgccttggatattgtgtagcttatgaagtttaaatggctcaacactgtaggattctgatttgcaaagaaacagtctgaaagctcatcttcccaggctggaagacactggtttatttatttcactgtattaggcaagacaggatgatttttttttttatgttgagtggatgccttttggaagattagaaaactctgaggaagagggttctgaacaacaagccatctcaatttactgatcaccagcagtggaggcaaaaaatgagaaaatccatgagtttcctcttgatctattaaagtcctatttgtgatccaaatcagaattggaaactttcttcatagccttagtccactgtttctgaattaaaatcacttcatcatggtgttattttgaatactgtgatcttaattaagatccaaaccttagtgaacatttggaaaacaatagaatttgctgcaaagtgttacaaaaacatgcaaaatttctaatcattgtcacttactaatgaagtttatgtttctgtaaaagaatagcctgtaactaagtattctttggggttgtctttaaaactgatttgtttaaatttaaattcccagatgtcttaatagaagacagtaaagtcctaaaacaaaggtattcactgtgttcagctccttaacaccaagtacagatcaatttgttagctgcagtgttggatatcttccagcactaaaactgacaaggtgatattaagataaaatatattacctcctttcagtgttaagatatcttaaacctggaactggactcagaggaacaatttatgtagaaatggttttccatgagtgtagaaatagtttggggcaaatgttaaatttttgaacaaatgtttcctgaatctcctttttatgtacagcaggggttcacaaactctttctgcaaaggaccagatacaagtattgtaggctttatcggtcagccaaacgatgtcagtttctgtctctatattcaaatctgcccttgtggcatgaaagcagccatggacaatacctaagcagatagtcatggctgactgttccaaaaaaaaatgttatttactaaaacaggtgactggccagagttgaccaacccctaatgtagaacattgtgttgagaatcgtttaggaaatgaatttataaaaaaaacaaaacaaaacaaaacaaaaaacagtgctactcccctcctggagcttatcatatgatataaatcaaagaagcttatgcataaatacttaaataataagtaaaacttgaaatgtacaagagaagaaggtgcatgataagagtcatgtaagaacggcaggaaggtggggtccatgtgtacagaggagagggggtgcaatcatttaaaactaaggaagaattgcaggcactcaaagctgtcaagcagtaccctgatggatggagactgccctgtagagaagagagcataatggaaccctgggagagccatgttctttccacccatctcacagtctttgggctgctttgttcttctctaaatgcagagtaactattcatatcactgtcttatagaggaggatgctaggaaccagtgttggacaaattagcagagtcagaactcacattgggtttttcttacttcaaatccctcaggattttgcacaatacattcttgcaggtcattcaggcaaggtgtattaaattgcatttttcttgaatggcgtacactctagcctaactaaacatgggtattttgttgtactaaataggagtaaaggttgaaaattttgggtacaagcagaagttggatggttttgaatgcaaagatgtttgaagtttaggtgggaaatagaagaggacccttaaaagttttaaattatagaataagataattaaaatgatgatttatagagaggtgaatctgctgaaatatccaggctatagaaaaccgttatgtagtgcttgactaaactttattcagagggataatgactaagaattagacacatcatggaaacaggtatgtgaggggtcgcacacttttgagtacaacaggtgtcatttgcaggaatatacacatgaccatggttttgagaaaccttacgctagactagcaagaacttcaatcttccaggtatctcctctaaaatatcattatggttgttcagaggtaacccttggcatcagttctgactctctcatgttctgcttctcttagtgaagtggaagtggatgtcacctttgtggctggacaccacaatttctgctccccatagagctccacagtggtgctccttgagcctctctagttgggtctaataatggaaacgtaaattatttgggattgtcattgtctctgtacgcaacttctactttaagccttatcagtctcactcttactccttctggtcttagtgtaacatgcacagagatgaacaggaagaagtattctggtagcatgattgggaaaattgtctactcatctgtgtatgctttatgaaaggcacaaactctctgagcccaaagggttatcacccatgcctgtacaatatttcccacttagacacacactcttacatgaaaattcatgtataaaatggaattctcctgccagggagcattcactgtgcccaagagctcaggctgtgcccagaaccagctgccgcctttgacgtaggccttagtgtggaaggtgattcaccagtttactcttttaatatctgcaatctggcctccatttagggctgctcaatccaccagatgaatatttatatctttgagctactattgagggtttcatccccagccatttctcctacagacaaatgattcttaggttcctgtgttacacagtatgagcaagtatatatggaggatggggaatgacgaacacaagcatccaattcacaatgcaaatgtactcaggaaaagatgatgcttgattattcattagcagggtttgagcttcagatcaaccagaccatatatcatagcagaaaaaccttttctgtactcctgcctcagcaatatctggattcaatatctagttcagcctaaatctattgtatactaaatagtgtaaaagaggtatttaatagataatttttaaaaagcaaaaccatgatcacacaacgcatggtagccccaaattgtaatttcttggaggtgggacacaggcagccaaaaggaagtgaagcacttggtagaatgtacatgaaacggtgcacagtagttgatgctgcttgggtgaaaggaaggggaaaaatctattgatcacagaagatcaatgtttagtgatctggttttgtgtgtcagataccttactaaacgtttttacattggacctcatttaatcttcatgataggcctatgtgtaacaaattgttgaataacttaaagatgtcaggtggaaaatatgatttcatttgttctttaataatttttattgatgtagactttagtaacattattacatattatgttcatatgcatgtaacctatatatttcctttcaaacaaaactatattcttgaaataaaagttaatactaatcctgtgaagaaagtcattggtagcttgatggggatggcattgaatctataaattaccttgggcagtacggccattttcacgatattgattcttcctacccatgagcatggaatgttcttccatttctttgtatcctgttttatttcattgagaagtggtttgtagttctccttgaagaggtccttcacatcccttgtaagttggattcctaggtattttattctctttgaagcaattgtgaatgggagttcacacatgatttggctctctgtttgtctgctattggtgtataagaaagcttgtgatttttgtacattgattttgtatcctgagactttgctgaagttgcttatcagcttaaggagattttaggctgagacaatggggttttctagatatactatcatgtcatctgcaaacagggacaatttaacttcctcttttcctaattgaataccctttatttccttctcctgcctaattgccctggccagaacttccaacactatgttgaataggagtggtgagagagggcatccctgtcttgtgccagttttcaaagggagtgcttccagtttttgcgcattcagtatgatattggctgtgggtttgtcatagatagctcttattattttgaaatacgtcccatcaatacctaatttattgagagtttttagcatgaagcggtgttgaattttgtcaaaggccttttctgcatctattgagataatcatgtgttttttgtctttggttctgtttatatgctggattacatttattgatttgcatatattgaaccagccttgcatcccagggatgaagcccacttgatcatggtggataagctttttgatgtgctgctggattcggtttgccagtattttattgcggatttttgcatcaatgttcatcaaggatattggtctaaaattctctttttttgttgtgtctctgcctggctttggtatcaggataatgctggcctcataaaatgagttagggaggattccctctttttctattgattggaatagtttcagaaggaatggtaccagttcctccttgtacctctggtagaattcggctgtgaatccatctggtcctggactctttttggttggtaagctattgattattgccacaatttcagagcctgttattggtctattcggagattcaacttcttcctggattagtcttgggagggtgtatgtgtcgaggaatttatccatttcttctagattttctagtttatttgcatagaggtgtttgtagtattctctgatggtagtttgtatttctgtgggatcggtggtgatatcccctttatcattttttattgtgtctatttaattcttctctcttttcttctttattagtcttgctagcagtctatcaattttgttgatcctttcaaaaaaccagttcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttctgtctttgttctcgttggtttcaaagaacatctttatttctgccttcatttcgttatgtacccagtagtcattcaggagcaggttgttcagtttccatgtagttgagcggttttgagtgagtttcttaatcctgagttctagtttgattgcactgtggtctgagagacagtttgttataatgtctgatcttttacatttgctgaggagaactttacttccaactatgtggtcaattttggaataggtgtggtgtggtgctgaaaaaaatgtatattctgttgatttggggtggagaggtctgtagatgtctattaggtccgcttggtgcagagctgagttcaattcctgggtatccttgttaactttctgtcttgttgatctgtctaatgttgacagtggggtgttaaagtctcccattattattgtgtgggagtctaagtctctttgtagatcactcaggacttgctttatgaatctgggtgctcttgtattgggtgcatatatatttaggatagttagctcttcttgttgaattaatccctttaccattatgtaatggccttctttgtctcttttgatttttgttggtttaaagtctgttttatcagagactaggattgcaacccctgccttttttttggtttccatttgcttggtagatcttcctccatccttttattttgagcctatgtgtgtttactttaaagttcatatggcaccaaaaaagagcctgcatcgccaagtcaatcctaagccaaaagaacacagctggaggtatcacgctacctgacttcaaactatactacaaggctacagtaatcaaaacagcatggtactggtaccaaaacagagatatagatcaatggaacagaacagagccctcagaaataatgccgcatatctacaactatctgatctttgacaaacttcacaaaaacaaacaatggggaaaggattccctatttaataaatggtgctgggaaaactggctagccatatgtagaaagctgaaactggatcccttccttacaccttatacaaaaattaattcaagatggattaaagacttaaacaatagacctaaaaccataaaaaccctagaagaaaacctagacattaccattcaggacataggcatgggcaaggacttcatgtccaaaacaccaaaagcaatggcaacaaaagacaaaattgacaaatgggatctaattaaaccaaagagcttctgcacagcaaaagaaactaccatcagagtgaacaggcaacctacaaaatcggagaaaattttcacaacctactcatctgacaaagggctactatccagaatctacaatgaactcaaacaaatttacaagaaaaaaacaaacaaccccatcaaaaagtgggcaaaggacatgaacagacacttctcaaaagaagacatttatgcagccaaaaaatacatgaaaaaatgctcaccatcactgtccattagagaaatgcaaatcaaaaccacagtgagataccatcccacaccagttagaatggcaatcaataaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcctattactgggtatatacccaaaggactgtaaatcatgctgctataaaaacacatgcacacgtatgtttattgcggcactattcacaaaatcaaagacttggaaccaacccaaatgtccaacaatgatagactggattaagaaaatgtggcacatatacaccatggaatactatgcagccataaaaaatgatgcgttcatgtcctttgtagggacatggatgaaattggaaatcatcattctcggtaaactatagcaataacaaaaaaccaaacactgcatattctcactcataggcaggaattgaacaatgagaacacatggacacaggaaggggaacatcacactctgcagactgttgtggggttggagggggagggatagctttaggagatatacctaatgctaaatgacaagttaatgggtgcagcacaccagcatggcacatgtatacatatgtaactaacctgcacattggtcacatgtaccctaaaacttaaagtataattaaaaaaaaagttaatactaaagaaagtcttttttccctaaaatattattgtacaaagagagaactcttaataaatgttgacctctgacagaagcttaatttatcctaaagcatttattaaacatctattgtgtactaaaaattggaaaggctttcttttgaggaaaaaataaaaaggcactatatttgttctcaaacactagcgatatgaataataggtgtctatatctgagaaaaatgcagaggaaatagaagggttatctaagtctatttgggctcgtatagcaaaattccttagaggtggatagcttatcaacaataacaaaaatgaatgtctcacagttctggaagctgggaagtccaaactcaggttgccagcgtagtcaggttctgctgaagaggcttttctagggagggtcctctggtgagggtccttttctgtgcagattgccaactccctgttgcatcctcatatgggagaagtggagaggggtcactctctggcctactataaaaaggcactcattccattcatgagaactctgcctgcccttgtgacttaatcacttcccataagaccccacctgctaatacccccacctgctaatacccatcatggagttttgaactacaatatatgaattttgcattcagaccataataaagagtatatttattgcttatctaacgctctgttttaatcctaagaaatttatatcacgcatctacttcgatgctatagctagactaatacatgttcatcttcgtgcattttcccatatatgctattttacttccatctgtacttgaattttcttagtggcttgggtaaagccttgacatgtacacttgttaaaatggcctcttgatgactgacaagataaccagctacaattaatggtcattgtaatgttgagggggaaaatcatccttgaagatgattagatactaaatgaattagcacacagcatatttaaacacaagtatcaagtcaacaaatatgattttatcaatctttaataattttactaacctttattaatgtatattctagtaatgatactatatactatgtacatatacaggtagcctagtatttcatttaaaataaaattgtattcttgaaattaaaatcaatacagaggaaagcttatttctctgaaatatttacaaaatgcacaaatttttaaatttcaaaatttaacatttgtgttttattttaatgaatacaattttcaagtatgttatatgtacagaatggaatacatagcacaaaagaattatttactatctgtgtatgaacctaaactgcatcaatgaccatataaagcaggtaatataatttaaaataaacaataatgatgtaacaaattttttcatatataaaatgaaaattttggagattaacactgcgtctgcctttgtgggtgatttattccacagagctctttcaattgtttagctgccttgaatcttgtagcttagttataaagagaagtttggaggtaaatgttctgcagcattcaaaaggcttccttgaaagccatttaatgcttgaaaaccttttattaatgtatttgaaaatagtcatgttggattggaatatgagagaaaaactgatttggttgattttcctggctcatcagttttgaggttattgtaactaacacacctcagtcagaggcactaatgaattaaacacacagtgtttgattctgtgctgtctaataccatagcaactggtcacatgtggctatttaaattagaaattcacattaaagtaaaaattcagtttctcagtcacactggttatgtttcgtttctctctctctcttttttaaaggaagttttgctcttgtttctcaggctggagtgcaatggcacgatcccagctcactgcaacatctgcctcccaggttcaagtgattctcctgcctccgcctccttagtagctggaattataggcacgtgctgacatgcccagctaattttgtaattttagtagagacagggtttcaccatgttgaccaggctggtctccaactcctgacctcaggtgatccacccgcctcagcctcccaaagtgctgagattacaggcgtgagccaccgcgcctggcccacactggttatatttcaagcactcaatagatacacatggtttgtggcaactaatggacagtgcagatgtagatggaacagatccattcacactgaaagtactattagccagtattattgtaagatgtacgataacctcctttgcaattttatttagtcaaaagatagtaaatgcagtgtaaagtcattagagaaatattgacttttaaggataattaaaaaccattaggataataaacctatgttaaggttattcctgattaaatcaataccatcatgagacatattccaaagatccactgtgagatgctttatggaaactctaatttctaactaaaaaggcatgatatgtgaacactcatagcttaataaaaattatagttaatatgaatggcagcctgtcatcataaacatggttagtaaatttcctggtatccctctcatattcttcccaattggcatcattcatgaagtttctgtgtgattagttccaactggatttccaaggtgatcccccttttctaaaagaaataatcataatctcttccctttgccacaatgatgacttcatgaatatgaattgagctcaggccccagtcctaccatgaattacattcctcctatgatgccgcttgattcaagggtgtacaagagcttcataaggtcaaaacaaagtgaagtccagcagttttgctttaggatgagggagatagattctcacttttaccggatgctggggtgtgtggactgatacccagaataatcatagttatgttgttgccctgaaaggtgctagcctgaagatgaagacatatagaggacaggggatgagaacatcacacactatcactaaaaatcagttacttgggctgggcagggaggctgaggtgggtggattacctgaggtcaggagttcaagaccagcctggccaacatggtgaaaccccatctctactaaaaattagccaggtgtggtggagggcacctttaatctcagctactcaggaggctgaggcaggagaatcacttgaacctgggaagaggaggttgcagtgagccgagatcatgccattgcactccagcctgggcgacaagagcaaaactccgtcttaaaaaaaaataaaaaataaaaaaataaaaaataaagtcagttacttatttacctttaactatagatgtcaaatttagagttagattttctgttatgtaaagtcaaaattattctgaaactcttaggtatgtgacgacttgtaggcaaagttatctctccaaattggaaattagtaatcttatttaaatagagtcttcacatttagtaaaagcatattgatgttggtacatttaaattgcaaaataaaagaatgacttactctttagaagcaagaataggactgggcacagtggctcacacctgtaatcccagcattttgggaggctgaggagggtggataacttgaactcagtggtttgagaccagcctggccaacatggtgaaatcccatctctactaaaaatacaaaaattagccaggtatggtagcagatacccgtaatcccagctacctggatgagaatcactttaacccaggaggcagaggttgcagtgagcagagattgtctgggtgacagagagagactctatctaaaaaaacaaaacaaagcaaaacaagaatagacagtatattcaccaggtatacgtatattaacttctattaatttaatattttcgcaaatagttgtttgaagtctctggtttaggatagaacagaagtacatattttgggtgatatctgaaaaatggactctgaagggagcacaaggagagagaatccagagtgaataagacagtagctcacggctgggcgcgttggctcatgcctgtaatcccagcagtttgggaggccgaggtggatggatcacctgaagtcaggagttcgagaccaccctggccaacatggcaaaaccccgtctctactaaaaatacaaaaataagctgggcatggtggcaggcacctgtagtcccagatactcaggaggctgaggcaggagaatcgcttgaacctggcagacagaggttaaagtgagccaagatcatgccactgcactccagcctaggcaacagagtgagactctgtctaagaaaaaataataataaacaaaaaaaatagtggctcatgtttcacaggcgcgtaatccacatcactgctgtgcattctgagagtgcaggcgtgaagtatagtcagttcgggattgtaatcagggtccttaactgaaagatctaagggaaactaagatgttttacccctcccaccctagacacacagacaataacagcggtgataaatttcaagatgaaatcacagatgtgctcctccatctcccattctcaaaattaggaaggctttattttgaggtgccagagcacacattaggggacatacaccttcctaggtagacatttcagatattttagagagcatgtgaattaagaacttgaagtcccaaaatagtgtttaaagacatatggtaactagcagaggcatgaaaacgctatttttatcagcaaatcccagggaaggatggggagacagatgatcctgtaagggagctaaatttcttacctttcatggcatagagtcaaccacttaaagtctaatgatgatgagcgaagaaaccggtatgtaattattgaggcatcattgtggacacaaccaggaaaataaaatctgaaaacaggagcccttaaaatacaatttgaaatatggtgtcaagtttgttggagatttgttaattcaagtggtgagttaacctaaaaatatcacagaggccaggtgtgaggtaaaaacacaaactgttttcctgcttctctcgcactacaacagtgggcacagaaggcgtctgtgtgtgggactttctctccatgtaccaagtaagcaaccagttctgcagtggacacaagctgactgtcctccagcccagttgcattctgaccctgtctatctggagagagcctcagatcccacagggtgagggctccatcccacaggcctgccctccacttcccatgccagttgcaagccccaggctcttttacctgtgcttctgactgaccagctgtaagtcagggatcccaccacctcctccttgggtttgattaatttgctagagtggcttacagaactcagggaaagacttatttacattttccagtttattatgaaagatatgacaaaggatacagatgaagagatgtctagggtgaggtatgcaggaaggggcctgaagcttccatgccctctttggggacatcaccctctaggaacctccatgtgttcagctgtccagaagctcttcgaaccctgtcctcttggaccttttatggagattgcattggacaggcatgattgaagcatggagaaatgtcattacacaagaagggtaaggtatagtcctcatagactgggtagcgaaacccggcaaagcctgtctgttctgtctgctctgtcgattcttcttggcctcgctgtgcagtattcttctctcccaggaatggggcaggactcctggaatgggggcctatgaacaacaatcagacaagcagatcagagaatttctttgtagccccctccaggacagaaaggcggaggaagattcctgccctggggagaaaaatgagtggataaaaggaagggaggagaaaggcagagagagtctgttttctgaggtttgctcctgaggtctaaagaaccccaacgttataacaaaggccacaggagttagagccagaacataaatgaaaatacatatataaaaaacataaaataataatgaaaaagggaggaggctactattgtttatgactcaatgtaaaacttgcagagagaaatgagtgaagaataatacttcaatcattcttctgtcttggtgttcacaacatagagacacacacacatatacacacagaatcagaatcagaatgaaggagacataaagataccatatgtgcatagatggacttcctgtaagaatgaatagagaaggaaaggaatagaaatgtaagagaatacaaacagttattccagtagagaatgaaacgatataattattgagtgatcgttcatggagtggttttggaagactctcaggaggagtctcctgtccttgatggcctattagccctttttgccacatgtgaaccctaacactctgaaggtgaaagataataacagacagtgttgagaccagagctaaaattgttgaacacataatcatgacagggtaaattaactatttcactttatcaaatgttttaataaactcttaaataatatgcattgaaaaactggcatttgatgtggaacattctcttagatactatattttataatttttaaatttatgtatgtatttattttggtgagcaactgaaaactgcaattgtcagtgaacttccaagtgaaatgcctttgcgctgtctgagttttagatcttcaaaagctcaaatgagtaatcctgtcaaattacatgggttgatatggaagagagataagtaaataaaactccactataatatttgtgtggtaccacacacatttggcttaaaaataaaaagggattgaagactgtgtaaagaaatggaattttttaaaagataagataggagtaaatatagaaaaggtcttaaatgacttcaggcagtgaagcaaaaagcacattcccttgtttcttcctgtagaatgataccctagaccaggctattagctgtggataggagccctttatagttcagcaaactattaatttatagtttaccctttcagctaagacattgaagctattctttaaaaatttgagataatttgactatttaaaaattcaactacctttgcaaaatcaaaacagatctgttttgtaagaggtttgccatttcagcatctcactgcaagtgataaggtggttcagtgtttaaccaaagatcatggccacttgacccggtcttcaacccagcgctgtgccaggctgcacatggagggcaccagctgagtatcaccagccaaaggactctttcaaatgacaccagaaaagcctgtcctgttcagaaaaatgacatttccaggagttggaataatgctaaactacatggtctgtaaagtttcctctaagtaatatctaaggcactgtgagtctagccttgggaacatatttgtcaaaagactatttaagaaggggagatttttcagtcctcattgtgttctctctctccctctctctagttaaatgtatatattcatcaggtatttgaactcattttgctaaacatgggacacagaattaataggcattaatattttgtccaaatttagataataagatcatatatatataatatatatatttaactctcctcttgctactttactaaatatatatttattaatagaaatgagtattacatgttaatctctgaagatcccaaaataaataagaaagtgtccagcctttcaagtagctctcagtgcattggggaaaatgaatgagaaaagtaagttctactgtagtattaaagcaagagtgtgaataaaattttgttacagttaaacacagagcacttttaaaagtttgagattttgagtaaggttaatttatggtttagctatacctcctgtggaagttctgaagatcttattgattttctacatttggacaaaacattaatgcctattaattctgagtcccatgtttagcaaagtgagtccaaacacctgagaatcaagtgactttcccccagtattgattttgttagtggtaacaatttgaagatctccttaactcttctgttctcccagttgtctttactctaaatgttgccctgtgtatttaaaacctctaaaatccacattccttcccatagcctgttccctttctacttccctggcctcgtcttatactgtgtatgatagccacactggccgccttctatttttacaaagattgctgtctcttttatacttgatgtttccctcttcctagaatactactccctccaatctttatatggctggctccttcttattatccagatcgcatctcaaattgtctccacagagagtgctttattgatactcaaactaaataacaacacccttgccccacaattacatttcattccatgtttttccattattacaatttaaggtttcacagcctttgtgtctgtaattattttatttgtttatcatctggtttcctctaattgaaataggtccgtgaaagcagagtgtgatctctccaatcctgtatctccaacactatgagcagtgttgagccataagtccaaaaaaatgtttgttgaaggaagaaatacttctagttcccacaaattatgcaaagggtaaagtaaaatctgtctaaatattatgagggcaccaagagggttacatttgtaaaaagaagaaataataactatgtaagctgaaaactctgtattactgactccttataagaggactataaaagagaagagtaaaatataaatcagatgatgaaggtataatattttcacatgttttgttaatatttagtttaacctaagtcatgttaggttggtgcaaaataagtgtggctttgacattacttttaatggctaaactgcaattacttttgcaccaacctgataaatgtaacctttttccaggtggatgtcctagttggttagtgatgctttttccattagatttgaagtcattgacgttgtccaggaaaagaaaagagcccaggacagagtttttggaggatatgaacaggcagaggaggatgaaaatgaaaagccagaaagattaataggaaatcaggtggatagggggatgtggtaatgttggtgggggttacctatgtagttctagtaaagaaaccaaaaggcaaaacagaatgtcagaagggggcaagtgatcaacactattaatgctatgaaaaagctaatacaggtaaggactgagctgtatgtgtcggtgaaactcaagctgctgtaacacataagtccttgattgacaatggtttgcccagtggaaggttgattctcaggagcagaacagtccaggtaatcttggttggcagggagctttgtaataattggagaccaggtgtggaatctgtttttgagtggctataacaggatacccaacactgggtaatttataatgaaaagagatttaatgggctctgcagactgtacaggaagtgtggtacaaacatctgtttctgctgatgtcctcaagtagtttccagtcatggcagaaggggaaggagaaacagatgtgtcacgtggcaagagaggaagcaaggtgggaggtgccatgctctttgaaacaaccagatctagcatgaactgacctatcaccaaggcaactgcgctaaactattcatgatcccttgtaatccaaacacctaccaccaggccccgcctccaacacggaattacatttccacatgagattctgaggagacaaacatcaaaattatatcatcgggttccttccttcttttggcctcactctattttagggttccagagtcccctacattcagctactgagtgtggaaaacagacaagagaagtcacaactgctttttctaccccttagcctagaaattatacacatcacttctactcatattccctaggcacaaggtcccatggttatgcaaaggagccaaaaaatgtagttggtagaagcagctatttcttggatatagatttatattatggaaggagaagcagaaataatgatgggcagtgacccatcttctgtgatactttagaaatttgtgcaactaagtcatttttcacttcataaatattgattgatctcctaaaaatataggactacatggtaatttgtgtctgctcccaaagagttataacttattggaagaaataagatttacaaatgaattatggtaattcaaagatatttctgatttattcgtgtaaattttgggatagaaaaatagatgagaacagtagaaaacaagtacatgtgtattactaacccagcaaaaatataaaccctttttactgctacattttgccattttcagaataaacttgcataaattctcctcattcttagctcaaactgtgctgctgattggattgaactacttgtatatgaatgtatcttggtgtgatacgtagcccattaaaaacctagtatggatttcttaactaaaatcctgtattcctaatttacgttgatttccatttttttaatctcaaagtaatatttcagttttattattgggtaaacaatgtgtattctggcttagaacactttaaagttatttcagaagaggtcacaggggaagaaagatccagaaaagtggaatattttcatgaatcattaagttaataactttggaggaggaaggtatgtctagaaaaggcttaaaacaaaacgattagacttactttaaatatttttatttcaaattaagtagatgaagatggtataaatcaggagttagcaaaccttatattgaaaagggccggacagtgaatactttaggatttgcagaacgcatataatcttcgtcacaaatattcaattctgccattacagcatgaaagcagacatcagagacagggcaaaagcataaaccagcgagtgttaatgtatttcaatagaagtttattaattgacactggactttgaatttcatacaattttcctacattatataacattattctttctttgattttccctcaccatttaaacatgtaaatggaccatgcaaaaacaggtggtgggctggtttggcccataggctataacccctggtatatagagccattaacataaaaatacaatttaaagctaatttagaaaattttacccaaagctgtgtaaattataacacattaattattatattctacatactcatttagggtggaactttataaaatatcttttaaaaatatataatatataagatcatgttatgtactacaaaattttaacacaaacattaacaccccattctttgtgtttttttgagaagtttttgttgttacttacacgaatgaagctataggaaattatcctaggtcagttcaacagaggagacattttcagtcttgctcatgtttagcactctttgaaagtcttgatgctcaattagtcaattagtagccgccagatggagaagggtatttcttcacaggaacacgtgttgctatgtgtgtgattaagagggtgaaagatgctgttgtgtgtcagacctctctgtgttccttttagatgtcactagctcaatcaccaagggcaatggaccataagatacttatgtatcttctgcttggcttcatgcttgatgcctctgatcagactcagtgtttcatttccagtatcacagatgacagagtaaaatgcaaaatgtgttgctgcacatgtcaaaaggtccagagaagaaaagacagctctacttttgcatttggattaacagcaattgaaaataaatgcccatttccaattctttgatattgtttaaatttatatgtttgatatctgtttgttattatctacacgtatccagggattatttgcctaagctgcaaaattggaaaaaaaagtacagatttagaaaatatgctgccaatggcttaattcagattcattgttaaaccacaatattaaagtacactgttaacataatgtacactgatagttttgtttgataattacctacttgaaatagtagactgataaattgtcccaattggagaagaccttcaaccatctatgccaaccttctagactgcaattattaattaatcatttctggaacaaaagctcctaaaaatggcttttaaaattgtgttttctgctgaaagattctgctgaatggaagtgggagtgtgaagcctaggaaagaatatattcatttcatgtttttgattagctctgaaattttatttaccctcttacctagaggaagagtgccagtgtatattccctaatcctctgctcaggaaattcaacactttctgcaatttgtacttgaaaaaaggtacacaattttagaaaacatagacaaaaaaaacagaacaaaaccaaacaaaaggcaattattgatgtgaagcaaaaagtattaatgcactaaagagttgcttcaggatgcctcccttgccccatcgctacacacaactaccctacaaacgccaagattcaaatgtgatactctcttccatattacatttgaatcttctttttccaggaaaagcagagtatgtatgggtgtacccatagtaagcatgagggcttccattgtttttccatttggcgagttgaaaaacaagtgtgctgcattctcctgtctgttacggtacagatatcttcattggagcactatttgtgaagcacacagttttcaagtcttctagagcaaatttgtttgtcaccatcagaagggctggaaataaaaatatgtttgcaattgacatagtgcaggaactggttaacagcttcaaagaatttataaagaatatttgtctctgaaatgttataaatacccatggtgaaaaagacctacttagaagatgttttctttaatattcattgtgttttaccaaatacagtgaggatatatgagcaattagaaacatgtgcctgcaggttggctcttgctttctttgcagacctactgcccttcttgttcttcctctccatcattttcattgccttgttaagatttatctggccaggcgcggtggctcatgcctgtaatcccagcactttgggaggctgaggtgggtggctcaactgaggtcgggagttcgagaccagcctgatcaacatgaagaaaccccatctctactaaaaatacaaaattagtcgggtgtggtgggacacgcctgtaatcccagctactcgggaggctgaggcaggagaattgcttgaatcctggaggctgaggttgtggtgagccaagattgtgccactgcaatccagcctgggcaacaagagcaaaaccccatctcaaaaaaaaaaaaaaaaaaaagatttcttaacctgcttttccctccgttgcttttgcctgtttccctttcctagttttcactttatttttttttctctctcctattctgttttttattctttgttccactttatattctcccttggtgtgaagaatggctgcagttttagtcatggctataagacaatgtcattttagagagctaatgtgtcctgtcattgaaaggatgagatgataacagaagtaagaggggctggtgtcctacatctccacggcaaggatttcgcccttctcccaatggtgtggttcattgaaatagctccacatcctcattaagtttatttttatagtatttctgtctctaatattttttccccatggaaagattaggttttctttttgagtccttctggctctcccattgtccctgtttgctggcagtggaaatgctataaatcagtattgaggtctggcaattttgcatgccgtcagctaaacataatgctgttgaaattcaagcacagttctttttaagtagacatttaattttagtagaatttgcatttgacagtttgaattcatgtgtttcagcatctgagtgaaatagccctctctgagttctaatggaatgaatttagtgaaattaaccttttgtcacaaaaacacactatcctaggcaaaagttttcacactgttttcagtcagttctatgtagttataatagaatgaatcttcctaatttaagtcatagaatgataaaagcagtgatgaaaagagaatgtacacctaggagtccttaattactctgtgaagtgccagcaataagtatgggacattgacgtgaaactccagttcattacatcaaaaaaaatattaatggtgagatgtctgacactgacaaaatacctagacataacaaagtgcttgtggaaaatgcttgaatttttttttttttttttttttttttttttgagacagtcttgctctgtctcccaggctgaagtgcagtggtgcagtctcggctcactgcaagctccgcctcctgggttcatgccattctcctgcctcagcctcccaagtagctgggactacaggcgcctgccaccatgcccggctaatttttttttgtatttttagtagagacggagtttcaccatgttagccaggatggtctcgatctcctgacctcgtgatccactcgccttggcctcccaaagtgctaggattacaggcgtaagccactgaatttttaaatttactcttaatatgtattcttgagctaattaatgagaaaattcaaacaatcatattcagtaaagttaaccatcaacacagtcgataagtttttcacaaatattctcccttttctttgaaataaagaaaccagatatagaaataagaagtttctattttaaatatttaatatttcttctggacaacattaaagctattaaacaatgccattggccaactatcaattgttaagtgtgtccaaaccctggcattcaatttttttccaagacacttaaacatttaaagtctgtttttaaaatcttaattatttttattaaaaaaggatttttttaagaaaaaatgattttttggtaacactttaggttgcaatttttttaattttaattttttttatttccataggttattgggaaacaggtggtatttggttacatgagtaacttctttagtggtgatttgtgagattttggtgcacccataacccaagtagtatacactgtactcaatatgtcgtcttttatccctcacccctctcccaccctttctccatgagtccctaaagtccgttgtgtcattctatgcctttgcattctcatagcttagctctcacttatgagagagaacatatgatgtttggttttccattcccgagttacttcacttagaagaatagtctccaatatcgtccaggttgctgtgaatgccattaattcattcctttttatggctgagcagtattccatcatatatatgtacaccgcagtttctttatccactcattgattaatggacatttgggttggttccatatttttgcaattgcaaattgtgatgctataaacatttttgtgcaagtatctttttcatttagtgactcatttacctctgggtagatgcctagtagtggaattgctggatcaaatggtagttctacttttaattattcaaggaatctcctcactgttttccacagtggttgtacttgtttacattcccgctagcagtgtagaagtgttccctcttcactccatccacgccaacatctatgattttttgattttttgattatggccattcttgtaggagtaggtggtattgctttgtggttttgatttgcgtttgatttgcatttccctaattattagtgatgttgagcattttttcatatatttgttggccatttatacgcctttgagaattgtttattgaccttagcccactctttgataggattgttcgtttttttctaggctgccactgttttaataaaatagtttttttcttttttactagatcattcttatgattcagttttactagcatttggcaattagcaattattgtatataaataaagttgtttcgttctctgaagaacctgcagagaaccctcgtctggagaaaaattctgtcaggtctaatatttgttaagttcttaacaaagaacctggaacacaggcaaagctcaataattttattaaattcaaactgcattcttgctggtgagcaaaaccagtgtctaaggacttacatgctacatagttctttgatgccaacattagatatagaatgattagcaaatacgttccaaaatgcttaattcttgtgaaaaatgtttcaaggtatacttgaggtattatccttttttgtaaaggccatttgagatgacaatttttgaactactttattttaaaagcatttattattaagaaattcattaattagtactcactgcaccctacttttagtcctgcataatgcacctgtatttttgtactaaaaggtaaatacaaataaatgaaaatgaaaatattgaactctaagtatgtcaggattcctatagacatttcacactctgagattatgcaaattatgataatcatgttaataaagatttggatgaattaattgttattcaaaatggattagtttgcaaaacttcaaattagtctaaaatggagagatttttctggcctcattctatcttcttcgcaggtctttgaagacagctgtgtagtatagttactgtgatgatattgtcacagaaataagttgaagcattttgtgtattttgtgtactaccaatgcctaaataactaactgaaaaatgtatatatattcatagaaagataccagggacaagtggaaagttacttaacaatgatgtgaactttgacatacttaaactctttcggtctcaaatttattgttcagtacaatggttaacaataaggtggttataactattttataatcatcctataacaattgagtgactgtaaaaatgaaataagataaactttcattaaagaacctagcatagtataatgacaggtacataaaagtcctcaagttttaattcttatccaaattcccgtaactctatttccaaggcctcaattttctcacgaaaggcctcttactttctgaaattctatgatttagtttttagttcaattaatattttagcaaatgagtaagttaatgaattaatatatttcctttagagtttactttctaatgcacatgctgttatggtcctatatgaggaaatgtcttttaatgtgcaatattaaaattcacggtcacataaaatgaataaagttttaatgtagaatataacatttttgaattctagaattcaacttaccagagaaagaaaatcttagaaaacctggttaaaatggcttttgataagcacattgaatataaaaacagggtatttatatatatatatggatatgttttctatcttattttcagatcgtaattagccactatataggttttgtccttcacagaggtagaaaaaatacatttaatcacttccaaaaatctgtttgagtcctgatagcctgatatcctttgaaatgcttaaactttgtatttggtatgattcgagatttcactaaattctctattgtccccacgaaaatgacttatttgggtagggggtatttcttatcttgttggaagctttataaaggatcagttattgtatctttgagctgatgaaatagtttaacactgctcaaaacttgtccaagatgctgatatgtatcttcagttagaccatttgaacacatgactaatacacagaccaaagagaacattgtttaaaagaaatcttatcaagaatcatgtaatagatcttaggctatttggatttcctcacaggaaaatagaagcaaaggcagtgacagcaatactcaaagtaggaattgagctctgctccatgtggataatgacaacatctgcatctgttgtgaacttgctcccaaatcggagccctgtgtttttcagcttcctgatgaacatttctactttgtactgcacaatcgcctcactgttaacattctgaaatccactcatttttcctctccatatttctttcttacacacctgttcttcttgtctgccagatgtttgctttatatcacaattgtcttttccccctaatcttggcaactcagcatcatctttgattctgttactgattgggtctgagatggagataagtatgcaggaggtttagcgtgtaggagcatgtaggggtgctcttgggatcactacctgtggaaaggaagggaaggaaagaaagaaggattgggaagagataaaacttgggatgcaatgtactcttaccaaagcctagagctgacctcgttagcagttttaaatctaggatgtcccttcagtactggcctgtgttggggtgatgggactgaggcttttgtctccactttggccagtcactggatacaggttgccccaggaaacaagtagtagatgtaggacaaagtgactttttctcagccaaagaaatttggctaaaagggctaagaagttcttcagtcaggaagagatcttgtcagcacataacagtatccactggagactcctttaacacaaacaaacaaacaaacccacaaaaagctattatacatgatcagatcttgttttcttcatgattttaaatttccaaatctcatctcttgctgcccaaccaccaatctaggttaggagcttatagtgcctaacataggcacttatgaataagtaggacctcctaaatcagatctatccaatccatcccttatccatcgcatttttcaacctcatgaaatgcttccatgagcccataattagcccgtttagtaactcgttggctctccattggcaacagaataaaatgcatttcttagcttatgattcaagaacaaccactgtctgtctaaataatataggtgttgtcaccccaatcttccaagcacatgttttgctttgttagtgccattgattttttttttttacatttaacacctaaaataaaagatctacttggcttatatggaaatcaaatatcacatagttatctggtcatatttacagggatattatgtccaataagccatatttacctacaattttacttaggtcctgtagagaaaaataaaaaataaaaaaaaaggggttgaggatttgcaagaggacatagttacacagatctaatgtacaatgatatttgaacttctgtggacttgttcttatgagtaacatcttccattttaattaaggtcagatgaaaactttggcattatccatgctgagtcctgagtctcaatcattcaatgaatgagttgctaggacacttagttcaattagctatgaggtatacacatggacagaatgttttacaaaacttggccctactgacttgagactctcacatgtattacaaaaacaagtgtatccccatggaggtctgactgtatatctgccttgtaagatcatggaatgttagttgtgtttaagttcctttaaccttctttctcaatttataccttgtttaccactaaaaatagacacctagccttagttgttttggttttaagattgtttcatttatgagtatatactattctgtggctgatttttttttctccctgatttctcttcccctgagttccaagtacttttcacaaagaaaaccttgttcataattaaacatttcttacctcaggcttggtttcagagagaaaccattcaatcaaaagagtgatggaattctgtcactctgatgttatttttagaagttgtttgggttttgattgacacatgttttgtggtctgtgtgtatgttgctggggataatttaattttaagacattaataagaaaagctcattgactcagtcaaagggaaaatgactttttgaagtcaccacacagttttaagaagggatcatagacaaggagaaaacggccaaggaaactttggtttagctggagtgtcgtgccatagtcagaggattctgggggaaatagaaagccctaagaattagttcatatgtgaaaccccacctgccattttggttgatttcctttcttatatcctataggcaaatttccagtgcctactggtttcagtttaataggtgagaaaagcataacacacataaataaggtttaaaaaacttttaaaggctcaagaaagaactaaatgcattcagaaaaaaagaaaaaattagatctagcccagtctgaaaggaaaaataatggcagttgaaatgttgaaatttgattgaaagatttgagatatagtatttgaaatatagtattctaaatcatttaatttagaataccattaatttttaaatattttgggattgaaatcagttcataatgtagctagagaatttaattcaaatgtaaaggaaggacacctgatatgcacttcaatatcattaaatttagaggtcagaatgaaggcagaagaagagagaaatgattctgcaggaccaacccatgtggtaacatatttatgcagaccaccccaacatgatcggaatattactgccacagtggggcacaccttgaaatatgatgaaatgtttcaaggttgttaaataagaaagaagttacgaacagaattgttttcatcaaattttcactgtgtaataacacattgtaaaaccaatataggagtggatttacaaattctgggcatacataagcctctctgatgacttagctaagctggttttgaaaagaaagtgcaacataatggtgaagattattcaattttgctcgtggaaacaattgggcacataatgaatcaagaaaaatgctgagatcgttgaacaacaaaactcaacacgatcattttttgaaatcttccgtgttgttatggtgatttgtgtatttagaacttaacaatgtgaatggcatgaagaataagtgattatgcattgctgaatgcctttacaagagttcgctaagaagaaattactgctttatcataaatgtattgttactgcttgaatgatgatagctgtatatttgtccctttactcactcagcaaacactattcatttcaaggttttggtgttacatcaagcaaaagactccaactgagaaatggtactattatatacacacacatctcccttggagggtttctgctatgaatcaatattatggaatgactgtgtagcataaacagtacatagcatcttttagataatcatatttagaaacagaaatccttttatatgtgtattgttatagtttcatgttaaagaaggtaaaaatcagcagaactacttttaaaaaaaatcttagagtaatacctccttcccatgagcgttagtaaagataggaaagatgatcgttttatgctacatattttcctattgccaggtcaagtattataaaatttaatacatattgttgtaggactttctccttagttcagctggaaacagtgttcttgtcacacaaccatgaaaaattaggctcacagacactttgaagggtgagaatggcagggtttattgggtaaaaacaaataaaaaggaacagggactctcagcaaagccggagtcctgctaccaggtttcctgcctcatagattgaatcccaggttccaccccagaacaggagaggccaggctcctgccccctgcaaatggaaagaacttaccggctccaccccattctccctgtacacaggccaattagagtttctctggggacccctttgtacctggctgtctcaatatgaagaaaaagtagtcatactaagattttttttttctagaaccaactatctaacataactgtcaataattagaaacaaaactgtacaaaaatacttattatataaatttttaaataaatccttgctaggactttgctctctgaaatttgaaagtatattttaaaacaaattaatgctttatctccttcctaggaatgtattcctcacattgtaacaagttgataaccagaattataattgctagtgaatccgttttcttattctattctctgctcacacatgttttaagatgccatgcggttaccagcagtgaatccgtatgggtctgcagcaacctcagttcttgcctcctccaaagaaagaattcaaccaaggaggcagaacgcaggagagatggaggcaatagagcatgagtaaaagtttatcataaaagctttagcgaaggaatgaaaggaaataaaatacacttggaagaaggccaagcgggtgacttgagagatcaagtgccctatttgaccttctgacttggggttggcatatttctagggtcttgcatctcttctcccctgattcttgccttggggtgggctgtctgcatgtgcagtgggctgctggcacttgggaggtgagcaagtgcagtgtgtttactggacttgtatgcgtgctcaggtgaggcattcttcccttacaaatcgaatgaacctagaaggtcatataacaagtaaactctgccattttgcttcttaaagctcatgcttgagtccactccctgaactcctgctgattgcatcaccagtttcaggttttttttctatctattgggagactgccttttcctggcgctggctgtgaccagttattattttagagaggcagttaacaaccacctgcccatcacctgatggtggcccgacattcctggtggagagcagggagagctccctcctgccccgctcaagccttgttactacctactgtaacagtgctatatagattgtcatgatgattttacaggtgtatacgtatccccaaattcatgaagttgtacatattaaatatgtacagcttttttaataccttattaaagtggtgtaaaaatagtcgtgctacatatgactattttgtcatggccactactgtcatcttgagcattgcaaattagttattctagatgaaacaaaaaaggcttgcctttgacaatttctcaacatgtttagtattttccaggttcaaccaataccactttgaactgctctaaatcaagtaagccagaatgtgtctggcagctgaactactgtgaacctaataaatattatcatcattttctattgctaatcaggagttgcattttaggcaatgcaaagtgggtggggtactcactttctgtagatgattcatggaactaacaatacataatacagcatcaaattaaaaacttatttaagtccaatctatgtgaaatagaacaagtgacaaatgacataggttactagtagtaagtggtaagggagctgggttttgatttttttttaaacaaattcttttctaatgcatttattgcaggcacagagcaagtaatcttaccatcagagtttttgtactgcactctattttccttttcaagaaaggaatttcatgaattgttttaagcacagctgagtgttattgttcctattttgtgcattactgttaaagttctcatttccttttcaaatgtgtaattttaaagacgtgatgaattcttaagaataattttatgatgattaggaaagcaatttttcgagctatatacaatttaaattttatagtgacaatcatgaaaaatagaaatacactttgcagcaaatttgcgaaattatttctgctaaatgagtgactcacataaagcaatttgggtttgttttattttattttttgtcattacatcatgcagctgttttcctctatcccaagaatgtaactagtgattgtaggatcatttcaaatactcaattgtaaaatggcagttttacatatctgtggtgatttaaaactctcacacacatgggtgttaatggaaactagttactttatgagtattaagataatttattaatcttaaatataacttttctcattgtggatgtttttggtgaacaaatacattacttcacagttatttttgtggtgagaacacttaatatcaactctctttgtgttttttaagaatacaacatgattattatctatggttgccatactatacaatagatctctcctcctatttagctgtaattatgtttcatttgagaacatctccacattcttccctccaaaccactccagcctctgttaaccaccattctattctctacttctatgagatcatttgttttttgattctacatatgagtgagatcatgtgacatttttctttgtgtgcctagcttatgtcactaaacatactgtcctccagattgattcgatttgtgataaatgacacgatttccttcatttttatggctgaacagtattccattgtgtatatatactatgttttaaaaatccattcatccattggtaacatttaggttgattccacatcttggctattgtgaatagacgctgtaataaaaatgagagcagatacctcttcaacataatgactttatttcctttggatctataccattaacaaaagtgttagatcatgcggtagttcaatatttaatttattctggaacatccatactattttctataatgactatattaatgtatattcccatcaacagttgataagacttctgttttctccacatccttgccaacacttgttatcttttttctttctgataatagccattctaacaggagtgacataatatctcattttggttttgatttgcattgctgtgatgaataatgatattgaacatttttatatgcctgttagtcctcttttgggaaatgtgtgttaatgtctttgcccattttaaattgagttatttgtattcttgctattgagttgtttcagtttcttatacattttgaatattgacaaaatttaacctacatttatcataaaagcactccatgaatgtatcagatgtgtagttaaccagatgtatagtttgcaaatattttctcccattcagtaggttgtttcttctgtcgattttctcctttgctatgcagaaacatttcagattttggtaattccacttgtctatttttttgcatttgttgtctgtgtttttggaggcatatttaaaacaaaacaaaacaaaacaaaacaaaccttgcccagaccaatgtcatggagttttctcctgttttgtttttgtttttgtttttttttagcagctttatagttttgcatcttatgtttaagtcttgttccatttttaattgattttatatatggtgagaaataaggatttagttttattctctgcatatgtatatccaatttatccaataccatttattaaagagactgttttttcccccattttgtggtcttagtgcctttgtaggaaatcaattggctgtgaaaaagtaaatttatgatttttttttatttctgtgaagaatgtcattggtcctttgatagggatcgaattgcattgtagatgactttaagtagtatagacattttaacaatattactactttcaatctacgaacataaagtcttcctttttatttgtgtcttcttcaatatgtttcaccaatttttcataattttcagcgtagagatctttcacctccctggttaaaatttttggagtatttttttatacctatcaaaaaggagattattttcttgatttctttttcaggtagtttactgttagtgtacagaaacactactgattttgatttttgtgttaatttttatcctgcacctttaataaatgtgtttgttagttccgacaacttttggtggagtctttagagttttctataaaacggatcatgtcagctgcaaacaaggatactttaactttttttttccaatttgaattccttatattacttccttttgcctaattgttctggctaggacttctagtaccatgttaatagaagcggtgaaagcagatgatatggtttggctgtgtccccacccaaatctcatcttgaattgtagcttccgtaattcccacttgttgtgggagggaccccgtggggagataacggaatcataggggtggtttcccccatactgttctcgtggcagtgaataagtctcacaatatctgacagttttataaggggaggctcctttcgcttggctctcattctctctcttgcctgctgccatgtaagaagtgacttttaccttccaccatgattgtgaggcctccccagccacatggaactctgagtccattaaacctctttttctttataaattatccagtctcaggtatatctttatcaacagcgtgaaaacaaactaatacagtggatgtccttgttttgttctagatctcaggggaaaagatttcatctttcccatttaatatgttagttgtgggattttcatatatggactttattatgttgaggtatttgtctatacctaattcatggagtgtttttatgatgaatgcatgttaaattttgtaaaaaggtttcttctgcatctattgaagtgatcatattatttttgttgtccactctgttagtgtgatgtgtcacatttattaattcgcatatggtaagccatcctttcatctctgaggtaaatctaacgtatcacaatgaatgatgttttccatttgctgttgaatttggtttactagtattttgttaaggatttcaaacctatgttcatcaggaatattggccagtagtttgtgttcagatttaattgtatcaggataatgctggcctcatctaatgggtttggaagtatttttttcctgtttcaattttttagaaaaatctgagaattgatattagttctttaaatgtctggtagaattcagcagtgaagccatgaggtcctgggctttttactgatgggagactttttatttctttttaatctccttattcaatattggtctgttcagagattctacttcttcataattcaatcttggtaagttgtgtatgttcagaatttattgatttctcctaggttatccaatttgttggaatataattgttcataatgttctcttatactattttgtatacctatggcattggttgtaatgtctgcttacttgtctctgaatatgtgttgagtattctctttttttcttactctagctaatggtttgtctacttcatttatcaattcaaaaaactaactcagttttgttgatcttttctaaggcttttgtagtctgtattttatttatttttgctctatctttattatttcctcccttccttcttattttagatatgggtttttttctttagtagttctttgagatacaagattaggttgttggagatttttcatatactctgatgtaggcatttattgctataaacttcttttttagaactacttttgctatatcccgcagaatatgttgtgttcccatttatatttgtctgaagaatattttaaatttcatttttaaattttttcattgtcccattgtttgttcagggacatgctttttatttccatttatttgggaattttccaacgttccccctgttattgatttctagttttatgtcactgtggtctgaaaagatacgtgatatgactttaatcttaaacttgtggaggcttgtttgatggtctaatatagcatctatcctggagaatattccctgtgcaagtaagaaggaggtgtattctgcagctgttggatggcttgttcttatgtctgtatacctgctatattcatttagtcagtaggacagtttcaacatgatgtttctatgttgattttcagtctggatgaactatccattgctgaaagtgaggtgatgaagtcgcttactcttagtgtatttcagcctatcgcttccattttattaatatttactttatatatttaggtggtcctatgttgggtgtatatatttataattattatatcatcttatcgaattgactactttataatgacctttttgtctcttttcacagattttggcttaaagtctattttatctgatataactatacctagccttgcactttaatggtttccattccctcatttttagtccatatgtgcccttacctgtgaaactgtctcttgtagtgcatttcaacatataattgagtcatttttttaaattcattcagctattcagtgtcttttcattagagaatttttttattatttatatgtaggaacttactgctgtctttttgttacttgttttctagttgttatacagattcattcttcctttctttcttactgctttcctttgtgattaagtaattttcatgaaaattgttttattctttgctttttctgttagcgtatctgttataggcttttgagttaatgttaccatgaggcttatgaaaatcatcttattgttgtaacaagttattttaacctgataacagcttaagtttgattgcaaaaaaaaaaaaaaagacaaagcaaaagcaaaaatgtttacatttttactcgactcctccctaacagtttgaatttttgatgtcacaatttacatcattttatattgcatatcgattaacaaataattttagttattattattttaataattttgtgtcttaactgtcatattaaaatgtttggttgctacaccatcatagagtaataaaatattctgaatttttgtgtacttacattacagtgagttttgtactttcagtgatttttgttttactcactggtgtcctttcctttcagcttgaagaactccttgtagcattctttgtaaggtggtgactaactctctgcttgtgtttgtctgggaaattatttatttatcttatttctgaaaaacagctttgcagggcatagtattttttgttgacagttttttcccccagcactttgaatatatcatcctgctctctcttagcccgtaagatttttcttcagatgtctgctattggcttattagagctctcgtcatttgtggtttgcttcttcgctcctgctgctttccaaatcctcttttttctttgattttgacagttgcagtataacttgagggtaatcttttttaaattaaatcagaatgaagactttttaccttcctgtaaatatttctatctttctccaagtttggaaagttttctccttcaatttttaaaataatattttacctttaactgtcattgcttttttttgaatgccaatgattattatatttgctcatttaaggttatcccagaaatcctgtaggctttctgcattttctttatttttatttcctttttcccctttgtatattttcaaataacttgtgtatcagtttagagaatcctcttccacttacgaagttcttctgttgatactctctatagatttttaaaatttcatttgttgtaatttttagctctaggatttctgtttgatttaatattattattatttcaatttattatttcctcatcatagtcacaatgttttcttcatacctttagctgtttttctgtatttttttgacatttgttgagcttccttaaaacagttatttttactttatcgtgaggcatttttcatacatctccatcttttcagggttagttgttgccaattacttttgtccctttggtgacttcatgttttcctgattattcttgatttttttggtcatgtgctgatgtctgcatactgtagaagtagatacttattccagtctttgcagtctgcctttgtctatgaatatccttcagtgttaagcctgtccagaggttaagagtgggccacctggtgtgatccttaagcccgtgaccactgcagctattgcagtactagggggtgccctatatcctgaaccaccatggctggtatagtgactggtcagaattttatggatacagagcctgccacaatgcagggctaaaagtccatgaattctataattagtgcggtgctagggtgtgcttgaagcccatagttgctgaggctagtgcagcagtgggtcatgtctaaatcccatgacctctgaggtctgcctgttgtggtaggttatttagaatccaaggctgctatagttggccagtagttatgtgaactagaatttgagtcattcttgcagggcctgggggttcctatcttgcactatggtgggtctaaaggatcaggctacagataccaggctaaaatcagagatcatgcaggtctacctaatgctggtttttactgtggtgggcctggtatttgtgtccaaggcaaagttctacgattgcttacctctctttctcccaagtgaacagtgtctctctctgctctgtgctacctggggttggaggttgggtaacatgggaaatgcaaaaatgtccgttctaccttttttggtgtgtcttttctaattattgtgctatgacaaggtacagtcatcttttacttggttttcgtagctcttgtgagatatttttacctatggatagttgtcgaaattgatgtttcttccggtgggtgatcactggagagtcttaattgacagtcttgctcggccctcctcaggtttgactattcttaatgtcctttttctattgggcacctttaaatggaacacttaaaacagacacgcatcttttaattattttacagatgagtaaaagaatcaaatgtgaatttattcaaggtaataaatattggtttaaagaaattaccatagatcttaatatagagaaaatcataattgtggcttacctataaagaaggcttggtgctgggcattttcttcttcattttttaaattctgtacgtctttccaacacaaatgccttctaaacactgatgatgctgtaattcttatctccagccatgaattcttcataaaatctgagacttatttccaaattcctctagttagaggactctagaaatcttaccaccccatgaggatagttataatgatctgaagtccaggttcccctgtaacaaagcttgtcaggtatttgaaaaaaaagaaaagatgtaacactgaataaaaaagaaacaaaatataaggaaaaaataacttggaataaatagaaattgtacaggggaaggaaagcttaaaaaattaatatttttagatagatccaaataatttatttaaaaatgctataataaatagtgtttggaaattaaaaataagacatggtaaattaaaaatgtaataggagacatttaaaaaaatagtcaatatgtttagagaaataaagttgagaaaggaaatcatccattaagtaaaacaacataaggcaatgtaatagaaatatataataggtagggtaataaagtgtgataacaaatattaaaataatgaaaattatacaaagagaaactttaaaagatgcatttattatataataatttactgtgagctatgtgttttcagaattaaaaataaaaagagaatgtccagccaaatggatgaacatacactcacatagagacatgtaattatgaaacttcagaaccataagagtaaaatgaaggttctgcagcttcctgtggggacaaaaacaacagcaaacagaaaatatatcacatacaaaggatcgaaactcaaaatggctttggactttccaacagcgatactggaagctagaagataatccagttgtgcctatagaattctgaaggagattatctccagtatagaattctatagtgagctaattattaatgagttgttagaatgaacacatacattctcagacaaacaaaacgtcacgaaatttaccccctttactttcatgccaagcaagctactagaggattatttccatccatttgggctgctataacaaaataccataaactatcaataacagaaatttatttctcacagttctgggggtcaagaagtccaagatcaaagtatgagcagattcattgtttggtgagggcttgctttctggctgatagatggtgccttctagctgtgtccttacatgtggaagaatctaacttgctctattgggtctcttcattagggcgctaatcctaatcatgagggcacttaccttagaaccttaacagctcataaactccccacctcccagtatcattatcttgcaggttagggtttcaacaaataaattttgggggacacaaacattcagaacatagcaaggatgttccttccaaaaaaaaaaaaaaaaaaaaaaagaagaagcagcaaactggaaaagaagacaaggatttagaaaaccaaaggactaacagaaaagggttgtatctctagcattatgaggaagagaagtcccagagtgactatctgtcctttcaaacaaagaaatgaataaggaagatattagagggagcataaagagagtgctacataaaaggcaaattaaattctgaggctgacaaaaaatgaaagtcctatattgacagctgtatagcatgactagagcagaatcaattccgatagaactgagttctccatgtaggattgcaagtagattacattatgtgattgatcttgtacgtaattataatgagagactactaaaacataagaataggcaaaccaaccccccccaaaaaagtagcaagttaaaaaggggctataaacaaaaagcgagaaaaaaataattattgtacactacactgataaattttgaataatacttgcaaagttatattaatacaaatatctaatattattaaaccaaaaaaggcaggataactaaactgctatgataaaaaatggggaatagaggaaataacaacgtaagagttaaaatctcaactaaaatcagtcaatagaaaatatttaaaattaataaatcaacaaatagatacgcatgcatattatttagagatatatataagatatatatacaagaatgccacagtaaagagtggataatggtgattttgagagataaagcaaagaaatgtctacttttgttaggaaccgtttaatgccatttaactggttgggtgcagtggctcatgtctgtaagcccagagttacgggaggctgagtgaggtggaaggactgtttgaggctgggagttcaagaccagtctggactaatatagtgagcccccatatttacaaataattttttaaaaattatccaggcatgatggtgcatatctgtagtcctagctactcaggtggctgaggcagaaagattccttaagcacaggaattaaaaattactgtgagctatgtttatgccattgcactttagcctgagtgacagagaccctgtctcagaaatttcaaaatatcatttaactttgtttttgcttgttaattaggtacaataacaatacattcaaaataagaatatatttccatgatatttggcgaggaaatatatttggttagatgtacaaaaaactattgaagaataaaatcgatgaattcaataatattaaaacttaaaactcatataccaaaaaaaaaaaaaaagaaaaagaaaaacggtaacaaaaataacaagaaaactacaggaagaaaatgaagccattacatagattgggataatataattgaaacttaaacaacaaatgaaatatttattttcagaatatacaaagttctaaaaataaaccagaaaataattgaccttgtagaaaaatgagcaattggtcataacagaagaaaaaattcaaatgtccaataaatataggaaaatttacaaatgcaaattaaacaaaaacatgacacttcttattggctatataggtaaaaatataaatttccggaataccaaatatttactggcaagtggggaagagaaattttgcctcatatactacttaaaagtctaggttggtacaatcacttttacaaatagttaaactgtcatcgtatggcggagttgaaagttaatattcctgataagataaatgttcctgataagagaatatttacactaacagaatcttagtttaattcacatatactgatctaattactgcaactcacacttttattattgcctttattttgtagatgagaaattgaagcatacagaattaattagcttctccaaggctacctagctagttttgcttgtgttaaaacgaatcaactagataatatggaatatactggaaaatatattgttgagtaagaagtaaaaacaaattgttgagagcacataacagtgataaatgtataaagttttaaaacacaaaataaagttttatgtgtatttaaataatacagtgacttattccaaaatcagaaaagcacagatgtggaagacacccaccaaactgaagatagtattggtctctccggaggcaggatcaaaatatcaggaagagcttcaaagctatgtcatattttattttttaaaatgatccaaaatatatggtaagattcaaatacttgttaaatctgggaggtgtgacatagttatttttgtattattctctctgattttctatccacgggaataggaatatttcataactttaaaaagggaaatgatgtaatcggtaacattgttgtctcctctttaatctcacagatattcctaggagcaacccttgttattttttatgatccatacacaataaccaatattttaaatatattatacaaaagtattgtagagaaggaaaaataatttttttctctaccctactgggttcctagctggaatagacccctgcaacaaaggacaaatgaagaacataaaagcaaaaagaagtttattaacttgtatacctcatttacatgtgggagatacccagaaaaatgagtaagtcaaagacatggcttagagattaggcctaaataccaccttcaactgaaacaaagaaagaaggatatgggccagggtgcagtgatggtaaggtgaccaagaaaagtatggtaatccatgataaattctattatgcagacttaaaccagtgccttctccactgaaaagagtctctggtgatttagttatccttttcttctgggtactgaaaggaagccacccttgcaaatggaacattcctttagagataagtatttctctttaaaaagagtaacttctacttcattttcagagcttctttgttgtctgcagtttctcaaaataatcagctcaaaataatccttatggagacatattttggggtatcctatcctggtttcctacagtatcatgtatcttattgtaggagggggatgatagtctttttattttacttattttagattctttttcttctactcatcatagagatggctctacccatctggctggagccctgtaaattacactggaaaaagacagattaacaagaaactaaaactaaatagaaatttattaacatgcacaccatgcacatgcatgtatataggagtacccagtaatgagtaatccaaaggggtagttagaatataggcttatataacatcttaggctcaaaaaagaaaaaagcgttttgggcttctgggcaaggggtactagttgggaaagtggctaggagaagtatactaaacaagggttgttttagtgaggtttgttatacagatttatgtaggtgtcttctcaatccataagatttaagagttatccattgcctgatatgggaaagggagatatcttttacaaatagaaatctcctttatacatgtaaatttattttacaaaatgaaaatttatgccctgtttttagagcttttctggtgtctgccattcctcaggggcctttagctcaaaataatgcatatgctaaagaggtgtattttggggttgcatattatgatacctttcaatataaatacaagaattaaatagatgacataaaatgcatattcagaaaaaaagaagattcctcctctcccacaagaaaaattaaatttattttctctaaactaaatcttttctgtattttgagttttaaagtgtgtgataataaggaaaatttatgagtataaaatatcttcatatacacttctagtcatcttccttttagactgtgagaacatgaggctcctgtcattttactatgtttccttgtaatgcttttgttactggggagtatggggtccttggttcctgtcttcttggaggaaagaattctgccaagtgacacacaggggcaattcagcaatggcaatgtttatttaaaggaaaaagtacatgctgaaagccgagtcagggtgggctgctccagaatgagatgcattgactgacactggggaaccccctttatgagagttttacatgaatatttacaaatgggcataaagaggtgttaccagtaagcacattttgggaggtctcaaaacatgtgtactacactagtacatatgtcgcatgtttcattagtattttaaatccccactcatgggtgtgttttttactattatgatgagcaaaatgttacctttagggtgagccaagtcaaaatgcacatgctcgctactggggaaagtccctattgaagtgatttttctgctagggccaggtaagtctcagtgagggctggataagcctaaccataagcccagatgtggctactgttaattctgattgctctaaccacagagcataaattttctttttgcattgattccaagtggtgcaaggtatttagagcttctggggctttctttcctgctatctgtctgtctatctacctgtctatctagctacctactctaatgcttttcttcatacaaataaatgcagtaacttgtcatgaaattttaaaaaataagaaaaaagccaccttttgtataattatagttatattattgaatttcattaacttcatcagattaatgtaaattaaatatctgagcatatttaatttctagtttcttggttgtgggttgtgggctgtgtaagtaagaaaaaagccacctttttttctgggtttcctataacctgactagaattactaaggtatctataattaatgtaaattcagctttcataaaattaaatatcttaaaatatctgagcatatttaatttctagtttcttggttgtgggttgtgtaagtacttcagaactatctttagtcacaccaacaaaagagaaaatcatactcactctccaataagtaaattacaaaaaaaatacttatttccttaatagcttttgacataataaaatacactaaaataaaataaatgaacttctctccctaatcatcaatggaaagaaaagctaagcttctaataaaataagtgcaagttcattttcctgtttcttgttaaaattatttaatatgacaagtgtctaatacattattgcatatcaacacaatattatccactaaggaaacacctaatttggggtggccccacgttttcaatagacccaattattcaacccctaacattctattcattatttttttaggatccattagcaaaatattctaaactatcatttgtagtaacaataaggaaagaccgtgacttgttaatcctggttataagcgtattgaatgacctactcaaggaaggaggagcagaaaataatgagaaccagctggttctaaatcttccattatttctaatatataaggagagaatgaactataatttttatggtcttcatctgacaatacttcaagaagaggtcgcttactatggtgattcattttcaaaatttacactttagtttactatacctggtgtgggaaccagtttgcttcaagaaattataattttaggaaatggaaaaaatatttttcctctattcatattaggtttattggttgggtccctgcaaattagactgaagaaagattagttaacaaaagaaaacaaacaaaataaaaaaaacaggagttttttaagacatacattgtgcatacacacgtaagtacgccgtcataagtaactcaaaggattggttacaatgtaggcttatatagcattctgacaaaaataattttatagataagcagcaaaacaaaagaaaaggactttgaacctctgcggccagcaaattgtggaaaggcaaatatgtagggagactaatggtagataaagcctagttcgtaaggtttatttatctggactttttctctgtaccttgttgtctcgggtgataaagtggttattctttttctgatacaaaaattgagaaagaggagagagacatagccttcacaaagagaagttgttttgtgtgttcaggtagatagggggagggcagagaggtcttctggtgtttggatttttttttttttcagttgccttaagttcaaaatatttttaatgctcaattgggctattttggggtaatattactccaaagcttttcattaaaaaatagaaaaattatacaaatgccttccaaagatctagattatgcatatatagaaaacacaaacacatacacaaacatacatataagtagcgcaagtttccatgtcaagtgtacctatctgtctttactttgttaaatgtatcacctcttgctaacatgtatgtcttactatttagtagtgggagtaattcaaaaacactaaggtcaatgttctgataatcatccgatttttccccattctgcttataaaacatcagatttataaaaacctaatgtctgattgagaaaaggactcatgaacaaaaatcaagccatataatgtctaacaaaattggtggttattatatggtagcagtttgacaaccgacagttttcatccagacttagtccgatatgtgcatttaccttggctgtagaactgtgttgtttatttcacttggagttgtgctgaattaataatttcccttcaaaagggtatcattagtagccagtggacttttcaagctgtttattttgaatttgcaattcaattgaatgaaaggaaatacatataaatatggatcatttcagataaaaataaggcttttgttttagtagggaaaatatagaatagcttaactcaacatctagtagaatatttatcaatctagttcccaacattaatgagagcttcaactagcagcaaattctatagacttccttctacctagagcttaagagataagtcatcagcttaaattttggagtgtgactgtcacaatgtttcaacaaaatcagtcagattctttagaagctacacagttttcacagttattaatgtatatagatgtatatgaaaatacatactgatgtaaatttctatgtagctctgcccagtggaagagcctaggagcaacaatgctccagtatgctccagtatcattgaacacaccaggcgtctatatcttggttcttttttttttttttttttttgagacaaagtattgctccatcaaccaggctggagtgcagtggcatgatctgggctcactgcaacttccacttcccgggttgaagtgattcttccacctcggcctcccgagtagctgggattacaggcatgcgcaaccacgccaagctgatttttgtatttttaatagagacacggtttccccatgttggccaggctggtcttgaactcctgacctcaggtgatccattcacctcagcctcccaaagtgctgggattacagacgtgagccaccattcctggcctagatcttggttctttagtatcatttttgattaatggattatgccttcttgaaaaaaatgatgaattttggttctttagtatcatttttgattaatggattatgccttcttgaaaaaaatgatgacttttggggctgaaacaagacacgtatatatgaatctaaaatatctatttgtgccagaaagtaaggaaataccagaggatgatggtaacctggcagaagtacatagcagtgagtttagaggggataccattggccaaatctggaacaatttgagcatcaaactatgtagtgatactaccgtattataactcactgaataaaataggaatctttcagttcatatagttatggacaaagacatgagtaaataaatggagagaagagaaagctttttcttgtagaagagtaccaactagtcagcgcagaagtaatgatggaatcaggaaatcaaaatatagcaatcattgtagtgataatcaatgctgctaagaaatatactggctgagaaaactagcaggttaaaatgtgatagggaatggaatatttacatcttctaaatgtacctccccccgccccaaataattcttaattgtaaagggaagaaatggtaccttccacagtagagaagctggcatgttatcaaagttagtatcaccataaatggaacaaattaatatcctgccccatctgaggaagcttcaccaccgtgtatttctgccaaaatacctaccctgaatttcatcctgaggaatcaaaagacaaacccaaattgatgcattgtcaatgggagaactggcctgtgatatagaactatcaaggctgggtgtgatggcttacacctgtactccctgccctttgggaggctgaggcaggtggatcacctgaggtcatcagttcaggaccattttggacaacatcatgaaaccccgtctctactaaaaatacaaaaattagcttgacgtggtgacacatgcctataatcccaggtacttggaaggctaaggtaggagaatcacttgaacctgggaggcgaggcgggggttgcaatgagccaagattgcaccacttcactccagcctggacaactgaatgacactccatctcaaaaaaaaaaaaaaaaaaaaaaaaaaggaacaaggttgtgagggtaacagaaagaaaagcaactgttctggattgaaagaggcataaaaactaaatgtgacatgggattctgaactggatccttttggtattgttggggctcagaaaaccatactcaaaagtgaaggcctcagaagcagcctcggaagcaaagtttatctctggcctcctattccgagccactcattctcctctgagacaagccatggaaactagaattcatctccccagagcaggtcttaggaaccagaagccctttttcccaaagccagccatacaagctaaaaatattgttgtcatattttcctgtcttatctgggtaagagctggccatagagaaagtctctgaccttcctcgtttgatggcagccattccagaaagtgtccagcaccatattcaggaggaaggaacaccgcatagagaggccaagaagaatccagataagcctggctgggtttccccacctgggtctactagaattagaccagatccttttgtctaatcacagttctgcatgcctgtccattcttcattgaacctaagcataaaaatggatacttttccctgttcctttaattcttcatcctgagggctcccatgttatgtaaaaccataatgaaatatatttgtgatgcttttctcttgttaatctgtattttgttataggaatgtcagtcatgacctttatgatggggtgggaaggagtcaccccttttctgctccaatattataaaaaatggtggtgccataattggggaactctaaataagctttgtgcattagatagtagtaatagatgtaaaaaccctcattctaaggtttgtcatggttatataagagcatattcttgtttgtagaaattacagagtaaaatactggggatgatgaaaagtcagccagcagcttacttttaagtgattcagaaggaataaaatgtgcttcatagtattcttaaaatttttgctgtaagtttaaaattgtctgaaaaagagaaaaatgagaaagtaattaggaagatgaagtagtacttttgaaaacgtactaatattaaggagtaaattttaatttgaaattgaacctaaatagtagttctaattgtggtcacaacttgaaagtaaatgacagattaattttagagagttttaattctatataaaatttaaaagttgatcagtatgaaacttgagaattgtgatatttgaggctagtcaagaatcaatgaaactaatttaggcttagaaatatctttgagaagttgtcatgccaaagcttttgaaaacataatttgtaattagattgaatgttttgatttggatataaaactgacttagaaataataagagcagagcaagtgaaagagctccccaatcctgcccaaaactatgtagataaataaataaatactgaggccttttgggacctgctagtattgcagccagtgtaaacacagatgtgtagtgatgtggaaaaatgtgtttaaaattgaatctccaagttgacaactcttatagatgataaaaatcaaattaatggatcaacatttaccaaagttcttttaaaaccattttgaccccccaaaatgacaaacaagcataatccaaatatgtgtagaaaaataattcaatgtgttttcttgaataatagtttattaaatattaattatatgatagcaagtatgttgtagaatgattaaaattaattttctaagtcattggtcctatttttgaatagattcaaatagatcaaggtaattttgacagaacgggtcaaccattttgctagtcactgagagatgtccctggaatgatggtttgcagttgtggtgtactaaatattgaggggtgtactagacctggagggaagtgaaggaaatattaaaacttccatttgtctttggaatgagaactaaacttttagctttgtgctaagtggtttcttcagtaaaatatcaatattttatttatgtttttcttacattaagcatccattttagctaacctcacaaaatatactgtccctaaaaactcagtcttcatgtaaacactttgataccagctgttcttccatctaaaattattttcttcctcctcattgccttttcttcctgaagatgatcctgtcttcaggatctagttctctttctgccttttcatggaacattgctacaatacttcatccgtgtccgtctatcccctctgaatatttacagcatatgttcttagcataatttattcagaaagtaatcatcattgtcttgtgacatataaggaagtattttcttaccgtttaactctatctatacttctgcaatacaatttgaggttcttgaaagaggaatcctgtcttattcctctttgggataaggggaatattggtagacccaatgtctaccatgacccaaatacagtgctaagagccgggaacagaaatctaattatttctctcttccgacatgctttgtgtttatatgaagttgtggacaagttaatgaaagatgcaaggtaaaaatatgaatgcacattagctaatttgtctatattagaagcacagtgagttatgaaatggaaaaagggatgtttgtggcatgagatcagagctctaacaatgcctctccacaaggagacttccagtgatgtttttctggcactcagcccttagatatcattgaattaattcactaaagcaatctgtatgctgtctatgctcattttaatgttaattattctgtgttccaaaacaaatgtattttctcagcaggaattaaaatttcaggaatataacataaaaaaccctgtatcgtttgaatttttcataggtttttttctaattaaaacatatattgttaagtgcatgtttgcttttctaaaataacacctagtaatttgtaatacattggtttgttctatgagtgtggtttatgatggtctaccttttatccactggtgtaatatcttacgttttatcagtaaccatggaaatgtttagtacatcatccaacaataaataaataggctaacttcccagaaatgaaagtaaataattatttatttaattcaaagtagagaacatagcatggatttaaaaatcttatgtaagatccaataatccaaatatttaatattttctctttggtttaacataatgttcaaatccgaaagcctgctttgctcaccaacacctcccacccaacaaaactgccaacatgccaaaccaagtggattgatttaacagcaacattaagctcccctgccagtgtttggtggaaaggcggttaatccggagtgaaaggcctcaaatcttgccaacaggaaacaaaaaaataaagaagaggccatctgtaatacatactcatagttagtcagtccctggagattcttcagctctttgtctgcagcattaagaaacacatgctaatatgttattctcttttgttgactgctctaattgagatgcctgacaaattaatacagaatattaagattattaatgccaaatggaaaaagaagccttactacaaaatgtcatataaaagttatttgtaaacgctaaggaattaatttcttaaattatttcagcaaatgttaactttaattgtgctcaatgaatgtttatggatgcttttgacacagtggtttttttttttttcttttttccctcagagtatatttttaggcagtttaggaaacaaaagataaatgaatgattagttgtttagtttgtctgattcaaggcatagattggatttaaaagagcaggaagcatgagctcttgaagtggctctgggcacactgccccaatttctggatctcattggtaaaatggacagagtagggttactgggggaactgtgataatataaagttcttagcacctgtctgacatttcttatttttagttatattgtattgttttgtcttcaaatgcagcagataatcattttttattctatagctaacatgctggcatcatccaaaaaagtgacttctattttttttaattaccattttgaaaacaccatgccctataacatctaaagacgcatttactttagtgagtgggaataatgataatataatcccatggcttattcataaaagagaaccttggagatgctgtggtaatgagcaggtggtaacaattcttgattatttatacatttttgaggatataatgggattgagtcattgaactgctgttgtatcaatatgtaaatttcacacatcagttttttttaaagctgttttcttttgaatttaagaagggtaaaaacacaccagaaatattttaaaagagaggcctcagatatctcttaaactatcatgttctgttcacattcgtcaccatcaaacttatattctatctctaatatatcctacacattggcacatggctcccaggaagtagtgtctacagtaagaaccgagaaggtaatatacttgctctcaatttcttccttcttaggaatgacaggcaaaataactgtcacttctgtcaagtagcaatagatactattatgaagtatatcgtgtggcaaaatctctgctttaactgagtactttaaaagtacttacctaattttcattgcttgagtactgtgctcacccctttgggaacaccagaaatttgataattttctatctgagttctaggagattgaaagctgtgcgacttttcaaaaactttctgacacatgagtgctaatttgagcagaatttagctagctctcacaagtgatgaaagcgcggaagaaccagtgagcactgtcagtcttttaatctagtatctgattgcttgtctaactgtcattggtgaaaagcaaatatctttgttcttcttctgagttcaagccggatgtgctcctgtatttagcatgacaggaaatctcaaacggcaaagaattacatggatttaaggaatctgatattcctgtattcaaatctcccctcttgttcatgatagagtcttctgtagaaaatctataaaatagcaagaattaaaaacatactataaagtatatgtttggcttatcagaaatccatacaaactactttttctcagggcctcttaataagaactggttccatttgatgagtgagttgcaaactcttgaaggcatattgacagatggtttcatctgaacaaactgattttcttgatttgccaaagtgcctaaaaattagttttcaaatttttgaattatatttaaggcattttgcttctgagaggtgacttttgacagacccatattgcttcttataagaaacttaggtgaataaggcacaaaatagtttctagaattacttaattgtttttcaaggaaaaatggggctcaaagtgaatgggccacagggaagttacagctggatcctgtagagatcactgagaaaggtctactccctaggtcactgtgcacagaaagacaggcctactgtgattccacagagaaaaatgtgtccggccaatggacactctgagcacataaactactgaaggaagagagattgatgatttgggatgcttgagaaaaattttcctgcatttattcttaataatatgttagtaatttaagctagtaaaaaaaaaaaaagaaatcaatgtaaaggatttcctgacttctcttttctactgcaaataaagtaggttgatacatttaaaaagggctattctccttctccttcaggtcctttatttctgcttcttcttctgtcatattttattttttttctcacgtcttttcccaccatcctcccagttgtcttccttcccaacatcgccatttatttcatattatattcttcagcattacacacacgttatttaactggaaagtataataactacagccatttcttaaaatacaacattaatgggatgtaatttgttataacatgccatttgaaaatactgcatttttttactttagtaggatttctctactagcaattgtaattattgtattgtgatgtttcctatgtatgctataatatatgctataactgcctaccttacctacagatgaaaactctacaaaatggtttctaaaagtatctcaagtaaaatttgattttgtttcaaattacctttaaatttttaacattcttaacttcttttttaaaaattacaatttttcataatgccaaagataggaaatagtgagtaaaggacagtaaactgatttatttagcgagtaaagaacagtaaacttatttttactaaacaactctttttacaatacactctcaagtctaaatttcaaaatgttaaaaaaatgattcttgtacaaatataaagtgagcatatatcaaagatttatttaacttattcatgaggaaactagcagaatactacagctggtttaaaaaataaaagatatgagagaatatgatcaatgaatgaaagattgttgagataaggttacttcaattagatacaaaattggctaataatgtcctataggcaataaatctgtaactgagccatcatttctgttggctggaaccactaacatctctatcagaaaaaaaatcttttgtaatttattagtcttctgtaagctgacatttatctgcggagaacctcagttctattcaatgataaaagaaaaatatgcatttctctagaaaatcagtgttttgtaaacaagtttgttagataattcttcagtatgataaggcacttagtaatctttttaccataatttcagttttggataatttatcttactaaactctgtgtatattccacataaaatccaataaaagtaccaattatactggttaggtacagaatttttcagtctgatagagagctgcaagacaagcccaatttctttcttgaaaactgaaacatagtgaagaagaatatttacctaactccttgtcctataatacccactctatgactctgtcatggcatgtgccctaaataaacactgtccatgtctgttatttgatttgcgtgagagaaatgtatcagattttaacccatattgcataaattactagggtcttaactggatgactggtttggatggggaaagggataagagaggaagaaagaatgaataggtgaaaatcttctcactctaatgctttattcagataaagttatttagttttgatagacaaactgaaattgtattcacattttttaaaagagagttttattcaaaaactgtttttggaaacccttaaacttctaaattaaaagtcatatgcaattgcaacaatttgaaaaactggctgcatgagccagttaaacaaatagtaaagtatttggataaccaggcactaaggagattaaataaagagccgctatgttctaaatgttgataagccaaagacaggatagtgtgtatgaacctgctagttcccttgaccaacaggcatctccttctaaaaaggagtttgagaccttatcttgagaataacaattaagggcagaatcagaactaatacctcagtgacaatttgtacaattaccagtgaagattagctgcccaagatgatctagatctccatactacaaatctcttttcagtgagtaatatcaaaattatctctgtgtaagaatgcgtgataagaatcaggacccaaagagttaaaaaatatagtttatggaaatcattatttgttgttttagtaatccctacattttctaagtagtactgagagtttgttgtccaattggaaattcacatttaaaactcttaatctcaaaaaatatatcactaaggaagtaattatcttctctcaagtgcagccagtttagctgagtgtcaaacagcatttctacatattatttttctctggtgtggtgctgtctccttgggcttgtcttataagttgtttcacgctttaacactcaataaatgcatgatagttgaccgaatgttaacttatgatatacgacatttttctctagatgtctcccaagttgggagtactaccaaaataattccccaaaaaagcaaaaataaacaaacacaaagtaaattcaaacaaaaaaaggccctgcatcagtatccatataaccttcctagaagggcttcctttataggttaaattttaattgtgtttggtgttgtgggtagagctgtcagtattggaatattcatcaggatcttgatattaaggacttattatttattactttattttatgctcaatgacccttctgcctattgcatgtaaggcagaaatctaggtagaaggaatgcaggtgaataaagatggttagtccctagtcaacatggttcaaacataatatgagaataaaacaagtgtgtgaatctttacagtacaaagcagaaagtactttgtgtaataatgatgtttcagagcaggaagaactcacaactaattagttctaatcaaaattggggtataaaagagatagttgctgatagaggtcatcaatgatacatagaatttagctagaaaaaaaataagtggacagaaatgtcctggctatagcaggtagcgtgagaaaatgaagaatataaaacaggattaagacaatggagtagtatagatatagtatggtatggtatggtatggtatagtacagtacagaatagatatagtatagtatagtacagtatattagtatagtatagctatagtgtagtatagatgaaatacataatgtttgtaggtgattgtagttgattgggaaaaatagattttgcacatatcatagatgatcccaaatcctaggatgagctattacacttgatgcaatcatcaccaacataccagtgaaggcttctatttatataagctgtttaaaaatatttaatagaatctatttttgaatatctttctgttgttctatagactttattgaactagtgtggaactggattttgaatgcctaattaggatgaatttcataacacaatagaaaggctacagggttaaagggtctagtctggaatgatagatgcgcacaaattatgtcttgaccttgattgttagttgtcttattgaaacactgtacagctcacaaaaccactgggccccatatctccttgttatatggagttctcctttatttgagttgatccacttaatgctgtcatctggaggaaaataccagactgccacactgtgctgcattcttagtgcatttgttgttattcatatacactccgtaaggcccagtttgataggaaatttagaccaatgaaataacacagctcacctcctgactcctataatgacccaggaatattgtgtcatcaacaacaggttttctaaataatattgcctttaaaaatactttttaaaatatatcaggggcttggaagtttgaacatagtttcagaagtcaattgaatatttccttcatcccagcataaatccaggaaaacagagaaaggcatggagtgggatacacatagtcagagaacactaaggttgggcaacaaagaaagaatgtagtttcatgttcttagaaatattattattaagatgcatttcttgttaccatttttcagtattttgtgattaaaataaatgaggcaacccagtacccgaggttttggatgcatgcttttgataaaaatcctgaaacgagtacatgattacataaggaatcacgcaagttcaatgagcatccaaaagtcccagaacgagcttgtccagcccagggtacgcaggctgcatgcagcccaggatggtttagaatgtggcccaacaccaatttgtaaactttattaaaaccttatgattttttttggcaattcttttttagctcatcagctatcattagtgtgtgtattttatgtatggcccaagacaattcttctttcaatgggcccagggaagccaaaagattggatgcctctattctagaagctgattcactctcagcatcccacatactcccttgttttttattacatattctatagacatcattatttcataggtccaattaaaatgctcagggcttttgttttgttttttagccagttctttgtatgatatatttctcagactaccactatcctgatcagtgtaaaagataagactattattccccttagcatgaatattttgtttctaataatttgctctaaggtcaaaatagtgttgtcatgtgtctcacttcactcacttttctcacagttataaaacaacctcaaggtttctccaaatcaagctgttcttacaacaattttcttcctcctcctactggtttaattcactttggaacttcaagatatttacacaaatattcaacaaacttaatcttattatgttttacctccttgtggtttttgttatttccaaatgttgcctcagtcatgtaacaccttgtttttctcctaagcttttaaccccttgaacatttgataacaatttcttatttgcattcatcaaacataaatcaatttttgacccatagagggttaaagatagaacactccaatcatgaaggacactcatgtacttgacatttatgtatttataaatatattttaggtatggctatgcaaccctattttctcttattttttattttttgtcatgaaaatatttttcaagtttttcttatttttatatatatgaaatattctatactcttttggccactttagctgtcctgtagaccctatctagaccttccggagttttgctatttctttgttgcagattgttgaccagaattacaaacagtatctcatagaaacactgatttctacaaagtgagataaagcttcccattttatttctttggtctgatttcattgtaagagttcagtgagtcattgcctgccaggagtcatctacagtgagtcctagatcagtccacagctgtgacgagttcactattccagaaatacaagtttgaagaacttcctacccaaccctcccttagaaaattacccaaaattgatcatgtaaagcccactttctgcttctccatattcatttttatggcaaagtttccccactggcctggattttcactatgcagaagtgttcagggttatctacaaacataatacctaaattgtatatatttataacacatatatatgtactctatatacacatatattgtactatatatgtgtttatgtactatacatatacgcacacatgtatatgtactatatatacacatacacaaacacatggtttttttttttttattactaacctaaatataaaataagatctctggagaaaattttgttaatgtgtttccatcatgaaaacacacaataaacttgtttattgttctatctataacaaaatatttaaactacttttatcccaattcgaatatcattcttgtggaatttgccaaagtatttttttccttcaaattggaaaacaaacatgggactcttcttgggagatatttatattcttaatcaaagaacttcattatattcatcaaacaccacagcgctggtcacttacatctgtctaatgaattatatttggtgttcattgactctattctttttaatagaggtcatggtttgttatctatggaaccgagaatcattaatcatgacttggaattaatttgaagagatgatttttaaaaacttgtcataggcctgccttttgcagtacagggttcagggttccttgcttcatgataaacatttgcataaaagattgaagcttttagaaccttatcgtgttgttcaaatttagggatattaaaagaggaagaagcctgagatgaacacgggcacggcaactgatagcttcatccactgaagagggattttccagttgcatgcttgtttctctccctacatgtgctaacatttgtttagaaattttatattatgttgagactaaaaaaaatcaactctgaggtataaattttgatagtgcaaggacccatttatcatgcttgacatataatcttttaaattaaatttttattgtgcaatgattacagtttcacctttctttgtaagaagactttagagagatgccgtgtatcctttttatccagtctcctccaatggcatcttgtaacactagagtcaccaccagtatattcactttgatgctttaagaatacaaaatacttccatcaccacaaggacctctcctgttgtcattttgtagcctcacatacttccacttgtattcctcctcaacccctagcaaccactaatttcttggcatcatgaaccagagaatttattcatcactaaatctgttctgccaggatctgccactcttcagccaaaactcctagttactcctgatgacttctaggcatctgccctccttgggcatcaagtttactgccagttgccttctgagtcacctgcagtcaccactggagatgtaattgagtcctcatgtgccaaacttatttggttttcaccttaaaattattttttaaaagactattattcccacattttccctctacacttggtttactaatttgcatgtgtagtttatagggccaagctggcaataagttactgttatactcctctctttatttcccgaatctcctattcatgttccagtttaaactcagctgggaacaccttgtctcattcagaacttaatcacagtctttagatatagtcttttttgttttctttatatgcttattattaacatgtagtatccagtatctaatccagtaacagtcacaaattggcccatcagtggcaagaaatttaaaaaatggacactatagtgaggactaaattcaaaaatgacagccaaactggattttctcaagcacattctgctaatttgtattacgtttaaagagaaaaaattacttttgggtaattgaacatctatatcgcaattgcaatggtggttacacgaatctatgcaactggtaaaacctgtttataacaaaaaaaaagtacataaaaactagttaaatcagaataaaatctgtagtttagttaattttattgtgacaatgccaattttctggctttcatgattgtaccgtatcgtgtagaatgttattattggaggaaacgggggaaggttacataggaactcaactgtattagtccattcttacattgttgtaaagaaatattgagactgggtaaattataaagaaaagaggcttaattggctcatagttccacaggcaggtgaaactgtaatcattgcacaataaaaatttaatttaaaagattatatgtcaagcatgatgaatgggtccttgcactatcaaaatttatacctcagagttgatttttttggtctcaaaatgatataaaatttctaaactaatgttaacacatgtagggagagaaacaagcatgcaattggaaactccctcctcagtggatgaagaggaatcatggtgctagcatctgctcagtttctggagaggcttcgggaaactgtcaatcatggcggaaggtgaaggggaagcaggtgcttctgatgattggactaacaggaagagagtaagggggaggtgccccacactttaaacaatcacatcacgtgagaactcactatcgcgaccaaggaggatcttgctaaaccattagaaagcacccatatgtggctgggcgccgtggctcaagcctgtaattctagcactttgggaggctgaggcaagtggatcacttgaggtcaggagttcagggccagcctgacttacatggtgaaaccccatctctactaaaaataccaaaaaattagccgggtgtggtggcacgcccctgtaatctcagctactccagaggctgagacaagagaatcgcttgaacccgggaagcggatgtttcagtaagccggaatcatgccactgcactccagccctggaaacagagtcagactctgtaagaaaagaaaggaaaggataggagaggggaggggtggggggcagggagaagaaaggggggaggggaggggaggggaagggagggggataggagaggggaggggaggaaggggagggggaagaagggggaggggaagggggaggggagggggaggggaggggaggggaggagggggaggggaggagggggagggggaggggacgggaggggaggggagggggacggggagaagaaagtggggaggggagggcaagggcaaagaaacctcccatatcatccaatcacctcccactaggtcccacctccaacgctgggaattacaattccatatgagatttgggcagggatacatatccaaactgtatcatcaactatttttgcaactactatgtgagtctaaaattatttcaaattaaaaaataaaggcaaaacccatcaaacttacagattattatgtgatttaaagttcctatctctctcattctgtatgtgtgtgtatacattacacgtatatatctcagatagctaaatgcatgtgcttgtttgacatacaggtgtgttgctgttgttttttttttttttaaatttttatatattttttaatttgttgagatcacccaaggtgaaatgcagtgacacgatctggactcactgcaacctccgcctcctgggctcaagcaattctcatgcctcagcctcctgagtagctgggatcacaggtgtgtgctaccacgcctggctaatttttgcctttttagtagagacagggtttcaccatgttggccaggacggtctggaatgcctgacctcaagtgatccacctgcctcagcatcccaaagtgctgggtgccaccgtgcccagcctgacatcgtttttatggatttcaaaatataaatgtatttacattgtttgaaagttcatagtgtatataaaattgaagataggatcctgagatacgtatgaaagcattataatgcacaggtgtttgtgtgaaacatagattgtatctgaggagaaagaaatgacagtagaatactaatatcaaaaatatataaataagatgataggatcccaaagtataattttgtttgctttttagactaacaaaatattaccacatctaaataaatgaaaaacatgaatgacatatgctttttccatcgatttaatttttgttaacaaatataaaatgttttagaattttacttatagaattcaaaaatgtttccttcatatttataataatacttaaatatggaaatgaatacatcatctcaaataacactgagttcattcttggaatgtctttttttttttctgttagagattttctttcattttctttttatttttccccaggatgctatcatgcctacgtttctcctggttagtttcacaggatattttccaaagagaacttgaataaaacagacttgattaccactgttttattctcaaaataagctaatggctattaagacttgttccttgatttgagggggctttttggtatacttattcaaaaaggcagattcaaaataagctctctacttctttattcctcagaatctctgtttgtatgtaattggctaacaaaacccattgcttattagctttgtctcagtgctaaaaaaaaaaaaaaaagtccttaaaattattgcaaacctgcatctgtcacacctgattactccaggaggaaaaacaaaacaaaacagaacagaaaaaaaaaaaaacaaaaaaaagaaaaaaaaaaacttgctttggataacattttatgacaatagctttgcatcaggggacttacttatcttcaatgtgtgctctattcctcatgtcactctttcttccccttaattgaggaaaatgtgttcagaagttaaagttgtggccatctatttaaagttttatattattcagcttagaaaacaaataaaattttcatacgtacaagggaatatagcatcactcaagtaatgcccatcacattgcacaagaagtggataatctttcattacaaaagaaaagatggaaactgcatagatcttctgtaaatcagaagctgtataaccagctacttaactcaaattctaaaagccacctaatgtttgtatgtggatgacaccaatataacaaacatattgcttcaattaagtcaattatgttaatttgttgaaaagaatctgttaactgaatcattcagtatcccttaaacaaaacatagggtgataattttgcaaattattatttcaacttattgagttggcaacgtatgaacaaaaggcaacctgcatctatgttttaggataagtaattaggttctcacagactgagattttcatttaaaaagatttcccttttggacagtttataaagtgaattggaagagagactggaagcagggagagcattctaagagctctcaggggagaaggagggtttggccaaatacagtggccagactcgtgaaaagccgttactggagaggcaggacctccagcacctgggacattgtgaatgtgagtgaggaagaacaagagccatggacatgacagagattctggctggagaactaggaggatggcagcatcagcaaatggtgtgggtggaaaatagaaaataaacacagttttgatgataaaaaggcattttgttaacatcttgtagccattcaaataaagatgtttaatagaaagttggaaattcaggcctagatctcaaaatccaacttagggctggagatgtggatatgggaatcagtctccaatatttagatgggaatgagacctcgtagaaggaggttgagttgaaaaagtcagccgttcttgtccaagaatacaaatgggatcacagtctcatggagaagaaggcattacaagaataccaactgcaccaaaaaggttccttagggttaaaactaataaagaaggcttagatttcactttattagtgcagaagactaattgtagcacagtagaagagagatggaaatgagcttctatccttgaaagtttggatatgaaattgtctcttcaagaagtttgggaggtcaatacaaaataatgcaatattgtaactgaagaagtgagttggaaaggtgagttagttaaaagacatttggtggagtttgttttctttattttttctctgaaatcaagactttaggcttgtttcattaaaagagttgaggccgagagagatgttaaggaatacaggggcaccgtagaggtatagctaatggaacaagggagaatagagttagatgagaagatgggattaaacagcccgagtaggatttgtcccctgttagactgtagaagaaggccagttgggtagtagactgtggctagaccacactttattaatccgtttgtcagtaaatacacatttgagatatttctagattagactgattatgcataaagctaccaggctctcaggaggtcagaaaataaatctaggtagtgaaggaaacagataataacaaaataacaggaataagcaaaatattcctgttgaacttacatttgaagacaaaaaagcagatgatgtcacttgtgagaaagtagcgagaacagcatgacctttaataatccatagaagaagaagaaaaatccaatgaagataaaggagaagcaatcacagatcaaatagacatatgcaaaataagatatgttcttttttttttttttttttttttgagacggagtctcgctctgtcgcccaggctggagggcagtggtgcgatctcggctcactgcaagctccgcctctcgggttcacgccattctcccgtctcagcctcgcgagtagctgggaccacaggcacccgccaccacgcccagctaattttttgtatttttagtagagacgggatttcaccatgttagccaggatggtctccatctcctgacctcatgatccacccgcctcggcctcccaaagtgctggaattacaggcgtgagccactgcgccgggcctaagatacattcttgagtgagaaagattccaggagaagatgactaagggagatattcaagaagaattttaaaaaagattatttcattatcatcagttacctcattatcatcagtgatttttctgatttgatttgaaagaagaaacagcaacgaacaaattgctaaagtttaagagagcatggaagaggagggaaaaactgagcaaacaccatctattagagaagttttgcagtgaaagggaatagaaaaccagacagtacaaatggagaaacataatgtaaaaagggttttttttttttcttcccaggaaagatgaaatccaaatatattggaaaaaatggcttctgtagacccaagaattgtcacttattttagctcttctatattttgaagaaacattacctggtattaatcatccaatagataataaaaatggaagcatatgaaattgaggaagagtaaaattgttaatgctcaaatcagacattacatttagtattagaattattaatatttcatggcataaatttatccaactaaagaatttcacattttgaaaaagataaaattgaaagatggtaatttaccttgctatcacaaataattctcacattaactaaaacttgataattttgttgattgtatgcttataaaaagctcttggttccacattcagaaaaatattttatcccaagtactttccaaagagtatatcatcatatttgctgccattaatacttaacaaatacctgcgaaaagcaatggttttggagggtaacctgagggcagtataatctatctgttcttctagatactgtaaacaatttctagagtaagcttgtcagtagggagctgaatatctatctgcatcaaaagtgttggttactgctataaatttgtgtttactgagctgaggtttggcatttttccatggggctacattgaggaaaactgtaatgtatttcctatgaaatttgttgctgtttttatatggattttcttgaacacttcattctttatgtagcatagtttcttttatgtgaggatttgggaagtttctttctgggctcagtaccttgagtattatgcttctgcaagcaactggttagattttatttaagatgagccttgaaactaattctgtctgcatttatgtgatatgccagaaattttaaagccaaatttttagacaccctcctatgcaacaattgtttttggtttttcatatttttatcaagctagtacatagataagtatttttaatcaatttgtagagaaataagttcatttaacggtaaagttctttttccccaatatcttcttatttcctgttccactctccctttatacttttatatcaatttgttcgcttataaatgtagaatttgcctattggttaatgacttcttgggtcaattactagttagctgacttacttttccacacatctgactacttttagaagttatattaaggccaggcatgatgattcatgtctgtaatcctagcactttaagaggccaaggtgggaggattgcttgagcccaggggtttgaggctgcagtgagctgtgattacaccactgcacttcagcctgggctacagcgcaagaccctgcctcaaaaaatatatataatagatatttttaattctctattggttaattttattacatttaataatatacttacaaataggtctactcttctgtcaaattttggtaatataatttgactcttcacttggaagatgagtatattatttaccacattatttcttctacattttcgtatccatttctacctccaaacctctgcttcttaggttgtattttaacattgccaagattgataatgttagatttgtatttctgtttgtctaaatatttatttaacatatcacaaaatggatagcatttatctaattattttcatcctttcttatggcttgacatgaaggataaagaaaaaattataggaggtttggaaagaaaaataatatatttgagtaaaatttaaaatagatttctgatgctatattagattatcatctgaaaaaatttatttgtcaatatcttagaaattcaaatatgcatccattatataatccagaaattcttctcctaggcatttgtaacaaatgctcacagcaattttatttgtaatagtaaaaaaacctggaaacatcccagtatctatcaatacaaaaatgggtacaggttatagtaaacttagacaatgaaatagtacacagaaaaatagaaatgtgctactgataataacgatatgagggaatcttaacaaaattgttctgagtgaaagaagccagtgatgtttgattactttattatgaagttcaagaaaagtcacaattggctgggtgcagaggcccatgcctgtaatcccagcactttgggaggccaagctgggcagatcacttgaggtcaggagttccagaccagcctgggcaatgtggtgaaacctcatctctactaaaaatacaaaaattagccgggcgtggtggcctgtgcctgtagtcccagctactcaggaggctgaggtggaagaatcacttgaacctgggagatggaggtttctgtgagttgagaccatgccactgcattccagcccggacaacagaaaaagactctgtcaaaacaaaaggcaaaattaactatggttatagaaatcagaaaagtgtatacacacggtgaggagtggcattaattgaaaagaatattgactgaggggattgatgagactaatttctgggataataaaatgttctatatcttgatagggagtgagggtcacgtgagtgatcacatttctcaaaactaatcaaactattcactggttttcagtttactgtattaaaaattattatcattctttttaaaaaaatgacgtattgctccctgaacagtctgcagtttcactgagagatcaaatagtaaacattataattttactattcattataaaatgtattatgatataggtaagcacagaatttcagaatgagcatcaagtaaccccactatgcatttatcaaatctgtttcactttccttctgtggcacatattccagtctcttggacactaaggttaagatcaatatgatacatgaccaatggaatgtatgcagaagtgatattttcttcatcaaatctggccataaatcctaagttcattcctatatgtttgtcttctgtttctgtggtggacttgagaatcagatgttgatgacaaaaaccaaatgaagtgagcccggatccctgaatgactatgtggaacagtgctcctctgtccttttctttctatactgaaatgtgatgtgggcaaaaatcaatcatgtattatagtaaaacgctggaaagaaggaaacaagaaaggaggggaggaaggaaataaagaagaaaagaaagatggaaggaaggaaagaaagagagaaaaaaaggagagagaaaaaggaaggaagttggagagaaggaagaagagggagtcagagagtaagaaaagaattgatggttcttctgccagtgacttagactggagataaataaactatgggaggcaataaagccattaaaaagacagtccacttgttgagtaggctgagaacaaatgatcacaaagaaggaaacctattgaataccatcatcatgtgatgcccctaaagaataaagagaaggaatcaagaatcagatttttaagattttactttattaattttcaaagtcaaattattgcttgcaaaataatgctgttcttaatgcttctagtacgattattctaaaatgctttcacaacattgacaacattaagaagacaagatgtatttatttgggtaaagagcagtagggtctagagaggatattgctgcatatatatatatgtatatatatatatatatatatatatatatatatatatatatatggaatatgttggcatgtctcacaatgtttgacatgattttgcaataaaaaagagtgtatttttagcatagttcaagtgaattacccaagtgaacaagctaaatttgattggggtggggggttaatttttacatctctcctggcagttctctcaagatttttccatgattgttttctttttatcccatgatctctgacatctagccacattacataattataacgacatccccctacaactaggaaacccttacacattaccctggtgtctttttgagtcagtctagcatgctctattttttttcctgtaagatattatcaaatatatggtttttaactaccaatggtaatagaactggtttttgtacatccagaaataacaagacctatgaaatgtagatagatgggaatttggaaatgcacatttatattcatttacttaagcacatttattgaccactgaacactgtggtcatcagatacacagggaccaaagaggtatggtctgaaacctcacagctgacttacatacttctgaatcagttagggagttaatcaaaaacataatgaagtaatcacaattgagtgaagaggggaaaaaaaaaaaaaaaacacaggatgctcttgatacaggcaaactcccaaattggggcttagccaggagagttattggcttcatacaggaaagaactcaagagtacaccaacagaataaagtgcaagcaaagcaagtttattagagtaacagagtagggaaaaacggctgctccatagacagagcaggacatatgcagagtagcacttgtagattgctggctagctatatttatagctactccttaattatatgctaaataagggccaggtaattcatgaattttctagaaaaggagtggggacttcctggaaccaaggattcctctctttttataccatgtaaggtaatttccgggcattgccatgccatctgtaaactgtcttggtgctggcaggagtgccttttagcaagctaatgaaatataatttgtggataacaaacaatgaggacaactagaggttgctttctttgccgtcttcgttttagcttgtttattttctgcatttgaaacaggagttttcccttttcctcttcacagggcaagtgataggggtgtggctcacttcttcagtgctcccctgctcaaacccatagggagagcgtgcagatgggcatgtcatggagctcaaaccccatggcggtgtctagggtttagtgtttacagctcctgaagccctagtgggtgtgtgttaccttgtgctctcttagttttgccatctgcaggtggcttgtgttaatcggttcaattagaccccctgccttactgcaaggacagagagctttctgtaccctgggttcttgccttggtgtatcagaaaaatcggatcacatgtggtcttcaagaatgggtgtaaggttttactgaatggaggcgggtctcagcgaggtggatggggaggtcagaagggggatggagtgggaagctggtcctcccctggagctgggccacccagctgccagactctcctccagcgtcccttggctgaatccggtgtgcttttccactcctctgctcctctcgatgtccagacacttgtggctgtgtccactagggtctcagggtttttgtaggcacaggatgaagggtgtggagggccagagtggtcttagaaaatgcaacatttgagcgcaaaaacagaaatgcctgtctgcacttagttccgtgggcacaggccccagggtggagccccaccaggaccctgcccttctctatccagcacttctctgccctcctcccatatcgcattctgttttgaccagatcctgctttaatcagtagagtcctgactggtgctcagaaaaaaagtcctgctgatctcctactatgaggcaccctatggaacgaggggattgaggggtggcgaggcaaggtccctcctgtcaggaagtgctgtctgagctgagtcctacaagatgtggaaggccagccagatgaaactaatgagcagagactccaggggaagaggccagattggaagggtaacaggtgcagtattttatgaaggtccttcttatcttcctgcctcagcagggaatatagctagtcctggaaactcacatcaaggccgcaaaatggaaaatctatttctacattttgacataagttgttagcatggggaaaataaaatctaaaatctggcaagaaataaaatttcaattaaagggaagtgattgtaatgatcacaggtttagtatattaacataaagaatagtcaatatgtgtttcaatgccacagagtcattttatgttttaagcaagtaagatctctcactttagggaacattcacgtcattctcacataagttcccacctatgagacctgttgtcagtagcgaaaagctcttcctagatttagttacacaatagctaattgttttaggcacttttttttagtcttaagtaaaacctttacatgaagatacagagtctcattcattcgctataggagcttgtgatcttttatgttaggtctcctaaaaagtgaggatttagttaggaataaatatacttattctcatcataaaataatttgtgttacacttcaaaccccataatagtaaatttgagaaaaaaaaaatgttagttcatgcatcatacatagcatacttctagtactttatatagtctcctccagtttgataaattatattttccaagtgattacaaaatacttttccaaagtttactggttcttaactgtcaactggctggaaagtcttagacttgtgcatcctgtctaacttgcaagaaagatttaatttcaaagactcttagtccatgggctggcaaactgtagcccatgggacaaatcttgtccacgcctgttcttttaaagtttgtgagctatgaataatttttacatttcacaagtgtattttttaaaaaaaggaagaataataatatgggacagaggagcatgtgacctgcaaagcctaaaatatttactgtctggtactttgcagaaatgctttgcttcactacctcttagaccatctgaaatattgttttagctagaaaaaacagtgcacctagtggaaaattttcagttattaaaacttcagggatgtttattctaaaattaacattgtggatgacttacaatatgttaaaaaagttctaaattttggtatgtatttgtacaatttataagacaagaactctaaaagtagaaccataggtttaacattttattatattgattttaactttccttaacatcaagctttgtgagatacatatatgctatcttaattataataataaaccctattctaagcatatatacaaatcactgcctctaagagagatttaatagccagaacatgaaattcacaagttgttgtaaatggattttttattctttcaatgataaatttggctggcattttttatgtatctgcaaagcacttgtatactatttgtctaaatgaaggtttgattataaagagtattgttctatgcaagaaagattcaactttgctttaagtttttaatttttgatgcaggtttccaaatcttaaagattgtataaaaactcagctgtgtatctttttttccttttcacacctatatgaaaaactgtaaatgagtttttaaaagagccaagtgatatgaaaaaatgctccttttcaagacctatgatagtttattctttactttagtatttactaaataagatgccccctagctgacaaattcttctttccttttaggaaacagtgtcattcaaacttttaaattacttgtattaaaactgcagaggactttgggtgctgataatcacaaaagaagcttgatttaggtaaatgtgtgagaaaacataatattattgattttgtaaaaatttgtagaaataaaaaataaggagagaagtaaaatatgaacactatattagatgtactatctaataaatagaccagatatcaaatgtgtatctaaaaagtgatatgataaaaagcatccatcagactttaaatttgatattcaaatatataacattaaatatcaaaaataaaatatattgtatataaatgggaagatatttatttctagttgacaatttgattctcaaatgaagagagtggaagaacttgttactttgtcccaagtttgtctttactaggtattcgacatccagttttgttttttttttcccttttttttttttttttttttattgagatggagtttcgctcttgttgtccaggccagagtgcagtggtgcgatcttggctcactgcaacctccacctcccaggttcaagtgattctcctgcctcagcctcctgagtagctgggattacaggtgcatgccaccatgcctggctaattttttgtatttttggcagagacggggtttcaccatgttggccaacttctctgagtctgtttcctgatttgaaaaaatagcatccctgacaattttagagttttctttgaggcacaaacaatacagactatactagaaccgtttaaataatagatatatacatgttagacgttgtttttattaaatcaacggctacatctccttttatgtttcctaccttatcaaatactgatatttatggagacatttcacatatatttacagctttgtaatcaagacaatcaatggttcacgcctatggtattcttttgaaatatttaaagcttcagttaggaaaatgtcttaaatctcaatatgcttggatgaaagaagtggaaaaatcacaatctattggcacacacctatagtcctagctactcaggaggctaaggtgggaggatcgtttgatcacaggaattcaagggttacagttagctatgactgtgccactgtactctagcctgggtgatagagccagaccctgtctctaaaaataaaatataacaataaaaataacaacagaagcacaaactattgattttgagaatcctgaagaaaatatatagcatgcatttttccataagtaaagcaaaggcaaaccttaggtaaagcactattattctaaacctcaaatgtccaataacatcttttaattttgctggtgaaatctcaaatgcagtatatctaaatcttcactaattatctttcccttcaaatattgttgtattagtcaatgttatttcagttgctcagaaacaaacaaataaggaaacagatcaaataatccaaaacaccttagcaagctctggatttagatttctcaaatgatgtcatcgcagatgtgcttactttgtctttctctgacttccactcctttgtaatatcaaaatggccaacagaagctcagtgggaagagcacctccattcctgcagttttgtttgttttcttttcactcagcgtgcattggagatcccaaggtgtggtagctgtcctgctgttcttccacaccaatgttccaaacctctcctccctgaacaacctctgaagcacttgtggccatattatttcatctatcattttgtattttacattatgcaatggtcttctactatcttcttgggaatttctctttactcagagagggggattttagtgctttcattgttaaaaattataagatgtataactttcttgcttaaaactctctagtagatttcccttccagcacacataaatgaaatctagagcgtgatcataatgtacaggccctcctcattctgtccttgacctctccatcttctcccctgttcattccttcttcacactcttccaacaatactgacttccttgctacccccacaaacaggcacagtatgctcatgccatttgcctttctggcctttgcataaacgatatatgtaattgtataattataggatttacatataaaaacatatataacaatatgtacatattacatataacatagtgtcagtattgtatgtgtaggtatacatatatgtgtatgtgtgtatgtgtatatatatagacacatattcaggttcaggagtacatgtgaaggtttgttacacaggtaaacactcatgtgacaggggtttgttgtacagattatttcatcacccaggtattaagcccagtacccaatagttatcctttctgctcctctccctccttccaccctccactctccaggagaccccagtgtctgctgtttccttctttgtgtttattagttctcatcatttagctcccacttacaaatgagaacatgtggtatttggttttctgttcctgcatttgtttgctaagtataatagactccagctccatctcattcttttttattgctgcataattttccatggtgtatatgtagcacattttcttcatccaatctgggttgattctatgcctttgctattgtgaatagtgccagagtgaacatttgcatgcatgtgtctttgtggtagaatgatttatattcctctgagtatattccccataatgggattgctgggtcaaatggtagtttttcttttagctctttgaggaatcatcatactgctttccacaatggttaaactaatttccatgctcaccaacagtgtataagtatttccttttctccaaaacctaaatgtaaaacccaaaattataaaaactctggaagacaacctaggcaataccatcctggacataggaatgggcaaagatttcatgccaaagacatgaaaagcaatcataacaaagcaaatattgacaaatgggatctaattaaacctaagagcttctgcacagcaaaagaagctgtcaacagagtataacagacaatctatagaatgggaaaaatatttgcaaactttgcacctgacaaaggtctaatatccagcatcgataaggaacttaaacaaatttacaagagtaaaacaaccctgctaaaaagtgggaaaaggatatgaacagacacttttcaaaagtggccaacaagcctatgaaaaaaagctcactatgtagtttaataatataaatgccatgaaaactgcaactctgtctacattgttgatttgaacaatatctgctacatagaagactctcaaatatctcctgagtgaatgaaaggtgaatgaataaatacgtaagtaaatgtatgaatgaagcattttagcagaagggctaaaactgagtctcattgagttaggtgcccacccctggtggtagggagtagtgtctgcctctctagcatcatatggattaagagtgaatttttttttttttttttttttttttttgagacagagtctggctctgtcacccaggctggagtacagtggcgtgatttcaactccctgaaacccctgcctcctgggttcaagtgattctcctgcctcagccttccaagtagctgggattacaggcgtgcatgaccacacctggctgatttttgtatttttagtagagatagggtatcagcatgttggccagactggtcttgaactcctgacctcaagcgatcagcccaccttggtctcccaaagtgctgtgattacaggtgtgagccactgcgcctggggaagagtagaatattaagagtgaactttttaaagaaaagccagatgctattactcaaagggaagaggttgctgagcagtcgagcaataaatgttcatcatatctttccctctcttcccttttctgtcaccaatgcctgcacactaatatcttggaataggttgattatatcttctactcccttctttcaagatgttaataattcttcttttgaaatatcaaatctgtcttttatttatttattgcccctaccaccacattggtgttgaccttcaattacttgttgctaatcttcttgctcccagtatgatttcccattaccctggatctcattaatatggcttttattgttatttcttaacaacaagaacaacaacaacaatacatgctatattattttgtctctaatcagacagaacctgttaaaagatttatgatttttttcaacataactactttctgccagtcagacttgtgtctttattcctattccttgtgtattcctgaacacccttggttcatgtttcccgagaatctacaatcttagttcaaaaattcattttaccaataagcgcatcaaatctttttgtgagagacatacaggggaaaggaaaagtattttttttaagtcctagagaggctacccatacaaagcaaaatttcagcataactatccctggactctgggtcttataccctaggtctgaaatcctcctttatgccaacctattcttcaatatatcctagcccctttctctcttgtctttcaaacaccactctgtccttctatgcagctgagctctaactctgtagaatttgcctgattacatagccttcagggaactccaaatatcggtaaaattactagttacgtaatgcacttccatagttccttttaatgctgccttttgcaatatctttttagattttattttaggcctcataagactgcagatgtcttagagacagtgtttcaggagagatttttgttgtttttctaaatattgacataaaacctagcaacatgctaagcatatagttaattttcaagttgaaattgtttggtggcttttgttgagtattatttaagatcataaattttggattaacccatatccaattgtagatttaattcaagtgattttggtcaaggattctaattgttcttgcatttgaagccagagaacccaatagagatctgaaaatatagccatggtttaatggaatgcttgtttagatttttagattctttgtaaaactaacagctggctagaaaagtacctacaaagaaaatgtctttttagaaattgtttttctgatgaaattttgtcaacaagatgcaatgaggatgctctattaagtgttaaaattcaagacatactgctcaaatagttttgttttatggattacagaagtgtatggctatttttaaaaggcagtggtagtacgcagctcatttgagaaaaccaagaagagcacagcaggaatcgtcacagaagaacatcccaatttttaaaacatgtaattgtccatgttatagactaaatattatccattatgtggattgctggtaccatctaaaggttacataaaattgtttcaatgcggaggaaatctttcagtatacttctcataattactaggccttacattacacattttgtatttcggagcgcaggaatttgaccggggaatgcgggttggataacagatctactacaaacttgcatttgtgttgcttggatgaacttaagccagtgctttcaattccgaagctactctgtatttttttttaattaaaaacatctctcgctctttactttgtatgagtagtctaactttaaaacatcattattaaagataatttttttaaaagacaaaactcctggttttagatagaagcaaattcagtccttaggcaaagaagacaacatactaacaatgtaatataatgcctgtgttgcatcttttcatgatttaaaaaataatttttaaaatttctatttgtatgattttaagataatttaaatctgaaagttaatatcttctaaaagataaggctaaaacctcaagttatctattatagggacatttagaatgcatatttgtatgattttaagataatttaaataaatcgaaaagagaatatcttctaaaagataatgctaaagcctcaacttgtctattatagggacatttagaatgcatatatgaagctgaaactgctcatgtttaaaatagcacaagctttcatttatttgaattatatcttctaaaatataatagtttctttctttaaatcttccttgaattataactttatactgacattttctttttcattagatggtaattttttgagagtcgagtctatggtttcacacatccttgaatatcccatattatcttgctctaacttatgaaatagatagtttgtaaatccttgttgaatgatcgttatgtatgcctcccaaaaaatccatttgttctccgctgagaggaaaaaaataaaaaataaaattaaaaaaaaagacaatgtgaactttcagtatcagataaaaattcatggataattattcttttgacagaatcttctataatgaaaaaaactgaattaacatgtttctgatccattgaacaaattctctaaatgtgtctactccaataaaaggtagaaaaccctgacctcttcacaacgtgttcaattgttcttcttctctcactaatgttgaaatgttatctttaaatttctaatggttttatgggagaaaatgtggaggagaattttagagagcaagacatatggttagatgctataaaaatcatttattgtataaattaaatgcaaaatattagaactcatttcaatgtgtatggaacacaacagtggatgccatttagtctttcattcttttaacgtatgtttacatggatgaaaagacccacagaaaatctgacctgttttccacttaaaactggacctattttcacattaagagtaaggaagcagctttcttcaaattatttacggtgtaagaaatcacaagccctaccattggatgacatttgtgtttattctagtagacagaggacatgattgtttctaaagtatttttcccaatttttaaaatactatttccttttccaggcatttcccggaaacattaactctgacggtgtggtccggcacgaattacagcatccgattattgcccgctatgtgcgcatagtgcctctggattggaatggagaaggtcgcattggactcagaattgaagtttatggctgttcttactgtgagtatcgtattgtttaaatttgtggcaggttttatctttatttaaatagtaagctgttttattttaaattatttaacattacttgctttctctgacaataaactaccttctcatttacatatatatgtatctatgcatagatacatatatatataataaaaggttgtgtctctatttgcatgttataaatgtatattataaacacgtacagagactgacatgtcatatatcttaattatactttaggttgaagatttggaaaggttttttttgttcaatagactaaataataaagcttattaataaaattgccttgccttatgaaatatttaaaaaggggaaacctatattgttatctatgtatttgggtctttattatgggttttgaaaacatttcgaagaacttccttcgggttcactaagtatctctcttcagttatgcctattcctatactaaagccaatcactgggttttaaagtcaatgacgctttctctaccaaatttaatttattttttcaaattgatttggtcatctaaagaggttattttcccttaaatatattttaaagctcccttgttatttcttaaatacattatgcatatatctaaggattccaacatatgaatttgggggattataattcttctgtctattgttgctgctaatttttgcaaatggtacttgttttctcctactcctcttcctctctctttttcttcttatcttgtttgcctgtctgtcctttttatccttatccttatgcttatccatattctttactgtgacctcaatttctttaaaattttatctgtggaaatttgtttgggccaaggttgatggtgaattcttcttgagaggatatatctttgcttatttgcttctgtgaaggcgataccaacacagaactgctttcaagattatctccagttgtggttgttgtttctttatgagactgctagatagtataaatttaatctacgaacacgtgatttgcaaacattggcttcaaaatatgaattccctagtaaaatatactttcctcattcccggaaatttttcttccagctgttacaattccctgggggaacaaagatgctgggtatgaacaaggaggggatttggtttctctatgttatgcaaaaagtctcttattagcccgtttcctactcattcctataaacccacaaaaatgagttcacactaagcagaaaatttcaaatgcccccgttggacaagctttctaaaatgccctagacacttagtattttatataaaagaatatatgaagctttcacctctgtacacatttagtaacagaaattggtcaaaatattagctataatagtgcccgaatactgtcttattaattcataggcaatagtgttatgtgcaaactacaataaaggggtcatggaggtcatttaaaaattctcaaaaactgtttatttggttaccattttattgtagcagataaaattagtagagagacaaaagatttagctcttcaggagaatgtagctctttaaaaggaaaatttagcatttctggtaaggcccaaaaagaggtctaacataaattagaatctttggtcctatgtggtctagacattcatgaacagagtgtcatgttcacacatagtcttgctctcagcatagcatcatgacgggaaggccagaagaaaatgtgatatttttgtgaccatcacaaattttgttaagagccatgtttaacttttagtaaataaatacagacacacacacacatatatataggtatatatacacacacatatacatacacacacacacatatacgtgcatatatatatatataatccttcatggagactacgtgtatgtgcaatttattttattagcaattatttaatgagcacttttcatgtgtgataaatatattaaatggtagcattaccacagtagatgagaaagacatggtctttgtgagatgaagtgggacaaataatttaatagagttaataataataaaaatagtaaaagttaaaatttacccaaaagcacatagcctgagtgataggtctgaaagggaacccaggtagtctggtacagtgccaaagctcactatcaccgttctgtttttaatcccagcaaaataagcacccacctgaccgtccacagtttaatcaaaacatcatgtcaacaccccgcaaccactgagtaggccttctcccagttactgcaactccttaaacataaaaattcacctgatttgtatcaccaaagattagttcttgtttttcaaaaaaatttcacacagatggagtcataaaagatgcattattttacacttgacttctttagttacaaatcatatttctgagaattatctgtgctgatattagagatattagtttcttttcctcagtattattctatcttgtgaatattctacaatcatttgtttatttcatgctgatgaacgtttgagttgtttctagatgttggctatttatacagaattactaaaaatgtttccaatgggtatagacttgggggggtaataacaaactagcatatatgtgtgttcacctttggccaataacaacacaaatttttctaatttggttatatcaatttaaagtctccaatgcaattaactggagttcctgatgcttacaaattaagatatttagtattgtttaaaagtttaggccgggcgcggtggctcacacctgtaatcccagcactttgggaggccaaggagggcggatcacgaggtcaggagatcgagaccatcctggataacacggtgaaaccccgtctctactaaaaatacaaaacaaaattaactgggcattgtggcgggcgcctgtagtcccagctactcaggaggctgaagcaggagaatggcgtgaacccgggaggtggagcttgcagtgagccaagattgcaccactgtactccaacctgggcgacagagccagactccgtgtcaaaaaaaaaaaaaaaaaaagtgtagccattctggtgagtgtttgtcatgtctcattttagttaagttatgtttctttttttttttttttttttttgagacgtagtctcgatttgccacccaggctggagtgcagttgtgcaatcttggctcactgcatgctctgcctcccgggttcatgccattgtcctgcctcagcctcccgagtagctgggactacaggtgaccaccaccacgcccggctaatttttttttttttttttttgtatttttactagagatggggtttcaccatattagccaggatggtcttgatttgctgacctcatgatccgcccacctgggcttgtttctgatttttgaaagaggttatgcttattggtcatacgtataccttttttttaagtgttcaagaatcttgctcatatttctatggattcccatttatctatctatttatatatctatcatctatatagcaatcatctgtttgattgttttaagtagtttttgcaggcaactcttcttcattctcattacaattgctagacacgtatttatttttgaggtgacatttttttaacaataataattttaaagcaaacattgtcaatgaagttacttaagatccacaggtgtagacttaaactgtgaccacatgttctgtaattgttacaagtagatttataaagttgtgagtttgtgctgtcatgggcttttccatcaagcctgggctttgacaattacaagacaagaaggaaaaataactgaagcaaatcaggaagcgagacttttccactgtataagtccctttgggggaaaatcatatagctttgggaaactgtattaacatttatatcaatagatgccagtggagtaagtaacttagcaacacaaaatttaaaaagtagcatttcagttggatgtagtaggttgggtaatggcctatcataacataaagcctttattcttggaagttgtaagcatataagtatttgcagatgtgactaagttaacaatcatgacacggagagacaatttttttttttttttttttttttttgagatggagtctcgctctgttgctcaggctggagtgcagtggcgtgatctcggctcactgcaagctctgcctcccgggttcacgccattctcctggggagaggcaattttacattagccaggtgggccctaagtgcaatcacatgtgtcattgtaaaaggtagacagggagagatttcacagatgggaaagaaggagagaatgtgaacaccttggaaccagaggctgtagtgatatggcgataagccaaggaaggccagcagctcaaaaggcagatttttctctggagggaatgtgatcttgccaacacatcgatttcactcagtgatgctgctttggaacttctgacctccgaagttgtgaaagaacaaatttctgttattttaagccactaagtttgggataatctgttatagcaacaacatgaaactaatacaagagtcaatatattttagaaaagaaaagacaaaaatcggcctgagcaatgttctctgatagaactttctacaaagatgtagatgttgtcaatatgctctagccactaaccatatgtggctactagcatgtgaaatatagctaagacaactgtggaaccaaatttttaatttaatttaatttttaattcatttaaattcaaatttaaataatgtgactactggctaccatattagacagtgcagcttagaggaaccaaaacatcatgtatgtttttcatgtctttttataacataaaggacctataaaagttatgttttaagtgtcagtctctattgttttttcttagtttggaaaacaaaaatttaatcatcctgaaaactgtctttactgtcaataatgtaataaccagtcatcttactaaccacacagtcttagtctgttttgtgttactataacagaatatctgagactgggtaatctagaaagaacacaggtgtatttcttaccgttctggaggctggggagctcaaggtcaagggacctgcatctggcgaaggccttcttttcccattgtctcataacaggaaacagagccctcgtgacctactcatgtcttaaaagtcccacctctcaacactgttgcattggggattaagtttccaaaacatgaactttgaaggacgcattcataccacagcgtacaccaaatgtccagataagattctttttcatttattatttttgaagaatgaaaattacacttatctcttttccaagaaaaatatacatgtttacattttaaaatatatatatgttaaacatatttgttacgaaacactttccaaaagttacttccaaaaatttactggctaatgtaaattttctatactagagttcaaactagaatgagtccttagaagatgatactctgttcttgagcttagtgaactgttgtctcaagagctttctttggatttttcaatgagaaaaggaatcatataactttgagtggggaatgtagattagacacagccccccattttggcttcctagagaatagcagtgctgtgtactctagggtctcagcaaggagaaacatagttttgatcctgcccgtggaagagagatgaattctctaatctgtctggaaactcctgaaagggtgtacctgggatctatcttaaacctgcaagagagggaatggggcttctttcactgcaaagtttgccagaaaactagagagagagagagaaatcacaatgtgagcactgtttctgtttgactgtgtgtctggtgcaactccccttgtgtttgtcatctttcctttgtgcagttcctccatgatcactttgtcatctgagaaatgaggtacttctcaaggctgaaataagacgctgactctattccaggtggagaatttcgttccaggccactgctctgaagcctttagggcttctattgttcctacttcctgacttgtcttgaatataatatgaattccaatttcaataaatctaaactcatttgaaatcattctgcttcctctacgtttggttttccctcaagtttagttgaaacaagtgcatgcagttatttttaaaacttagcaatatgtcccatgccttttgattcagtgagctttctcccacagcgcagacactaatcttcttacgcgataccagtgggacttcataaagcaaaaggaagaggtctcagattaataatttcaaaaaatcatttatggctgcattactcaaacattcattttaaaaagccaaacacagtgcactgattaaagtactgagcgtttttgatggcaaatacttaattagtttttagtcagagtcctcttaaaagtaaggacggcaccttgggaaaccaaggtacacacatcgaaactaatttttatataggcttttaatttggatgaataaataataaaacctgtatgtcattcaatgcaaatcgtgatggaaaactgtcttgctgcctgagaaaaaaagaaaacatatcaggagaagttaaatacaaataagtaaaagacagtgtttggtcattttcatgctgtgttgatggcacgtctgcatctctagtgagaataccctcttctagggtcacacactaactcccctcactctcattcttcccaggcaagagatgctgccatgtacagatgtgttagtttcctggggtctctgtaaaacagttctgcaatcttaagatgaaatttaagacgatggaaaggtattctatcatggatctagagggcacagtctgaagtcaaggtgttagcaagggtagttccttctggaagcttggagagagaaacagttccatgtccctcgcccatctcctggtggtggccagaagtccttgatgttctttggctcattgctgcctcatttcaatctctcctttgggttcacattcacatgaacttcttcgcttttgtctgtgtctctgtgtcttcaaatagtcttcttctaaggacatcggttattggaattaggatctaccctaaaccaggatgaccttatcttaacaagctatatccacaaagacccacttttgaaataaggccacgctttgaggttttggctggacatggacttttggaaacactattaaacacaatattatatatacatatatatgtatatatatatatatatataaatcattaagaatttatgtttacatcagtttaagtgagcaaaaaataaaaaatcagttctggaagtcaacctgtgtgttcctacttaaattagatgtttaattttgtatcatacagaagcatcccagatacttatattttgtgtttataatttcttcaatttattcagtgaacctgtatcgcattcaggcatttagaaacaacctaaagcatgaactctgccctcaaggagatgaatttttggcagaataaatgaataagttaatagtttaaatactctatgataaatgctatgacagagaagcaagcctcgcctatgttgattaatgaaataaggtttcactaagaagcaacagaaattaggggtaaaggagcattcaagacaagaactaacattttcaaagactaagagacacagaggtaagaacataatttatttcatatttggagtttttagttagcaacataagtctcatttcagtgtacaaaaatatacaaattattatgttgcttagaggatcaatatatttgtgacagatttgttaatcttattaatattaataagaataaaaacattgaattatactattttaaaggcattttgctaattttaaatcttaagtgcaaatctgaccatattacatctgggctgactacacgttaatgatgctacattgcctataaagtccaagctgtttgtttgaaatttaatttctgcccacccactgactacctctgtagtcttaaatccagtcatattgtgttttatgctccaaatatgaatacaagctatatttcctaatacatgagtgacctgcttgtttaacaggcagtcattggagatactttctctaaccaaaatagcctctccatcatcctttacctgaccaatcttttttatctttcaagattcagttgaaatgcagtctttaatgagaatcatctgaatttccacaatgagtcatgtgtttattttcatatgaatatttatcagatatcatataccattatattacataaatatttccaatggaatatttaacaaaataattcaaaataaagtcaactgcaagatactgggaggaggagacagcaagtgtcaccttattcatcactagcatccccttaaatggcaggctccctgtacacaataaatgtttgctgaaatgaactgacatcaaatgtaaatgatacaggcgtaatttattccctcagtgaaaactgattactatttgaggatgcatagattcttttattggtggaacagggcatgattatattgtatcatattgaacagtgctctaaggggcctacaaaatattgaaataattaccaaactaaatataataatagatgttcaaacagagctatagacagcaaataactcagtgtttttttctaatttaaatatttgtataacttgtattattatttctggttattattttaaatcacacttttttgaggctgcttcatgggttatgtatatggattgcttatcagaggaaaaaaaaccacccaagatccagagtaatgtgaaaataaaagtaacttaacataaaaatagatttaataaatatcactgccaagttatacaagataaactgataattaatgaggtaattaaaattgtcatgtgctgtatgacatatttgggatatgctatgtttctaagttttcatgttattagatttaaaaaaaatactgtaagttgtaaccagagatgttcttgccattaagagatctggaacttagatttgagcacatgtagtattctttagtgcttttaagtatagtttgggtttcaaactagaattggagtgctttgtaatagacagctgtggattgtcattcagtgtcagtttgagataatgacttcctggtctgtacatataaatattattgtagggataaggctaatgatgaaagtgcacatgatagatactttcacataatttgggtataagccttttttgcaggggttggctaaggtagatagctagtggatcagatactcagtggatctcattcctgggttaccatttgagggtgacatttgaaatgaacaaatttaaagcatggaaatatatgttctaattttttattctatggggaaacagctatcagtatttaattgttttttttctagtgtaatttgtttacttggaagaaacttacaattgactttgttcagtgagagaacatggtgagcctacctttatatttaggaacaagacagttacaattggcagctagcttatattttggagaactatttaatatgtcactgatatagagctagagtcacatcatattactgtaaaatctaaatttaaatttactctcaagaactttcaaagttaaactgacatataaaatcaagagtgtcgatttaaaagcaaattaaaatttctggcagagagtaatatgcaattagacctatgtctgtcactctgaaatatgaataacagtatactttctagaataagggagggtataacttttattatacatattagtccaaaatttttcataaaataatttcccaagaaatgtaaacatattaaaacaaaagtatatatacacattttggtgcctggttaaagagaagaataaagtaatgaaaaagaactatgtttcactgtggtttataaataagatattttgattactacaaagaggagccatatgtgtactctataagaacttcaaagctgaaaagttcccaagagaccatccagcccaatcctctattttactaacgaggaaaccaaaacccacagagttatgcgacttgcataagcgaattaatcgcagacctagaaatcctgcataacaatctagagcatagcttcctctctgacatttaatacctctctcctctggttcattcttctttgtttcttcttcacccgtaagggctttttataatcttagtgatggcctacagaaaatacaattttgtgaattctaatgaccatagaaatgctttggcctatcaattatcaccgtaagaatatataggagatatccagtaagaaaagtatctcactagtactgtgcattctacatgtccagcagaaaaatttaaatgactaatcttcataatgtactcattggagaacagcttgcaaataaacataactcaagctttaattgcattttggtgcagaaagtttatcaatatcagttagtgtattttctcaggtaatcttacctcctgagatacgttaactactttttatatatatgttaatttttatttatgatagatgattgcagagagtactagagcctaaattacagttatacagtccatcaacatttcacttataatccgtttaatgtaaggaaagcaataaaatttaaaatgctgcaaatatatataagtgattcctttattagcttttattcttatgttgttagttttcattatcacctatttaaattagctagggagagaagagcaaatatttaagatggcagtaattgtcctcatgaattaaaagtaacaacataataaaataattatttagtatgcacactttaaaaatttcaagcaatttaaattacttgaattagaaatcagtgattttcagagattaaatattcttactcctatcagaatagtatcagatcttttatagttagacttgaaaagaagtaatccagattttcaatttgagatttttatattttctatgcttctaaatgaagcatgtatatttttctcacatgctcaaaatactgtcatattaggtttttcacctttcatgctcgtttggctggacaggaggagttaaagaaactgtcagtgttctcttttattaccaattaatgggggaataatctcaagaattaaagaaagcattcaacccgtaccaatcattttgtaaacatctgaatactctaccctcaggcacccccaaataataatatttgctaggaaaaaagtccttatttatggaatgtttttagcaagatatccctgtgttaggttgcttatggtaaacacttagcaactttagatttatgatcacggctctatggaaaatcacttatcagctagatgaccatggaggaatgaaatggagatgcttcataaccgaaatgcttctgcgtgaggcaataaactgcatagcttattaaggactgtccctattactctaggccagagagcacatgtctgatgaaagaagaaaaagcctgaggaactatgcagtgtgtatcagatcccaccttgctttgcttgtccctctgttttaattacctcctctttatcccatgggtaagggaggattcctgtcctggggttatgggtatgacggaacacctgacacctgacgtaaagcaactgagaccaacagcagtttattagtggcatttccacacaggctttgagagaaaggcatctcaagtctcgcaggggacatgggggttgtccttgggaacagagtgagcaatcagacactgcgggaggcaggatttgttgtatcaagagagtggtcttccccctggttcccaccggaggatgtgattggcttgttcgaataattctgtgggtgtagggtaggagggaacggaagcccaatactcaaggagaagtggaatatgcctgatccccgagggaagcagcgtctttttattggaggacatatccgcaggaacaaagttgggaggggagcttgcagtgaggtcactggagaccctccaggcttttcccagatgtcaaagcacacataaactgggccttacttttcggccttataccacaagctcttaatgttttgttttctacaattattaataatctttggctctacataagatgtttgctttgtgtaaatttgatttaacaatccgaatttaatatcaccgtataggttgcattaattactaactttagccaaatcaacaacatgaacaacatgtaaaatcccatataaaattttttcttccctgttatcagaacagaaaagaaaaacttccctgtttttcttccctgttataaaaattatttcttccttcttaaccaaccatttatcatgtctatttagctgtatgtgctcttttaaacttgctgtgttggctgtatttgtgtatcataaatataaactagaaaatggacaagtagcttcctaaactttgaagtgcaaatgttttattaagggaaaaaaaaaccctctttcccatggcattgcacttccatagaaaatataattatttcccccaaatccttttacagggttttgctatgttccaaaggacagggactgagctcactttgatttgagttggactctgaacatggttggattaacagcctcggtcattaatctctactccaaatttcagcatgctgtgtccatctattacaggtgtgggtgtgttttttgttgaaacaaaataatgtatacttactaatgctaaagttaacgaacaaaagcaaggttagtaatttttgcaacaaaacctacccagtgagggtcccagaaggctatctgagtaatacagtggggcaaatggtttcaattcaatctctggatgagctttgtttgtttgtttgttcatttgtttgtttgttttggagacattctcactctgtcaccgagtctgcagtgcagtggtatgatcatgactcactgtagcctcgacctcctgggcttaagcaatcctcctgccccagcctctgaagcaactgggactacaggtgcacaccaccatccctagcttattttttttatttatatttttgtagagatggggttattttttttttggtttgtttgtttgtttgttttccccacgttggttttagactcctgggcttaagcaatccttctaccttggcctcccaaagtgttgggattacaggtgtgagccactgcaccaggccaagatgatccttttcaacagcgtctaagttaaaatatgctacaaatttatttaagatcttgctgtaaaataaatcatttgaagtcgatatcatgaaacaacaggagaatgcaatgtgtttcctcctttgtcaaccaacagtgtggacccagcctggacttgcccacaaacagctgagcctaaagcctgcttcatccatcacctgaccttccataatgactctatatcacctcatttcttctattttttttaaaaattatgctgctctttctctttaatctagtttttcttcttcttatatcttctttctaaaataaaagagcacataaatgttttaaaacaaattagattttcaactttcagtaaagataaagttttgtcagtagggattaaagtttgccatcctcgacattgttgatatttctggctctataattcttggctttggaggaaagggctgtctcgtacactggaatcttttgcaacatccctggcttctacccattcaatactagaagtgcatcatatttccctcagttgtgacaaccaaaattaacccaaaagtctcctagtggcaaaactgcccctgggtaagaactgctgatatagatggtgctaaagtgtcacctagaaatcagttcattgtgttcctaggaactacgaaaggaaaattgacacattgtaagaattgactcaacattcatttgatttatatagcagtgtctgttatttgcagaaagcacgtactgcatgctgagatttccatagacttcatattgataaggacaatatttatggtgttaaagtatgcctacatatatagatctcctatatatgtactgcagataaaaatactattatgtcacctcatcagcataaatattgcaaaagaaaatgacctcttgaattctcatatcgtttgtctgtgatttgtggagaattacacaacattacttctaaacattttcaatctaagtggttttatttttattaattaggcattactttttattttgccattaaggatatcatcttttcaaccaggatcaatttgaatctgtaatctcctttggttaattggacattttccttattgtgaatttaagtttgggatcaagaggagattgattagatctgccacatagtttggccggggattatttatatagctgtttctttgcatttcacttttgctaaaaaagtagacattcaaaacaatataaatttgtagtctgttagcaaagtgtattctctaatattctattatagatatagtatgttctatagagtatattacactatattctattctattatagaatacactttgctaacagaataaaatttatattgttttcacgcactctattcacatttaagaaacattaaccttcataaatagcataaaggctgattttctctaaaacagagcaaacaaatcaataaaataactttgccccacttcttagcttccacctcaaagggttcttttttgttcgtttgttttgtttttgtttttgctttttgagatggagtctcgctctgtcatccaggctggagtgcagtggcgtgatctcggctcactgcaacctctgcctcccgggttcaagtgattctcttgcctcagcctcccaagtagctgggactacagatgtgtgccaccacgcccagctaatttttgtatttttagtagagacggggtttcaccatgttggacaggctggttttgagctcctgacctcgtgatccacctgccttggcctcccaaagtgctgggattacaggcatgagccaccattcccgtccctcaaagggctcttttcctactaaggaagtaaacgatgcaggcctgattgtgtgtttttttgcacttttaataacaccttcattgaccatgtgacaccacacaataccactccttggtgatgtgcttagcaatcccaaacaaacctttccaattcacataaaatgccacacaccctattcctccctacctcttagggttgtcataagaatttgaatgatacatgtgaatgctcttctgattttgaggatgaagtcactgtgtcatcttaatcatgcttatttggagttgtgcctagaggggcataatacacagtgtgaaaatatgttctattgaaagttcaaacgattgctttagtggttgatgccattaaattggtttggaggatgttttattgcatttaaattggactgaccacctcaaagagctatttggataactctaggcaacctcagtctggcacagataatccagttacttagtaagagtcttgagcacaaaactggggagggggttatatgataattctgattttttttttttttttttgcaaataaaaagatactcttgactgtgatcttatttccaattgtacaatgggttcaccttacaaaattaagtatagtactatccccatgcttgctttttaattgaggaaatagtgggtggtttggttaactaaacaaccatttgttagattaattctcactagcttgattcagaactatacctagtaggaaatattggagctaggaactgagcaataagcagcatttatttagggtgtctggctcatatatattgtgtccttacaacaaagatgcaaaacaggtaattattcccccattttgcaaatgacaaaaccgaagttgaagaagtgaattaacttactctcataacaagcaatgtcactttaatttttggcctttctaccaaagcatgttacctcttaaagacagcataaaatcagagcataacagattcatagaaagaatggttataataataattactatcattactactataattatagtttgtatccagaattgattaatcattgattataggtcagatattgtgctaagttccttatttaaaacctcacgatactgctacaactatcttcattaggaactatcttcattttaacaatatgaaaatgaaggacaaaataattttttgtttattcattcaatcactaagtgtaaaaataagagcgattatgtatttgcttgtttagtggtgccatattctcaaaggtcccaaagtaacaatttaaaaaaaaaaatgtatctgtccttgaggggaacacagtacatctatagtacaatttttcctaagagtagttatttgaaagtcatgacaaaaagggaagtggtcaaataaactgtgttgaacagccattgcaaattatttaaagcaattttaatggcaacaacaacaaaaatatgtattaggtgaagaaaagcagaatataaaattgttaatacagatcaatatctctttcacttagcagtttgatttcaaaatgtgcaggctgggcacgatggctcacgcatgtaatcccaacactttgggaggcaaacacaggtggagcacaaggtcaggagatcgagaccatcctggcaaacacggtgaaaccctgtctctactaaaagtacaaaaaaaatatctggggccgggcgcggtggctcacgcctgtaatctcagcactctgggaggccgaggcgggcggatcacgaggtcaggagatagagaccatctggctaacacggtgaaaccccgtctctactaaaaaatacaaaaaaattagccaggcgtggtggcgggcgcctgtagtcccagctactctggaggctgaggcaggagaatggcgtgaacctgggaggcggagcttgcagtgagccgagaccgcgccactgcactccagcctgggggacagagcgagactctgtctcaaaaaaaaaatagaaaaagaaaaagaaaaaaactgcgcaaaaattacatcaaaatactaatcatatttctgagatgtagtattatggataaccttttttatgtttttctgcattaatattcaataactttattactaatattcaaatattactataatcgctgaaagacaaatgctgtatgattcaacttatataaggcatctaaaatagtcacattgatagaatcaaagagttgagcggtgggtgccaggggccggggaggaagaggaaatgtagaattactattaatgggcatgaagttgagcaagatgaataaattctaggaatgtgctacacaccattgtacttacagtcagaaataatgcattgaacacttacaaatttgttaagagagtagatctcatgtgtttttaccattgtaaaataaaattaaaaaaatgattagtcaaaattgtgaaaaatacaaaacatatataatttgctttaaatatcattttaaaatatgtacaagatttgtatctcaatgtataaattcagatgcacataaaagttctcatccctttatttatcagttttaattttaagcttccatcttgctgttctttcgaaaggcttactctaagtcaatcctggtttcattttatttcagggtcttatcgtgtcattgtgtgcacacacttgtatgtacatacagtgatgcatgtgtgtatacactcatgtgttcccagagactagttgtgatacttacagtggcccctgtttgtatttcctcctccacgattcagtgattctctgctgcttttcctgcagtcttgggaacttgaatcaattgggaatgtgttgatggtccacctataaataattatcccaaaatagcaaccaattactttatttgaaaacaaaacaaaacaaaacaaaaaaacactagctgaataaactagtatacttagtattcggatactaataacataattcaaaaacagttctttggccgggcacggtggctcacgcctgtaatcccagcactttgggaggtgggcggatcacgaggtcaggagattgagaccatcctggctcacacggtgaaaccccatctctactaaaaatacaaaaatttagccaggcgtggtggcgggcgcctgtagtcccagctactcaggaggctgaggcaggagaatggagtgaacccgggaggcagagcttgcagtgagccgagatcgcaccactgcactccagcctgggcgacagagcgagactccgtctcaaaaaaaaaaaaaaaaaaaaaaaaaaaaaaaaaaaaaaaaaaaccagttctttatgatatatataaaattaaaaccatagacagtacctacaatctatattttcaatatcacattaaaaaagcagtgtaatatcagtatattattgtgatttatatgtcacaatttatccctgcttaaatatcatatagaatgcttaaaattgtattaattcaaagaattattcacaatgtcattcccaatgtcactttttagtttagagcagagtatgcatgcacagggattatttgtggtaaccatattatgaagtgtagcattatcttttattataaatgatatgatataatcaaaagagatggccttttgggtttaaagacaaaataaatgccacgtttactaaatgggtatatttgagatgattgcttaagctttccaaatcccatttttgccactcataataggaataagaatgcttacttcatagatttgtcatgaagattaaattagataataaatgccaagtgcttagcaccatggctggctgaaggtaaggatttatacatattagcccttattattattgctgctgttgttcttagttcttccctttggtagtgcatagagtcatgtagtaactgtttgtacttcctatattctcaactctgaaatgaattttattatctagcgtctgttcttaacctcacaagaaaacatgccttaaacattaaataagcataaaaatgaggtcttgatgctcacacagagaaataagcattttccagaaggagttgccttcaaatcaaaatataattgatactactcagaaaagagattttctctctgcactgattgacttgaaagcagaatagaagactggagtcacggagccagaaaatgtttagaggtggctggcttcacatgtattttctagtccaactattaagtttgcagatgaagaactgagaactccctgaaagaggaaacggctcctcctgagacttccccataaggaactagtagcagaaccgtattggatttggttttagtgcttagccccatgctcttccactatattacatttaaggtaacatgtacgttttcatttctattagaagtcatcaatgggtggactttgagtgtgagcattttgccttgcatgtaatagatattcttaaaatagttgtgaaagaatgaatccctcttttatctatcctatatatgaaatgactttgttggtaaaaaaaaatggccaattgctcagcaatttacactagaggataattttacaaccgcaggtatgggacacacttgggttcctttccacacttggacattttatagatgcatttttaagggaggaggagataacagcaatctcagtttttttctggaaaataaaaataattgttgtatgcccagtggaactatgaaggagcatattgggcccaagaaagtaaagaatgtctacacttaagctatttttaaataataaattaattcataggagaaacaggaatgagaggcaaaaatgtctagtaattaatataaagtccagcaaaatgacttaaaaacagttatatttgcaaagaagactcagcacacttatgtcataaaaatccttgtctagtcacagttttaatttatatataaaattaaaaccatagacagtacctaaaatctatattttcaatatcacattaaaaaagcagtgtaatataaaaaatataaaagcagtataaaaaatcttatctagtcacagtttcaatttctcacaattgtatgatcattttgacattataggagagtaaggatatgtaagttagctaagaattacagcagctttcgagaaagataagacagagaagtgagagatggaaagaaatagggacaactcatcgaaatcaatataaaatatgttagttaatagcactgtttgcaatctttaacaaatgtcctctagtggtttttaagtatagcacttcataagccttttgaaatggcatgttaaagtagtattaaaaggctgacttaccattagcatgctatttaatgtgtcattttaatttttaattttggagagttcctagaaatagtgtattgagtgagcattaacaaaagattattaaaactccaatgtcaacttaattgatatatcagaattcttatgacaaatagttcataaatttgtttcacacattatgaaatggaaaaaagtaacaggcacatgctctgtatattgctgttaagtgcatatcctaccataaaaacctctccattgtataacaagaggcttgtgagatacttgatgaaagggtagcatctcacctgctaaatgatgtggaagaattctttgactgaccacaccatctatagagatttgacattttccctgtgcctcacatagcattcttcacaaaaggtgagtgttgtttgtattaccttgaatgcacacacaccgcctttctttcctcccatttctttcccatctccagtcacagttcttatagtgtatttttctgtaagtagttgcaaaatattcaattaatagcagaggggacttattcaatgtcaatatatccttaaataaagaataataaagaagaaattactgtagggaatggaaaatcattctctccatctccaacaaaactatataaaacaaatccattttctaaaaatgttaaaatcttcccagttggctgaccttgtttcagtccagaaagacacagatttttagaactaagactgtgaagcccacatcaattttgcagtttcaagagctcaaattccttatgaaataagctgatgaaagtgtttaacctgtccaaatgaaaaataaaatgctgagtatttaaatgcctctgaaattaagtaaatctgttctatacatgtttttcttctaatttctgcttctgatagaaaatagtttagatgagattgttttaaatgcacaaatggacaagaaatctactgtaatataaagccctgtccaaattccagctcttcccttattagctatgaagccttaagcaagtcattgacctttttggagctcagtttcctatatgtaaggtgaatgtgataatagccgttatttaatattgttaattattaattgaaaagtttaatggaaaatgtcttgcacatagtaattattaagcaaatggcaaccatttgaatcttcactagaggctattttgtattctaagtcaagaaatatattggataagaatgaaattaagttgactacagatgaacttttgatgtaagtatgagcctatttgttctaactaactattcagaaattggggcagtgtaattcttaagtacaatttaagatgatcttttccaactctcatatttaaacaccaggtaaacaacattaggagtggctgtagtttgttggttgccaactagctggttagtggcagacacagatttgaacctacatgtctgttgtgtggataaagttttcctcttatatcctgtcacttatatgttcagtttcccttgtatcttaaaattttatgaggaattaattatgcttttttagtatattcttcaagtccattatcaatttcttaaagacacaaactggttattatactgaattcctactcttctcagcatctcaaaatgtaagttgcacaaagctaataggcatttttaagttgattgttagaagtagaaattattataagtaaaaatcattagaaatatatttctgattttacttacattttagtcaatattaaaattaggagttttaattaggaaaattaagaaaataaagacggtgattttctcatgaagttgactcatatcttttgtacctgtctcctttccaaactctgaagtataaaaaaggtggaaaaggtggttttataaaacaaaacaaaacaaaacaaaaaacaaagaaacaaaaaaccttacaagttaattcagaggtctaaaagcaaaagcttgatatctgcaacaggagcttgatgtacagaaactagaaggcaacaaaggtcacactgacctattatttaattagaaagaacaaaagttttctcaatgaccctaacagttctttaaactgaattgaagatgctggtagactgtaactttcagcagatcgtcgtcagttctaaggttatttcgtcagttctgttaccattacagccaagacatcatacgacagactacttcaaatctcacctctacttgccaaatccgggatgagaacaggacaggtgacacagcagacggtggcttctccacgctcatggttggctgaagttgccttctagatgggctttcctttttataaaactaaacagcatatcacactggaaattgtttttgccttgtagatatatctggtaacaaattctgacatattggattttataaattctatttaagccttacaggagattttaagtttcctaaaattcttgctgtgttcattcccaattatagactagtaagtgttcacacagactctaacgagtttttcttactgagaaagggtgcacaaactcataatgggggagaatagtcaagataaaaaatgttggcatcagtaattaaacaggtttgctttccctaatgccaaccatggtgggtatttatttcctctttattttgaagaccacatgttagactgtcttttagtcaggtaagattgctgtaacaaattaccatagattgggtgattgtaaacaatataaatttatttcttatagttttggggactggaaatctaagatcagggtgctagcatcatcgagtttgggtgaaggccctgtacaaggttgcagactgctagttccttgttgtatcaccatatagcgaagagaacgagctagctgtctggtcacttcttaaggtgggactaggctgggcgcattggctgacgcctgtaatcccagcactttgggaggctgaggtgggtggatcacgaggtcaagagaccgaggccatcctggccaacatggtgaaaccccatctctactaaaaatacaaaaattagccgggcatggtggcacacacctgtaatctcagctactcaggaggctgaagcaggagaatcactggaactcatgaggcggaagttgcagtgagccaaggtcacgccaatgcactccagcctggtgacagagtgagactccgtctcaaaaaaaaaaaaaaaaaaaaaaaaggactaatcccattcataaggcctccaccctcatgacctaattaactcacaaaggccccacctccaaatgctgttttattgggggtcagatttcaacatgaattttgggaggggacaccaacatttgggcaatgagggattagatctactaaactcaaaaaactgtgtattgctattccaaagaatggtattttttcataattcttttttatgagtatgctataatatttacaatgtagcagtgactaatcaaaaacccacctgtccgacattaattcaggcatccataagaagagataatctgaactgtccctagaatacaaatcttgaatctgacaggtactatttcactttgggcaaactacttaatttttgagcttcaacttctttatccttaaagatgaaacaaagaaattcttcattgatagaaagaaaataatttcaacaagcattctgttgagtatcttatgaagtctcctcagctcagtgccacacttacctaatcctctcgattcgcattcggttgttctcttcccattccattttgtgttagtttcttatatggcacaatttccacaaacttatgccttagaacagacatttattattttactgtttttgtggaccaggtgtctgggcatggcctagcccatcggcgtgtcagcctaggctgtggtctgggctgagattcaggcttcttgtgcaagctcgaatactgttggcagaagtctttttatcgcagctatagaactcaggatggtttacttcttcagggatggcaggagagacagcctttgttgctacaaatctcaaatctctgtatcctcttttaaaggggtcatctgcctaactcaggcccactaaggatggtcactcttctgacctaaaatcaactaattggagacctgtgagcatcagttgtatgtgtccatttggcaaggctaccttcttgggttggccaatcaaacattaacttaggtgttgtatggaagtattttatagacaagattaaactccataataaattgactttatttatttatttgtttgtttgttttttccaagacatagtcttgctctgtcgcccaggctgaagtgcagtgactcaatctcagctcactgcaacctccgcctcccaggttcaagctgattctcctgcctccacctcccaagcagctgggattacaggcatatgccaccacgccaagctaacttttgtatttttagtagagatggggtttcaccatgttgaccaggctggtctcgagctcctggactcgtgatccgccaacctcagcctcccaaagtgctggaactacaggcatgagccactgcgcttggccacaaactccataataaatttactttaagtaaaggaggctatctccaatagtctagctggtcctgggcttcttcccaagagtttccagtctgcctttcctgacagcctgtcctatggacttcagaactgccaaatcatcccctacattgcataagccaatttcgtgaaatacatcttaatatttgtgtatcctcccgtgtgttagtcctttctgcattgctgtaaaggaatacctgcagctaggtcatttataaaacaaaagagtttatttggctcatggttctgcaggctgtacaggaagtgctggcgtcttctggtgagacctcagaaacttttactcgtggcagaaggcaagggaaatctgttttcacatggcgagagagggagtgaaagagagaggaagtgccaggccatttttaacaatcagatctcatggggaaaatatagagcaagaattcactcatcacccggggaagggcacagagccatttatgagggatccacccccatgacccaaacacctctcactaggccccacctccaacattaggaattacatttcaatgttagaatggcagggtagggggagagcataaatatgcaaactctatcatcctggttctgtttcttcagtgaatccctggctgatataggaccttaattacatatactaaatccacttactatgctgtataacataaccataatcagaaaagaaaacccatcatattcacagattctgttcaccctcagaagaaggggattatacaggtcacctgtcccagaggcaaggacatataggggccatctcagaattctgtcttccacatattctccaactatttactttttattttctaataaattctattcacggagaacaaacagtatgactttctgggatgggacagtaagaaagcagttggtaggggagggaagaggtcacataaataatggaattaaagctttacgtaacatagagattgagtaaagatataaaagctggccctttctgacaatcggagatccagttccccaaactcattagctgctaatctcaaagttgcttacttactatcattctctgttttctagtaggtagagttgtccaatagaattttctgtgatagaggaaatattccacttctgctttgttcaatacagtagccactagccatatgtagctatggagcattcaaaatgtggctatagtggctgagaaacagaatttttgttattaactaatttaaatttaagttcaattaatcatattgggatagtggctgcagtattagacaacacagcatagaggaataatctatcggtcacagctggatttctacaggaaacttgacagctttggctataaataagacctgtgatatgtctgcagtttcaacatttgttttattaatgtgtacctgacaaacaaatgacctgaaaatctcttttcaaccagaaacaaaatagactggctcagtactatgctttttacatattgcaattttatgtgctttgttttcactttaaagaaaatatattgtgcctatctacaatctcagagggaaattaggtatatagcatagtctcttttcacgtggaatcttttgagggggactagattcatccgaaacactcaaataaaaatataaatagacataaatgcagaggcagaaaaagcacattgcctgtcggggaaaaatgagctatcaattcttctgtagccaaaaccacatatggttagctcattttcaaggttcaaatgctctgagaagtgtcatcgtattaaccacacctaagaacggatattcggggaattctgagatcctaactgacagtctgatcagaagttgggtcctagagagctcagaaggactgttagaatgctgatctgatccagagattacccaatgctaggattttagtctttgatttctatatagcctacctgtggttccagggaatttgaagagctttgcatttgtcattaaactgaaagagtcatatagccttgccagggaaagaagacagggatgcaactgctgattaaggccccatgtttttatgtccttcttagagtacggattccatgtcaggcaactttaactagctttcacaaatttctcttgaatatactcatattgttggctggaaggtttaaggaattatttgagaaggcttctcatttacgatggaaatgtatcagaacatgatttaaaactaaatagcagagacctctgttttcaaaagaagcataattaaaggaaatttaccactggcagtgtgtgtgtgtgtgtgtgtatttgcttcactccaggcccaggacctgggtatatggtttggcctctctttttctcccaggacctcattatgtatccctctgtgtcttcaactctgtgggactcttgcttgacttcttccagctgtttcaccatagacacattccttttattttgctgtgtaaagcaattcaacccagccttctgactggtgctctagggcctataatttcatcggcaaatggcccatcaaagtgtttagttaaattttctccataacagaaattttcaagcaatgttttaaaatagtgactttttcttctttttaacaaataatgaagtgatacttttaaagttattcagctaacaggtataaagcagattatcctgcaaaaaaaaaaaaaagatgtatacattcctccaaccatactctgtgggaacagcagcaggactgccccgtgcatctttcagcaagcaggagatgcatccctctcttgtaccatttatattaggctttaattatctctctacataactgcagtccccaaatatgaaatgagttcctgatggcagaaaaagcttcatatcaatttttgtaaccccaggccctagtatgctctctggcacctaattatagcaatcagtgaatacttgatagggtcatcattcacttaacagatattccctggccacatatgagaaagtgacatttaagctgagatctgtaaaatgagtaagagtgagacatgtggaaaagaagatacgggtagttaaggctgagggagtggcacagaatgaatcaactagcaagttaatgaatgaccaaaaatgctggtctatgtagtactagacagaggatcacaaatatcttgtttcaagtcattcttgagagttctggccatctgtatcaaaaacttttgtttggtcataataacaatcattgattcagtaacaatgactaagaaccaaccatgtactaggggctggatatgcccagggtatcatgatgaaaataaaaaccagtctctgcctttgtggggagactgacattacagatctgcacagtggaggtcatattgcacctgtactcatcctggaggatggtagtgctctcaaggtaatagaagccaacggaaatgtgacttcagtagtgatctgagggagaacttctccagggaggtgatggctggttgagctttggaaagtaggtgaaggtaggaggaagggtcatatttcaggtaaacaaaagagcataaacagaactcttggggcagaaagacaaggctggtgtggctgcagcaccgagattgaagggtgatttggtatgaaataaggctggagagttgacaaatcctgcaatagatggctttttaggcaatgttcctgatttctggttttgattccattagaaacccaaagagatgccaccaaactatcttaagccaacagtttgtatgtgttggagtgatggacatggaggaagcatatcatgatcatgtctgctctgggtaagccttgctctggctgtggtgtagaggacaggtctgaaggcagaaagagaagacttggtaacacctgtcacaggatatgactgcagtgccagggtgagacctggcagcctagactaggatggtggtagcagagtggaaatatctgggaggattgaagagctattagaaggtaaaatctacagaacttggttgtgggttacatgtgggctgtggtggaaaaaagtgctggaaatgcctcccatgtgtcagtctggttttacctggtattgggcaataccatgcaggtatggactgatgggagagactcagatttaaagaaaggatcacacatctgttgttttttttatttttgaggaggtgaacttaacactctgggtctttatttccttttcttcctttattcttttttttttttttttttttttgagatggagtcttgctctgttgcccaggctggagtgcagtggtgtgatctcggctcactgcaagctccacctcctgggttcacaccattctcctgcctcagcctcccaagtagctgggactacaggcacccgccaccacgcccggctaattttttgcatttttagtagagatggggtttcaccgtgttagccaggatggtctcgatctcctgacctcatgatccacccgcctcggcctcccaaagccttttcttttttttttttttttaacttttattttaagttcaggactacatatgcaggtttgttttatggataagaaaatgtggtacatatattccacaaaatactatgtagccataaaaagaatgagatcatgtcctttgcagggacacggatgaaactggagagcatcatccttagtaaactaatgcaggaatgtaaaaaaaaaaaaaaaaccacaaatactgtatgttctcgcttgtaagtggcagctaaataatgagcacacatggtaaatgttgaatccgaagtgcctttacggcatctacaaggtgttgcgtggataactaaataaaggagtcaagatctcagcttggataggacaaacgacaaattgtgacttagctatgcataggagaggtaattgaaaccgtgtttggatgagatcacctaagggtgagaatagagggtgagaaaagaagagcatctaagactggtccttagatctaaaaataatggctgaataatggaacataagcttcaaagcagacagagaatgagtggcaggtaggtcaggggaaatctagaagggagatgtgacaagaaagcatgccaggaagacagaaatgggcaccagggatgagcactgctaagagatcatgcaagatgaggactaaaatattgtccaggaaattagtaaaattgaagttgttggtgaccatagcatgagttgtttatggaagggacggaaatttaaacctgggtgatgtgaatggagtatggggatgaagggtggggttaggagattgagtcagaaaatgcagtgtggcatttccaaatgaaacacagcatcagataataggataaagatgaggcatttcatttgttcgctcttttaaacagcctgcttttggaatcaagatggtgaattcaattaacctattattatttcttggtatatgacagttcactagctattgcactccgtagaatttatttcattctattcaccctggctgaagaaccataggtaagatccaacattttcagtggcagcccctcaaaaccaacgtgtttccctgataatcattctgcttcccttcttttgttgtttctggagatctccatctgctcttccatttatcatctgcttgatattcttggatggtgtgcttggttggcctatgctatgggttcagataggcaagtaactatattccccttccccattacagatgatgtgcctcatttagctatgataaatatttgctcatttcctcacatctgcatatggcactgctaccaatccatcttttcctccccatcctcatctctgctaagttcttttcctgccaccatttctatggttgaccagttagcatttaagaaaatatgctgacagtagccgcatcatggattagcatttcttcatgttcataatgcaaaagccccattagatgtaaaaaacttgctttcttatctttcctttgttacacttatatggaaccttttagaagttctatttataagtagaatgatatgaataaatagaaatgtgccagtgaaatagaataggccaaaatatacatcatattaaaaatgaaaatcaatcatttaaataatattatggctctttgaaataatattataccctatatcaggaggtttgtgttttgtcttatttcattttcagtatgtttctattgaaagtgagattgccatcaagaattctcaaaaccttctggggtgagatttcagagcttcaactatgttaatagctgtgcttggcatatctaatggtgttttgctccttctgaagcattttttttaattagacaatacatttataaccaagctcagtgagggtccagattgtggatgaggattaaattgagattaagatataagtgtctggtccattttaggaagttgtcaaacaccgttaagagtacacagtaatgttattctctgattgttgaatataggcaagtttcaaaaggacccttcacagttatgaaacttttaagtttgctatagtgaaaagattgatacatgggaataaaaattcactcatgaatctcattttataaataaatgcttcatttatgtaaattgtttgtactttgtgtgggtaaacaatattgattgcacatctagttgaaattactggatgagaagtattagtatcctattcttatgtgtcgatttaacctacagcctgggttctcttgactgccacattcctttaatttcctttacttttatatactcatttatctagaacttaagaaatccccatggcttgtggtaacatgaactgaagatggtattacaacacatttccttctagctctacccagcacgaaagctttattataaggattctggttcttcttgctatttggggagtaatattttgaaaattcataagattatgtccatcaagcattccagactaacaataataatagtatatgaatgtatgaaataccataacatttttaatatgatatttttaaatgaataaatttcttcttttttcttttttttaaattatactttaagttctagggtacatgtgtacaacgtgcaggtttgttacatatgtatacatgtgccatgttggtgtgctacacccattaactggtcatttacattaggtatatctcctaatgctatccctcccccttccccctaccccacgataggccccagtgtgtgatgttccccaccctgtgtccaaatattctcattgttcaattcccatctatgagtgagaacatgtggtgtttggttttctgtacctgcgatagtttgctcagaatgatggtttccagcttcatccatttccctacaaagaacctgaactcatccttttttatggctgcgtagtattccatggtgtatatatgccacattttcttaatccagtctatcattgatggacatttgggttggttccaagtctttgctattgtgaatagtgctgcagtaaacatacgtgtgcaagtgtctttatagcagcatgatttataatcctttgggtatatacccagtaatgggacagctgggtcaaatagtatttctagttctagatccttgaggaatcgccacactgtcttccacaaaggttgaactagtttacagtcccaccaacagtgtaaaagtgttcctatttctccacatcctctccagcaccggttgtttcctgacttgttaatgaacaccattctaactggtgtgagatggtatctcattgtggttttgatttgcatttccccgatggccagtgatgatgagcattttttcatgtgtctgttggctgcataaatgtcttcttttgagaagtgtctgttcatatcctttgcccactttttgatggggttgtttgattttttcttgcaaatttgtttaagttctttgtagattctggatattagccctttgtcagatgggtagtatttttaagtgaataaatttctaagtgaaatcagttatgactttcaaagcaatttttaatctgctgcatttttattagtgatgaaaagtatatgagttttaatcatgaacacaatttaaaaagtcaaccaaagacttcaggatgttgttccttgttacttctgtcagtgtaaatttcattaatactatgggtgatgaataatatgcaatgtttaagctgtttatattttctactttaatagacgttctggctttactatcaaaaagaatgcaagatttataatttagaaaacaagaagaaaaagagcattgtgaaggtcaaactagctatttgcattttaaaatagctacttctcttttaatggacgttgctacaaatgtatagcaataacccctcagctggcaaataaggaacattgtattagtttcctgagtttctttaaaacacaactgcttcgtttcctcccacagatactatggtattagatgttttaattgaattacttagaaaatatatcgtttagcttcttaatataaaactaattttaatctgagaaaatttaaaaaagtattttctcatccttaaattcttttttccattgttttccaatttagccctattgtgtctacaactcagattttaatcttttttttactaaaacaaatttattatttaaaaaaattaacttttctttttttccttataaaagtaacctacatttgtatctttagttctaaaattacaggtggccctaattcttttctctttggtatctggagaaagtgaatgcaattatgattagcagaaatgcttttttttcaattgcacactttatttagtggaaacaaaagatgcatgtatgattcaacttcacaaaaggaaaagactcaaagcaacactggtgatgagccgtttcatattcttaggtagacgcaagatccccgtacttcctgaaaccttatctaatagtaaaatattttctgactgtttctccagtcttttaccactcttgtcaatggatacacaccaaatacataaataatgtatgcaggttcattttgggtaccatctagctacacagcccagtggagtggttgagtacaaaagccagcctagcttgaaatttcaagctttgacattttctagcttccttgggcaagttacttagcctttctgtgcctcagttttcttacctataaaatgagaataatgatagtaccctcataatagggtgattatgaggattgcatcaggtaactttgtaaaggttctggaacatatagcaagtactatataaatgtaatacgtatgcaattaaaataggcttcaagatacacagattacagataaagaaatagctgtagacagaacatatcactttattcactccacattattactttttacattttcaggcttcttactaccaactaacagggtatattattagttctcttgtctatgacatctgatataccttccttcctttcaaagagtgccaaacattttaaatgatacttacatttttctccaatgtatgctgcacaattaagtagattgatagatatttttcatcagcacaaagagaggatcgcaatacatataagactttatctctgctgcaaaatataccttgaaagaattacatgtataatgaaaataaccctgacaatgccaactttatctgcgaaatcactggccgttgactttctgtgaaagagttaagtacgttgctgtatcaaatattcagttactcattaattaaagtagaacaaagtcaatactttttttgttcagcagattaaccaaaaactaccatgtaccatgtttgcaatttatattcatcctataaactgcatatgcattaaacatttccatctggagccccgatgactgtttttctcccatctcatgcttgataagctgttactgattagacagggaattctgaagctgttgaaagcacagatttttttaaagctctatcaccttggtattctttatctcttaacagaccttgcttgatgcctgcaggttccattttggctgcaatccagataggaactataggtcccctggccacgatggtctaacacagacaacgttatttggtatctatctaattattcctccattaaaaaaaactctctatctagtctaatttctaatattgaatttttcttctttaattgtctcatttaatttttttttttttgagatagagtctcactgtgtcccccaggctggagtgcagtggtgagatctcagttcactgcaacttctgcctcccagattcaagcaattctcctacgtcagtctcccgagtagctgggattacaggtgtgcgccaccatgcccagctaattttttttattttcagtagagacagggtttcaccatgttggccaggttggtctcgaacttctgacctcaggtgatctgctcaccttggcctcccagagtgctgggattacaggtgtgagccactggcctggccgtcttatttaatttgatgtcaaaccttaatttagtctgtgacatactctgtaatataacataactagcatattttggtgcatggtgttttctaactattgttataaagattttacgcattttgactgatttaatcctcactaactgtgctacgaggtagatgttattattatccccatttagtaggaaaactgaggtcacagggaggttgagtaacacagctaggaggcagtagagctcagccaggaacccagagcttctaattctgggacctgtgctacctgccaccacaccacggcctgacagagctgtcttcatcccaccgttagtgggacatgcagtttgggatgttgctcccgtgaaaaacagtattcaaaagacccacagcctgactccttctttataatacacaccctggatagcattaggagatatacctaatgctaaatgacaagttaatggttgcggcacaccaacatggcatatgtatacatatgtaacaaaactgcatgttgtgcacatgtaccctaaaacttaaagtataataataataataatgataataataataataatgctaataataataaattaattataatacactccctgcctgactccttctttataatacacaccctgccactttgtgctacctgataggaatcatttaatagattaaaaatggagtatataatctgtgtgctattaataattaaaaacaatgacaacagcaaacacaataacaatcccatagctgctgtttgttgagaatccccacgtgtttgtcctttcacagtgtctgtaagccgcgagacttactgtcatgtgtcatcagcacctgatgagatattttaaatatcacttcatactgagactcagaaaagtgctctttcttgtaaaagggcacaaagttagtaagtagtagaaccagaattcaaagcctagtccttttttttttttttttttgcatagccatatgctctcttatatactaattggttagaaccctctagcttgaaagcaactcagctagccagcaaatatccccccaattaggaggtgactgatgtcataaccagattgctccctgttctctttttgtttgctataaacttgatcctttggatttgtgcatattctaaagatcaccctgtcaccatgcctggaggcaattaagtataagggagtagtgtttcaagataatctcccactgtgaaaacatgggaataattatccaacgtaaacatgtcatttcttttctaaattacatggattccttttttgcactttaaacctggattatacatcttactcaacttcgtatccagacccaggcatataccagccaggtgtatagcatgaacttaataaatgttgattaagtgaagagacttaataattaataattaactaatatatgatgaaagaattttaaaaattcacttgtttgtccatagtttcatgtagtcaacaaatgcaatcaaaaggccaatgatatccatgaagataacatttattttttaactaaaatcctatgttttctgtaattgtatggtagcatagaattttatatatataacatacattcatatataacatatataacatgtatatgacatatatataacatatatatctatatataaaataaatatatataaatatatatataaaactttgtgtcatttcaatcctgagctattttttatttttctgcctcatgtcaattagaatcagtctccccctttgattccagtcaattcaaccaccagtcgttttcctacctcttcctgacctcctcaccaatattgactctggctatgtatcctgaaaagtgagaaagattgaactgatatgaatgaaaattagaataaatgtaaaattcacacataatattgtttatttctcctcatatggtacacaaatatacacttaaattttatttcatatgacatcaacatagtgtatattcaacaaaatataactcctgatcctgtcttaaggagtatataatctaatgaaagattgaacacacaacagtgctaagaaccaacagctatgaagaaggtgcaatattcacaaagaaactgtctttgtgatttcaggtagtgctccttagtatcggattgttgagccacatttgaaagaatgattgtgaatttatgagaacatacaccaacgagtggacagtgggatgcctctatccagcaacacaggccactgtctcatagttcctcatcagctgctacaggattcactccaaatttcactataggacctgccagcttgtatttttgtctcttgagtctacgccaaaaccaaaactggcaatcccaaccactcatcacttaaaaactaagagattcttttttttttttttttctgagacagagtctcactctgtcgccaggctggagtgcagtggcgcaatctcagctcaccaccttctccgcctcccgggttcaagcgattctcctccctcagactcctgagtagctgggactacaggcgcaccaccacacccggctaatttgtgtgtgtgtgtgtgtgtgtgtgtgtgtgtgtgtgtgtgtgtgtatttttaatagagatggggtttcaccatattggccaggatgatattgatctcctgaccttgtgatctgcccacctcagcctctgaaagtgctgggattacaggcgtgagccaccgcacccggccgagattcattaatcttaaaggcttggtcaaagagcaagtattaaaacaggaatgtcactttcagtttcatcttgtgccgttggccattcataccttcctgctacatctgtacagtcttccacgcccagcttgtgcttctagaaggaaatcaaatgagacgatttgtatgctggtgctctgaaaaggagggagctagaggatcaataggctctagctaatagttttttggatccgaataataatgtttatagaactggaagactgcagtttagaatggtccttgatcacttattcattggtctgttcaagcaggaaatacaatggtttcattgagtgctaggaaaaaaaagaaaggtaaagggtgttgaattcagccactggctgggctttgaccagaagggaaaatcagggattggatgctgctatttaaacattagcatttacaaattaattggtaccacgaagaaaggaaaaagaaactgaaaactgtgattaccaaagaatagtttaggaccaacatgctccccttttctttacatttgcttaggccttttatcgctgcctctttgaactgaggctgagattcacttttttgtttataagggcttacttgttactgagaacagagccaaaatgggcttgcagcatctgctcataactcattaaccagaacttggtcgtgtgaccaccaacacttagatgcaaaggagaatagaaaactagtctgagttctgtagccacgtacccagctaaaagctgcaatttgtatcactaaagtaaagctcaccttgcgctttcattgaacagctagcagtctctgccgtgcgatttacttcctcgcccctagacaaatggaggagagaattcctcctcttctgtgctttgaaagatcacaattgtcataatttttaagaggaaatttaaaatatacatttaaggaaggtttaatctttagttcttactaaaaattctgatctgactcaaactgattcaaaaagcaaggaaattcagtttcctatatgatggaagtgtcagggtggaacagatctcaggaattagttgacccactgacctgatgctttgggagccatttgggagccattccggcatcactgcgtgtcctgagcctggctcccatcttggggtcaagatggccacaccctttcagttctcacagacacacactgcaatttccagaggcagggtgaggccatctgctctgccgccatgttcttctcaggaatcggcggccttcccaaaggtgttctcagcacgcctctcatcctctctcgctgtagctgagtcacatccccatgtttcatccaagtagcggcaaggaaatgggattgcctcggttgacttggatagttcaggactggctcccttgcagagaaaagagagtcgcttcccttgaattatatgaggactggatggacactggacacccaatgagtaaaatcaaggcttgtctgaggtcaacagtaacaccaccaaaagcaacaaagaggaaatggatgttaggtcggcaaacactgtctgctacagttcataacgtagtttcgagagccttcaaaagtattaatgacaaactaacgtttggaatatggggaacactgtattttgcttctagtgatttggagaagtaggcaataatgtcgctcacctctactaaatgtatattgtaatgtgtacattaaatttaaaattgtacaaatgatttctcatcctcaaaagactaactcgttttcaggttaaaagtaaacatcattttatatatatatatacatatatatatatgtatatatatatatacacatatatatgtatatatatatacacacacacgtctataatgctatatataaaaaatatatctgtatgtgtgtatatatctataatgctatatatacatatataatacatattatatatgatacatagatatataatgtattatatatttatatagcatgtgtatatacatatatgctatatataggattatatatgtgtatacacatatatgtatatattatatatacatatacacatgtatgtacatattatatacatatacacatgtatgtacatattatatacatatacacatgtatgtacatattatatacatatacacatgtatgtatatattatatgcatatatacatatacacatgtatgtatatattatatagcattatatatagcattatatatgtgtatacacatatatgtatatataatacatatatacataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatacatatatgcataatgctatatatgtatatataatccatatatgcataatgctatatatgtatatataatatatgcataatgctatatatgtatatataatatatgcataatgctatatatgtatatataatacatatatgcataatgctatatatgtatatataatacatatatgcataatgctatatatgtatatacacatatatgcacatagcatgcttataaatgctctatattgtatatacatataatactatatataatatataataatataataatatatacatgtatatacatatgtacatatagcatatataatgctatataagcatgctatatgtatatatgtatatacatgtatacgttataccatatactatataatatatagcatatataagcatgctatatgtatacataatgcatatataatatataatgctgtatgataattatatataatgtatataatatgtgatatatgatatataatatgtaacatgatgatgtaatacatataattttatgtattttattatatataatttatatatatgctatgtataggcacacacatatagtgtttgtgtgtgtatatatatgtagcatgaggttgtgagctagtcaaactttagtcatatcatttaatatctcaagtttacattgatgaaatatttataatgaaatcctttgctacccactaactctgagaggtttgagtacttataaaatcaggcttatttttttctcaaagttgagaaaagcattttttctccaagttagaaaagcattttttgttgtttattaataaaccaatcaaagctgatgtcttttggtttgagaaaaacaaataattttcttaagaaaagtgtgatgaaaattatagcatctttaatgactttgttctccatctcctagtattgttatctttgtatgtatcccttttgcctgggctgggaaaactgtactgtaggtcaggggttcccagcctccaggccacggacctatactggtccatggcttgttaggaacccggccacagcatcagaaggtgcccagtgggcaagcgaatgttcccacctgagctctgcctcctgtcagatgagtgcccgcattagattctcataggagcactaaccctactgtgaactgcacatgcaagggatctaggatgaacactcatgagaatctagtgcctgatgatctgaagtggaacaacttcatcccaaaacccacccccaagcccaacctgtccgtggaaaaattgtctcccaaaacactggccctggtgccagaaaggttggagatcgctgccataggtgatatctctcctagaaccatacacctctggttttaagagctaaaaacatacagacttattctgtaagtgtaaacattttactgtgtgttacctggccaattcttcacagctgatcattgtatatttttaaattctcttcatgtctcatcgttttattagcgtgtttcttcccattatgccattctgaaatccttttacaagttgtcctctggtccagtgatctggtgatacaaatgattgatagcaataaacatatcatttgcatctgcaacccaaatgtcctgtgtgttcctgtagaaattatgtagctaagacacgcacacgaaagctctgtaagtcaaagagtagcgtcgtgtttttccaaataaatttttctttaaaccttggagcctcattgaagcacaacttgaaatggtagaaaaacccagtggggcatgtcaccaaaagcagtttcctaccgcagcttccaagagaacttcattagtgttttcaacctgaatactaatcaatggcataaactctaaggaaattttaatatgaatatttttaaaggagcattttaatgtgaacgtagtgaaaatacaaaatcatatttaaataggaaagaaagggatatctctgggctcaatgagttttgaaagaggagaggtttgaagaataaatgagtttacagaaaataaacaaaaatatgaaacaaagaagaaaatagatacagagaagcaaaagtataaaaatagcaacatttaaaatttttatctatgctctttttgatacatccacagaaaatatgtttctctttctttttcttttcataaaatttatttttatttttaatttttttaaattacttttttgagacagatttctctctatcacccagaatggagtgcaatggcatgatcatggctcatggcagcctcagtttcctggctcagtcagtaatcccacctcagcctcctaagtagctgaaaacaggcatgcaccaccatatgtagctaatattttttaaattatttctgtggagacagggtctctctatgttgcccaggctggctcaaactcctgggctccagcgattctccaccccagcctcccaaatcgctggaattataagcatgaccacctagtctggccatacagaagatacataatcttagacccccttcctcatgtaacatgtagcactttctctaactatatcaaataatgtctgggaaacagcaattttaaatctttagtatggtataattattgtcaaagcaaaacaagatgaaacttcagaaaagtctagtacagagcttcaacgaattcaagttaagttttacacctgttactccctgatacttagaaaagttttatgcttgcctctattgtgcttagagagaatgttgtggtttgtaggaaaatagacactggtaagtgtaactgtatctgaaatttgcacacttcaccagtgtgtctggttattatctacatggtggaccttcagtgactggaggacctctctttccattcaagctgtctttttattaaccgttctctggggcctcaagttccctctgcagcatttatttccctttgagttaagtattgttcccattattgtcttagaaacgttaagtatcattagatacagtatctcattgtggattatgttatcagattctttgcaatgtgtctcttaacaaaaggatattgagtggcagagtggggagtggaaaatcactgaaaaaagaggacaccgaagagacacatgaattttctttgttctgttttttttaaccagtggtcatccctagcaaagatgtgtgtaagtgcattaaaaacatttgtgtgtagcgaaagtggtgaatttctctatgcaacatatttaaaagtcattgtttgtacctcacttgcatggctatttggccctataaatattggctcttgtctaatgacattttctatttcactttttaatagaatttgctgtaaaatggatactacagaaacagcattttattttcattcttggcaaaatcatttccacccaaagtgggggagctcctaacaatggttgcttctactttatttataagaaaaataatcaaggccgggcatggtggctcatgcctgtaatcccagcactttgggaggccaaggtaggtggatcatatgaggtcagagtttgaaaccagcctggacaacatggtgaaaccccatctctactaaaaaatacaaaaattagctgggcatggtggcgcacacctgtagtcccagctacttgggaggctgaggcaggagatccccttgaacccgggaggtagaggttgcagtaggccgagattgtgccactgcactccagcctaggcaacacagccagactccacctcaaaaacaaaaaaacaaaaaaaacagccatcaagcagacatggtcatcttttgcctgtagtgcaacagaactgtttaaaacacagtttaggccttaacgtggaaattcttgcttgcagcttccactaatcaatctcgctaacctcaggactctaactttcattttcctaattcacatttcaaaacctttctaaatttcaagagggaatgatttatcaaatcatctaactctttcaaattttggagaaataaatctcacttggatcactaaaaataaagaaaaggatcactatggaataatgaccctttaatagaaaaagaaaatatttctaacataaatattggagcttttctgtggtagctgtcaaatccaggagtttggaaattggaaaactagaaattagaaaagaacaaaaaatagatgttttaaagttgcaaagctccttttctaaccttaaattttgaggttacaatcagtttaaattttaaggtttaaagccagtttctaaatcttaaaactatattatttacaagacaattcaagtgacaaaatacatagtagtcagtcataaactaaatcagattctaaaatattatgtcatattatgaagcagtatgtaactaaagggctggtgattgagccctgaagggccgtgtcaggtcttctacttgttttcaaaatcaaggctgaagctgggtgcagttcccacctgtaattccaacactttggaaggccaaggcaggaaaatggcttgagcctacgagttcaagatcagcctgcaacatagagagaccccatctctacacaaaaatacaaaaattagctggacatggtggtgcctccctgtaatcctagctactcaggaggctgaggcaggaagattgcttgagccccggagttcaaggctgcagtgggctgtgatcataccacttcaatccagcctgggtgacagagcaagatgctgtctccaaataaataaatgaaagaagaaagaaagagaaagagagaaagagagacagagagatagagagagaaagagagaaagagaaagagaaagagaaagaaaagcaagactgcttctcccagcaatttgttaggatcctggctgtccgcccaagatgggttagatgaatggctgacaaggaatttgttttctaccactgtcacatgggagctacattaccccagctgttgcccctgcagagagaattatctgtatgttccgtgtatgcatcccaccttttcaacatcttgtagcagttccacttgagaagtttcaagtgatcggagtcctggccctcccacttcattgtctccataatccctagcattgcacttctctgtttgtcaatgtctataaatggtctctttgcaaggcttctcatgctatgtataaaacctttataaatagcatccactgcgactcacacagagccacttggaaaaacattcttgtcttgtttttctcacatatgtctaaaattttacactttttcctttatttttacttgatttagctaatttattcttaaccacagcattgtggtttagtaattgagacattttcttcattttgaactccagagtctcatcaactttagtcatgaaatacaaaaattggaaataagtctttgttataaatctaggccttgggtaggagttaactaagtttggtagtttgaaagttatagaaaccaaagtttacattgaatacatacagccaaccaggtgttatgacactgaattcctatattcaataaatattagttgttttctgggtggcaaattcataagctataaagaaattctggcttatattatgctgatgtggacagaattacagatgatggacttgaaggtgttcatataagcacccgtcctcactctgcaccaaaggtgtctcagggcctagtgagggggcagtgccagaagcctccaaaatacttgtttctctgaaatgttcttcagtacagaaagcagtggaagcagagtagactgaattatgtattttttcagctttcactttatgtctctacagtttgctctcttcctcactggggagaaaataaaccagctacctcagggaagtcagcacaaatacagaacagtaagggagggtcccatagtcaccaagcaagacgcccaatttgtcctaaatccattcatgcatgttatggtaaaaatatggccctgttctccttccaggcatgagtcaatgttgctaagtgggtggattagaatagtcattatttcaaatcaattagacaaatacttaatatgttgccactccagctactgtgaaccagatcttgatttagtaaagaagactgatatagaacatataagcgtgtgtgtgtgtgtgtgtgtgtgtgtgtgttacaattctctggtatttacaacaagggctgtactgttgtgctaggctaaatattagcaaaaagagagggaaatatgacatgttttacctgaatgggattaaatcttttattttacacttgctcaaggtcatacatttattcttactggtcccaggtaactgcagccatgaatatttttcttaatttattcagatacttttttaatgttctagaattaaaataatttaatcttcagaaatgtgtatctcttttagcattatcaagcaactaagaatataagtaataattataaattgttgtgttagattttacttctaacaccttccaattgtttattaaaacaattgatataattattctttgtaaaaattaacaatattgacaattatatgtggtttttaggatgtaatatttttgctgcaattggctaattttgatacttttcttacataaattttaagtgattgtccagtcacccgtgaaagcgtttcaatgtctgtggattttatgttttaaaattgcatttgaaatagtccaattcataatgtgctaaaataatcaagaaatgttctctaaaatcctgaattcttccatttaggatctaacttaaaattcaaaattaaaaataaatgaaaaattaagcttgggcaagtcaatcagaataagagatgcttaatttctgtagttgaagggagaaaattaaagtgatgtcagctttctcatgacccaagaagtatgtagttgaatcaatagcatcatgaacgccccatcggatgatcatggagtctcttagattcctcgtccccttccttctttccttaaacagacccagaaagtgaatcggtttcctcatgggcaaataaaccaagcctagatcctgatctctgggctcagagccaatgctcttctgtatcctgatgggatggtcatgatgctattgactcaactacgtatttcttcggtcatgagaaagctggcatcactttaattttctgaaaaatgctctgcctcagcatgctctttgtcgtgccaacccttggaatgaaggcatgtgctatgattctaagtttatattaaagaaactcaaccatatacttttttcttttttctttttttgagacaagagtctcgctctatcaccaggctggagtgcagtggcacgatctcggctcactgcaacctccgcctacggggttcaaaagattctcttgcctcagcttccctagtagctgggactacaggtgcgcaccaccacacccagctaatttttttttttttttcttgctctgttgcccaggctggagtgcagtggtgcgatctcggctcactgcaagctccgcctcccaggttgaagccattctcctgcctcagcgtcccgggtagctgggactacaggtcccctccatcatgcccggctattttttttgtatttttagtagagacggaatttcaccatgttagccaggatgatctcgatctcctgacctcgtgatccacctgtctgggcctcccaaagtgctgggattacaggcgtgagccaccgcgccaggccattttttgtatttttaatagagacggggtttcaccatgtcagtcaggatggtgtcgatctcctgacctcgtgatctgcccacctccacctcccaaagtgctgggactagaggcgtgagccaccactcctggccaaccattgtcattttaaggacttaaccaccctactataaatagcacttgtaacagcactatatctgtcatgccttgggaaatgcataaattgttaagattgacctaagctgtaaaaatgcaggaagttgaaacacagatgtgtaggcactgtatcaaatgtatcctgtttccaagttcagttcctttcccaatgaccccctcaaaaatgtttttctaaaattaactggatttgtgatatatctgtccttatattttctgaattcaaaataatttccttcttgaagctacagaattctgcaactttgcaataggtttctaatatttccaatatctcaggcctttattcaaaagaaaatgccagatcttttcaagagaaaccctgaatttatgttagaaagagaaattcaagctataaattgtacaaaataatatctaaaattcttatagtataagaagtcaacttcaagcttatttatagctttaaagtaatttagggtttagagagaagagagattaatgttcctattctagtagactcaataaaatatttgtttttatgttgcaatttttaagcagaatattttctacaaagtcaggaaaagtaggcaatcatcaaatagctttaaaaaattctgagcttcaccatagagggaatgtaaattgaaaaatgtgatttggattctgtgattctttaggaatctcagattctacatacctctgtactacaaaaactaaacttattgttgatatagtggttagtgaattttaataattaggtatataaaccacagtgtttagttgcagcaagcatgtcaggaatgagtgattggcctttgtatgttctacttgtaagttgcatgtactaaatggcacgtccatgctgtggaaggaaaaggggtatggccgggcgcggtggctcacgcctgtaatcccagcactttgggaggccgaggcaggcggatcacgacgtcaggagatcgagaccatcctggctaacacggtgaaaccctgtctctactaaaaatacaaatacatatatatatatatatatattagccgggcgtggtggcggatgcctgtagtcccagctactcaggaggctgaggcaggagaatggcgtgaactcgggaggcggagcttgcagtgagctgagatcgcaccactgcactccagcctgggcgaaagagcgagactccatctcaaaaaaaaaaaaaaaaaaagaaaaagaaaaggtgtacgtatgtcagatgatacaatgcagcattatacttatttttgaagagatttgctgtttgttaatcatttgcctcaagattaaattaaatatttattatattctgctgacatatatgtggtagtttgaaatggttctctactttcttgtgtaaaggtaaataaatgcaacgtaaacacaagcagtcttcattattgatagtaattatgtgctataaagttgccaggaacactgatttagcgaatactgaattatttctcctaggggaagtataggtttaggtttcagtgagcctctggtcactacagtttttgagaggacacaaacactcataccgtagcgttctgccccaaaaccccaaaattcacacaattctcacacacaaaatgcgtttattccatctcaatagccccaacagtcttaattcatttcaacatcaattttaaattctaactccaaagtctcatctaaataacatctaaatcagatgtgggtgagactcaaggtgtgattcatccagggcaaactgctctcctgctgtgaacttgtgaaatcaaacaagttgtgtacttcgaaaatacaatgtgggacacacatagaatagacattatcactttaaaaggaaaaaaaataggaaagaagaaaaaggtaacaggtcccaatttaaagtcccaagccccgaatatcctgccacctagatggttctctgcagtagccccacctccatggtggctctgtgcctgggtcaccagctcacggctctttcatgctagaatcacacactggtggcttctaccggttttgatggcggcaaaacttggggcagccgcaaccccatggcacctctatacattgccctagaagggactctgtggagatcttgcagagcaacagatctcttcctgagttctgcaacttcccagggcatcctcatttctgtctgagacctcatcggaatggcctttatcacccaaatttctatcaacattctgttcacggccacttaggtataccttaagaagattgaggttctttctacagctctcctcttttcttcttaagtcctcaccagaattacccttaaaggtccattcagaataatgtagccttttattattattattccttttttttttttttttcttttggagaaggagtcttgctgtcacccaggctggagtgcggtgccgcgatctcggctcactgcaagctccgcctcctgggttcacgccattctcctgcctcagcctcccgcgtagctgggactacaggcgtccgccaccacgcctggctattttttttttttgtatttttagtagagacggggtttcactgtgttagccagtatgatctctatctcctgacctcgtgatccgcctgtctcggcctccgaaagtgctgggattattattattatttttttaaagcatgaactttgtaagccttccagcctctgcccatggccatgctccaaaaatgttcctacgtttttagtatttgctgcagcaggactctacttgagtagcaattttctgtcttagtctgtttggcctgctataacagaataatataaactagatagcttataaataacagaaatctaattttgcaagttctaatgtctgagaagtccaaaatctaggtaccaagagatttggtatctgatgagggtccactttctggttcttagatgatgccttcttgctgtgtgcaagggcaacgcatctttctggggcaactttattttttttgtttttgtttttagagacagagtcttgctctgtcacccaggctggagtgcaatggcgcagtctcggctcactgcaaccttcgtctaccgggttcaagcgattctcctgcctgagcctcccgagtagctgggactataggcatgcaccaccacgcctggctaatttttttttttttttttttttgtattttcagtacagatggggtttcaccatgttggtcaggctggtctcgaactctttacctgaaatgatcctcccacctcggcctcccaaagtgctgggatttcaggcgtgagccaccgcacccagcctctggggcagcttttatgagagaactaatttcattcatgaggacttcaccatcataacctaatcacatctaaaggccccaactcctaacactgtaacattaagaataaggttttaacataggaattttgggaggacacaaacattcagaacatagcagttaataaaatatttgtaaaatttatatatgtatatatatatattttctttttagtaagttctatttcaaatctcagtgaataagtttcagatgtatgttgtttcattgtctttcattgtttttcttgcttctttctttttttcttttgaatctgacatcactacaatattgatttttgtttctaccttcattttataatcatataccttaccaagctacagaaacgaggcagaaaaacaatttccattttatttcagtacatcttcctaaaactggatcctggtttgcttagttgttattaacaacacttgatgagctattattaattaaataattatcttttatctcaaatgtggaggttcttgttcctatgaagcccacccttccctttagcagcagcaacaacaaaacgacaggcagcttctcccttcatatgggtcctgacagatgagccttttggacccctcgtaaaagtagtaaatgcacctttttcttttatttacattaacatttgttttttcttaaccatgctctctctattgatttagcattaatcatgttgtttcctacagaatttaccttttgaaaaataaaaacacaggcagatacatactggttattcacaggaaaattagggtgtaattattagcagactaattgtttcagatttactatgatccatgaagtcttgtatttgacagcttaaagaactatgtggccaagaagacataaatgtgggccagtagctagcagcctctgcataatacaactccaaatcaactggtgaacatttaaattggagtaatttaattaaaaatttgaatttctgggcttccttgaaaatgtattgtttgaataacaccagcattcctgcatatcataagttacctccatgtgaatagggacagccccttttatccacaacatatcccaaacactgcatgaatcctctgccatcatggctgagcttttaatctcttcattagaatctctttttggttgattttctaatcagggaaatatgtctctcttggtcatattgctatcaaaagtaagaaagtaaaagatcaatagaacgacatgatatttataaccagccagcatcacacatttgtataaactgcttgtcttctctgagcattgaagttgtgacttctaattttagaagctacaaatcattttatctctgtcaggactggttctcgccacaagttgtgtaagtactgctcatttatgaaaataaattaattcaacctcttcttcatggccccagtgagtgtgcaggtgtcatgaagtaatggacagcacccaagttcacagtgaatcagattccctccaatgcccaaatcactgaggtgtgttcacgagcagaccacagagtactgtttttagtgttttaccagacaggacctaactgctctagcaaagaggaaagagaacattatctcacaacatgtgtaccttttgagctttactaagcctattttatggttgaggtaaaattttcacccaaaggtatgtgaaatcaaaccaaaattacagaattgttgtaatatattgcaccatatgcataacctcaaaagatactgcacacatatgtcccaatctctcacaaataagagaaaatcatttgtaccaactaatttagctttcaggaaagcacagaaagtaaaataaataaaaatgacattttttcctaatcacctattacatattgctactcgtcctgacaaatttgtaggggttgttgatggatgtatagcgttcagaacattaatgattttacaagtttaaagtaatggtgtttgttcatgtacatatgtgtggatgaatagttgtatggatggatggatgatgtattagttggttttcatgctgctgataaagatgtacccaacactgggcactttacaaaagaaagaggtttaatggacttacaattcctcatggctagggaggcctcaccatcatggcggaaggtggaggggaccttgaacatggcggcagcaagagaaagaatgagagccaagagaaacgggtttccctttatcaaaccatcagacgttgtgagacttattcactcccactagaacagtatgagggaaacggtccctatgattcagttatctcccaccagatccctcccacaacacgtgggaattatgggagtacaattcaagatgagatttgggtggagaaacagagacaaagcatatcagatgaatttgaaaaggatagcgcatagaaattttggatagctaaagaagtaacaaactaagattctgtgtaaaaattaagatggtgggaaaatgaattcgaatatgtagcgtgtttcaaagaggaatttttgacattttgtttttgttttcagggtactgtcaatttcattttaaattctgaggctttgtaatattggatttatcatacacctggagtcagccacaactgtaaattttgatctgaaattcttcagttagtataaaatccctaactgctttgaaattctgtgtagtgataatgcatcatctgaatgctttgcatcctttaatgacataggtatcttctgaattctggctttgcgtaactgttgccaacactgtaagaacatcagctcgtttgaggctgggtctttgttctctctgtttctgggccctttccacgccctttctcctctccctcactagcacaggagttatctttccaatgcaaacctggacatgcattttccacttagaataccatcattacacacatgggccctcagcttcctcagggagcattaagtctttaatcttccaattctcaccctgcacatgaattgtaagccttatgtagtaaagtcacaaacaactgagcgtttttagaacagtcgaatgtgctattcccctatctgtctgaatttatcttactcagtcttaattctcttttcactggaaagttcctgtattgttttttgtttgttttttaactcaccccattacttccacaaccccagtcttgacacaatgttatggatgtagaagatacttcagagtccagaagttgatcttagacatttaataatggtttctaaaatttgctttaaaggagctttttgcaggtctatggactaacttttgccaacaattcctaggcttttgtttgatcaaaactgatttttcacttcttttctaagatatggtaaaataattttctgtactgagtgttttctaatatagtttattagtagaaaatttgagacacagtaaggccaacatatcagaaaacacctaccgtgaaaagatactaatattttattactttattaatactttatattattgatacgatatttataaccagccagcatcacacatttgtataaactgcttgtcttctctgagcattgaagttattttattttatataaatacaattattactttattaaaatacatgacatttatttactttattacttttattactgtggcaggccatcccacagggtgtagaccagaggtagggagctcagggaagcaccaggatctgtcaggaggtagaggggatgagggaactgtgggcaaggtcctttattgtagtttccatgggaagggataggtgcagcagggtaagcaggcttaggtctggctaactggaataattattccagtgagttctggggcacagaggctgatcctagttgtcttgtacctgattctgggatgaatagggaagacggatcatggtccagaagagagaaagctggataaaggaagcagttggggtgtggactctggattgattgctttatatttggaaagtgtgcttaccatctctagaaattggctaactctgggaagaccagtccctctagggtcagcaaggccccagatgtcaaagcattggagcacagagattaaaatacatggtcaggatagaggggaagttgaagccatggcagctccaagaaatgacacaggtggctgccattacccctgctcccaccctccacagctaccagcctccgtttactcatagggataattgattttttcctcaatattatataaattactatgaaaagagtgcctaaaaacaagttgcttatcactatttgtaactaaactgctatctttatatagtatcaaaatttggacagaacactgacaatgatattttaaatggaattagaaggtgaactgaatagagattttaaaaattccgaaataaatgttgggaataatttaaatcaaaagacattctgaggagtttcttgatgtctggtttctttcctcatctgtgtagcatttacttaggatttataattctagatagtcttttcgccagcaaaaaaactagattttgtgtggtcaaaagttgtagagctattttcagtaaacagcgaaggcgagaaggcgagtctaatttatttgactttttgatttacaaaaataaataaaaacagcttccacatggatttcctacaaatagattatatgctaattttcagaaattgttattatttctgcattattggatatatgagagttataaccctgcttagaaatagatcactctgattttctgatatcttgtgggtaatgagtggatgagagcgaggacagaatataggtgtgtgcatgtgtttgtgtgtatgtgtatggggggtgtatgtgtgtgtgaatgtccattttgggaggcatagggtacctcagtgggcttttttgtctcttcacgttgaataatgtgatatctaatgctataactttaaaaagttactaatattttcctgtgtctgttttttgtgattcattgggccaaccagatgattagccatttatggtttatcatatatacattttttatggagtaagtcaaaaattaaaatatgtaggagtcaattgatcttgcctctgaaaatcaataaccatttcagattagcatacaatgactgctctaaaaggtgtttaaaacttagtgactttaatcttggaatatgcaagttcctcattaatgcatttaattcaaaggaaattatatattctttatttaaactcatacaggagttcaatgttttggcctttgacttataaacaaataactccagtgtaagtataataaaagcatgttatgtttaaaccatttattcatatcagacactcatagttgtaagagttgtgtagccttaaatcatgtataaatctgtactcttagaaagtaaactgcacggtcacaggcatagtttagaggggaaataataacacagtggaattctccttttgccttgtttcaaacctaaatgatgtttcaatcagtttagaaagtgtttatgctgccaggaatccaaaacggaacaatccaaagcctgtatcctagaagagcttcaagtccacaggaaaaatcacgcccaaaagaagataacttcaatataatgtgagaagtaaaatgataaaagtatgcaaggaactaggggacaatagaccaaggctgtttcacacaggcaggctttctagtggtgaggcttatctgaggcttagaagatgcctaaaagtaaactagaacaagaaaaatggctgctcactgaagaaagtgagcatagcccgaggaaaggtgctatgtgaagtttgcgaggaattcaatccgtttaccatcaggagcacataaaaagaaagatggcactaaaaatgagcctggacgggaaggcaggagctatatcattgagggtggtataggccacactgaagaacctggcttttgatcttttttggaaagagtttatttcaaaaaggtctttccagcttctgtgtgatggttttaagacgggagagttccctggaccccttcacgggacttgcaacaagggtgtggctccatttctcgctcaagccccttttgggaggaggagcatgcaggtgagctggagcgagcgcttttgggccctggctccacggcagtgtctaggggtgttgcagtgctcttttagctttgccatctgtggatggttaagtgttaaccagttcagtggagagtcagggtgacagccttttataccctgtcctcttgatacgcaggtccttgtctggcattcagaaagaatcaggtcacatggacttgaaggatggtgaatgcagggattttactgagtgatggaggtggctctcagcgggatggatggggagctggaaaggagatggagtgggaagatgatcttcccctggagttcaaccaccccacggccattctcctatctgactgtccccagccaaacccctcttgatgtacagacgcttcctctcttctctccttctctgctgtgccgctcttctgttctactgctcgtctgttcatggagcctggggtttggatttatgagtataggatggggagcacggcaggccagggtggttttgaaagaagcaacaattgggcaggaaaacaggataactgttctcatttagcaccacggtttgcgggcttgagggcggagcctttgccggggaaccaccctcttgtctcctgttcatatcagttggatttaagagaaataagaccaaaggatgagaattggtcatttaacaatgttaatacaataggcaacatgtgaggtaatggtaggctcatgatagtacatataaaagtaaactatgagttttaaaaatatcaaagtgaaatatcaaattgaaatatcaaatttcaattaacaatcattgcacctcaaatgaactcattggctatatgatactgccactgcacaaagctctatatttcacaggtcttggaagtcgctaaatgtaggtaggcaaaaagaaaaaaaaaaaaaaagaagctcaagaaagttccagatctctggcttgagtgactggataatggatataataaaagtagtggggcccagagaaagaattatatgttgagcaggtagagtgagatgtgcctgtggaatatccatgtggatcagccttccaagttactggattggaatctaaatggtatgcagaaatgaaatcagagtcctttgatattgttgtcactgtcctagggaatatcaagcactgaaggggaaagcaacatattttaagcagaaatattgcacaaactgtgagatgctggccttcaggaaagaagagccttgaggttttttgttttgttccattttccccaaagtagaagtgattttcagattctatctctagatcatttttaaaggatctggagaaggctcatttgctactattactctaaattagctataatgacattttgaaattattttatctgtttaggtttatatcatagatacattgaaaaaaagaaaggcagtgggttaggaggaagaaagtattcagataaaagcaatgtgtagatggaatgagattgagtccaccagagttgtgtctgttctaggactgagtcaatttaaaataatggaatacattcttgcccaccaccacagctccccaaaagtaacctaatgttaccagtcttttcatctgactattgaaacctcaagtatatttgtagttgtagcaccaagatgggtcagcgagattcttgaaatttcttccaatctagtgactctaattttttaatgaagtatgaaataatagtgtttattataccttaatccaattaatagaaatatgagtgacaacattcacacattctacaaatatttaataaatattcactgtttttcaggcactgttttaagtgctgggctttagaatggaacaaaactaagtctcagaggagatatgctgtaaatatacaaacatcaatgtatcaggtagagataaattccataaaaatgaataaagctgcgtgaatagagaggaggtaaagttggcagtcacactttttataaagaatgatcaatgtatctaaaatattgacatctgacaatgaaaataatacacagatttgcatgtgtgtgaaacttgcaaaataagcaaattctatcttctagtatttttaaacttcagtttcagaaatgaaatgtatttcaaactcttgaagtgacttggtatttatttgcataaactatatagtattcgattctgtactaactggttaatatacatttttactatttttttagattcatatgctttatatgtatttgagaaatatatatgcttttacaaaatttaaagttccaaatttactagtttttaattagtttattttttataaaagaagtctttaattttgtttccttttttctctaaaaatctatataattttttacctttattgaattattatataattgaaaaataaaaattgtatatatttgagatatatgattccacaactctgtgatattctccccaaatatcaataatgcagtctagtcctaagaaaacgtcagacaaatccaaactgagaaagattctacaaagcacctggctggtgctcttctagagggtcaaggttatgaaagacaaggaaagaattggaaactgttgcagattagaagtgactagggaggcatcataactaaatgcaatctgagatcctggattgaatcctagaacagcaacaaaaaagtattagtgaaaccctggtgaagtccaagtataatctgtatttgagtgaatgccacttaagttagtattttcattttgacaaatgtgccaggttatataaaatgttaatattagaggaagctgggtgaaacatatgagaattctatctttccaactaccttttcagcttttctctaaatctaaaatttttccaaaataaaaagtttgtgaaaataaaaacaaaacttccaccacaatttttattgaagaagttggacatttaactaatggtacatttttagctaatcaaaatcctgttttagaaaacaaaattatgaaataaggtttaaaaaatgtacagtaacaaaaatcaaacacaaactatatacagtattatccatatgtgtatctatgtacatacgtaaagattctttatatgcaatttaaaataatcacaaatagtatattatcattggttatttcagtaaaaaatgaaataatgccttttaaattttttttctttaaacctttttgtttctttcggatcccctataaaagtaactgaaaacatttgatggggaaacggtattaaaagtaactcttgaatatttatttgttgatatgctatatttacatactttttaattttttcaaataagtagactacagtttcaaattatatattcttttataagtgtcttttattaagattaataaaaaattttaattaaaccatgcaatttccctgtactataaatattatatcaccccaaactcaaattattagtgtacattttggaccatgactaactgaaatgaaattctccctctctctctcccactgtctttattcttctcccttcctccctcatatatatatatatatatatatatatatatatatatatatatatgaattattccataccttatatagttggatagatatttaggtaaatatgtaaaatgtaggatatgcaccagttaagtacccattaacactggtgatttttcgtggttgggattcactctctactttctatatttctgtattgcttaatttcttttgatcaatagacatagtttgtaataaaatatatagcaaagatatcttttaaaattaaaatatcaaataaacttaaaattttaatattaaaatgtttatatggtaaacacttcttcaaattatcttattcaaagttagaaagtgaagactaaggaacaataaaatgtttttgaaaaagcgttttctaccatgatgatttgatgaattgggcatattaccagcttgctgagcttttgttaggaacaaaattgtggaaacactatgattttgcattcattttttgactagccattattgttcagattgcttaaacagttcaaccatacatatttaatcaccgcatcgaaaacttaattctagggagtgataagcaatcaggataatagaagaaaaaagtggcttgtccccaaataagcacagcgcattattagatatcaaatgaaattttaatctatttttgtaggaaacagagccaaactgtgatggatgttctttacattgttgtagaatatcccagactttttaaagagtacatggtatgtgttaaagtgtaaatatcatagattacttctagaaattttataattttcaagccagctctgagcttacatccacaagaggatgtgctgatattttggaagcatttaacccattcatagaataacaacttttaaattttgttttagatagatggatagataggtgggaaaatatgttgaaactttttctttttctttgtagggaatctaggttacagagaattttgtttcccagctgaccctgacaacttaccatttgtaaagtgagacttggtctacatgaatagctgtccttcctgtttttattaatatcttaggattgtctgaaaaaaataagccatcttcatcttttctgtcacattttctcattgctctaaaagtaagacaggaatgcattaacatttgcgtaaatcattactctgtacctagaactaaatgtgttttgatttagaagaaagtatagaggaggtgattcttgttccctgagtaaaagctcagggaacgtttacttcctgaaagatgaattagaaatattttatgtcaattaaaatatgctaaaggtgtataaaacaagatgtgtctattatttaactgtcactgataggaaattgactgcaaaactactgtctagagttcagaatttactgtcatctgtttttcttttattcacttttcaagataaaaagtatcatcaactgctggattatacgttctcctttatttctcattgcacatgaaaaagatattgccattgaaattcagctgtgacagtatataggattaagctgaagtttaattggctttgcagtgttagcagaagccaaaattaaacgattgattttttccctcatattaaaataaacctctgtgattcacagtctcagagaacagaattctgttgattaagaaagtctttttatgggcaataaagagctgattataagaattaaaatttaaagtttaaggtcatattttttctgaatgttttataatataacattgtacaaacttatttaaaagcataaatatttgagatactagcatagatattttcaaagtatgtgaaagccatcaatgatttgaaaggcatgcttagatttcattttattcgaagtaactgtatgcacaacaattcactttatagaattaagtaaactcaacacaaaaaaggagtggatgtggttctggcagccctgcatctctactgtggcccccaaaggaatttatttggtggtatgctccacttacaaggcaaaccaaagtgttcctcgtggtgattggagtaaacaagtgccagagaactaggacatgaaatgagaaaatatttctctgacaggctttaaactggctattatttttctccaatgtctccctctggagttctttagccagaccttacccaaaacctagaggctagctttgtccagacttgtaattctaaagttattagagctgttccgtttgactaggctttctatgatttaaaaatgaaaagcttacagaaatagtctattgaaaagatttttaacagtgaagatttgatcatggtaacgaagcttctatttgaactcaatatttgatttgaatggttacattgcattttgaatcattctatgaatcgagaatgcattgaccaatagtgcctaataaataatatcatctcatttttatttctggtgtgaaataaatagtagttatcaaatgaatcctcacagtcacatatttctgatcatatttcccattttttaaaaagtttacatactttccttattttaatctattcccctgaaactaaaattagagctgctgtagtcatacgctggatatttgttctttaaactcatatatggataagtgaagatatctgtgtccaatgtagtgaaaaaacaaacaatggtgcccaattctccattccaaatgcaaggaggtaataagaaatttgagacacactgcttcctaagaataaatggtaagaagtttctgaaaattcgattggttgtaaactctgaatactacaacaaggtttactaaaattgtggtgaaatataaaaaccatttaaaaaaaagagaatagcataaaagattacattccaagtgccttcattcttacatcaaagaaaacaactttttgaataaaatatatacttaaaatcatgaagaattatcattaaggaatcaaacatttaagtctcataatctgtttgagatttaaaaattttacgattttggtctaaactctagatttctaagttaagatttgaagcatataacccattgaatttatattactaattttgtaattaaagtaaaatgttcaactgatagagcttttatgagcatttttatcaatactctccataaaacctcctttaaaacaaacacagtaaatcaaaagaaggaatagaagaaaaacagaggactgtcaatttctcaagaaaaacacttacttaattctcatttattctttgcagacacctgttggaagtggatggtaacatacatggctgaactaatatgttatttttttttttgttttaggggctgatgttatcaactttgatggccatgttgtattaccatatagattcagaaacaagaagatgaaaacactgaaagatgtcattgccttgaactttaagacgtctgaaagtgaaggagtaatcctgcacggagaaggacagcaaggagattacattaccttggaactgaaaaaagccaagctggtcctcagtttaaacttaggtgtgttctgactgtcagttctattctttccgttatggatgttcccattaggaatatgttcatgttgctcaattctttaaaatgtaaattataaaaagagctcatgttatatttcaattcatacttaatctataacagtaggtatataatgaaacacctagtcattcaaaaaatatttattaaacacctctactatacaagttactatactagtctttggcctacagcaaggaacaaatagacaagatccttaagctcattaagttcatgacctaacggaggaatcagaccatatagcatttattattcttattttaaaacaactaagcaaaaatgaatgtcttcaaataatatatattatgaaccagttgaacagattaatatgataaagggactaggttaatacgtcctgttcaaaggcaacagggctaatattagaatgtgtggtgaagaaagactgctctggggagaaaatatttaagatgagatcagagtgatgaaaaggaattagccatgaaaacatgagagaaagaagattacataggaagagaacatggaagaccaaaagcacgctcaagaagcaggaaggatgccgccgtgcataaatgctgtgagttattaagacaaaagatgaagtccaagaggtggaaattgcccaaatcctgtgggatcctgcagggcattacaaattgtttagatattatttttaagaataggaagctgttggaagtcattaaactgtatggctttatcatcttattttttatcaagcgcattgagacttctgtaagaagaattacttgtgtagatatgagagtcgcagcagaacttctgcatagtttgggtgagagatagtactgcttgtatgaggtggttatcaggggagatgcagagaaatatgtcaattaaggaaataattttagtggtacattcagcatgacttatgatgggttggatatagcctaagaagaaaagagtagaaataaagaatgagccctaggatttgggcttgagcaccaaatggacattagtgccattttcagaaatagagaagactttaggaggaattctagagatcagtttggacatggttaatttgagctgcttatgaaacatctaagtagaactttcgattatggaagttgatatatgagactgagagaggaagactaaaatggagactaagtaattgtgaatattgagtaggagaaaatgaagaaagtgtagtatcacagaaatcaaggaaacaaaagaggttgtcaactgttgaattcatctaaatgtcatgtaagatgaagacagagaggcaaatattgggcttaacaacatggaggttactgttaatttctactctgtggaatagaaaagacaaattttgtaggtaaaaaagagaatgaaaggcgttaagtaaatattttgactaactagagaggaagaacagttagttaactgttaactagaaagaaagaacatagagaaatgaaatgttggctgctgaaagatctgaactcaaattactgttttatgtggggttgttgttatttgtatttatttatttatttatttatttatttatttatttacttatttttgagtcagagtctcaccctgtcacccaggctggagtgcagtggcatgatctctgctcactgccacctctgcctcccaggcttaagtgatgctcctgcctcagcctcccgagtagctgggattacaggcacctaccaccatgcccggttaatttttgtatttttagtagagatggggtttcaccatgttggccaggttgttttcaaactcctgacctcaaatgatccacctgccttggccttccaaagtgctgggattacaagccaccgtgcctggccctgttgttgtttttaaatggacaagaccaatgtatgtttgtatgttgatgatgtagctaggatttacttaaagctaaagtgaagatctgcaagattggtactggcattcaaaattacagtttaggcaaagtaatggtacctttttcttttttttttttaaatttaagttcatgaatgcatgggcaggatgtacaactttgttacataggtaaacgtgtgccgtgacggttgtctgcacagatcatcccatcacctaagtattaaggctggcatccattagctattattcttgatgctttccttcctcaccacctaaacctccgacagaccccatgtgtgttgttcctctctatgtgtccatatgttctcatcattcagttctcacttataagtgagaacatgtggtatttggctttctgttcctgcattagtttgctgaggacaatagcctccagctccatccatgtgcccgcaaaggacaggatctcattcctttttatggctgcgtagtattccatggtgtatatgtaccacattttctttacccagtctatcattgatgggcatttaggttgatttcatgtctttgctattgtgaatagtgctgcaatgaacatatgtatgcatgtatctttataatagaataaattatattcctttgggtttatatccagtaatgggattgctgggtcaaatggtatttctgcctctaggtctttgaggaatcttcacgctgtcttccacaatgattgaactaatttcccctcccaccaacagcataaaagctttcctttttctctgcagcatcaccagcatctgttgttttttgactttttaataatagtcattttgactggtgtgagatggtatctcattgcagttttgatttgcatttctctaatgatcagtgatgtagagattttttttcatgtttgttggccacatgtatatcttcttttgagaattgtctgttcatgtcctttgcccacatttttatgaggttgtttttgtcttgtaaatttaagttccttgcagaagctagatattagacctttgtcagatggatagattgcaaaatttgtttctcattctgtaggttgtctgttcactctgatgacagtttcttttactgtgcagaagcacttcagtttaattatatcccatctgtcaatttttgcttttgttgcaattgcttttggcatctccatcatgaaatctttgcctgtgcccatgtcctgaatggaattgcctatatagtcttctaaggtttttagagttttgggttttaaattaaagtctttaattcattttgaattgatttttttgtacagtgtaaggaaggggtccagtttcaattttctgcatatgactagccagttcttccagcaccatttattcaatgaggaatccttttcccattgcttgtttttgtcaggtttgttgaagatcaggtggttataggtgtatggtcttatttctgagttctatactgtgtcccattggtctatgtgtctgttcatatcagtaccatgctgttttggttacagtagccttgcagtagagtttgaagttgggtagtgtgatgcctccagctttgttcttttttcttaggattgtgttggccattggactcttttttggttccatgtgaatttttaaatagtttttttaaattctctgaagaatggtcaatggtagtttaatgggaatagtattgaatctatgtattgctttgggcaatatggccattttcatgatgttgattattcctattctccctatccatgagcatggaatgtttttccatttatttgtgtcatctctgatttctttgagcagaggtttgtagttcttcttaataaggtccttcacttcccttgttagctatatcttaggtattttatattatttttggcaattgtgaatgagagttcattcataatttgactctctgattgcttattgttggcttataggaatgcttgtgatttttatacattgattttgtatcctgagactttgctgaagttgcttatcggcttaagaatcttttgggctgagatgatgaggtttcctagttacaggatcatgacatctgcaaagataatttgacttcctttcttcctatttgaataccctttgtttctttctcttgtctgattgccctggccaggatagccaatactgtgttgaatagtcacggtgagagaaggcatccttgtcttgtgacagttttctgtggaatgcttccagcttttccccattcagtatgatattggctgtgggtttgtcatagatggctcttactattttgaggtatgttccttcaaaacctagttaactgagagtttttaatataaagggatgttgaattttattcaagaacttttctgcatctactgagataatcatgtggtttttgtctttagatctctttgtgtgattaatcacatttattgatatgtgtatgttgaaccaaccctacatctcagggatgaggcctacatgattacagtgaatacccattttgatgtgctgctggattcagtttgccataactttgttaagcatttttgcatagatgttcatcaaaaatatttgcccgaagttttgttgttgttgttgttgttgttgttgttgtatatccaccaggttttggtaccaggatgatgctggcctcatagagtgtgctagagaggagtccttccttttcaggtttttggaatagtttgaataggcatgttatcagctcttctttggacctctggtagaatgcagctgtgagtctgtctcgtcctgggctttttctggttggtaggctatttattactgcctcaatttcagaagtcattattggtctggcttagggaatcaatttctttctggttcagtcttgggagggtgcatgtgtccagaaattttccatttcttctagattttctagtttatgtgcatagaggtgttcatagcattctctgatggtacagagaatactataaaaataatagagaaatacaaacatatttctatagggaaatacaaatgtatttctgtgaggtcagtggtgatgccccccttacgatttctggttgtgtttatttgaatcgtctctcttttcttctttattattctagctaatggactattttattaattatttcaaaaaaccagtgtattaaattctcacactggtataaagaactgcccaagactgagtgatttattaaaaaaaaaaaagaggtttacttgacttacagtttcacatggctggagaggcctcaggaaacttacaatcagggccgaaagggaagcaaacacatccttcttcacatggcggcaggagagagaagtgcagagtgaagtcggggaaagccctttataaaaacaccagatgtcatgagaactcaatcactatgatgagaacagcaaggggaaccacccccatgacgtccctcccccaacacatggggattataatttggattacaattcaagatacgatttgggtgggaacacagagccagatcatatcaaccagctccaggatttattgattttttgaaggatttttttgtgtgtgcctctctattccacttcagtttagctctgatcttggttatttcttgtcttctactagctttggggtttgtttgctcttggttctctaattcttttagttgtgatgctaggttgctaacttgaggtacttctagctgtttgatgtgggcatttagggccacaaatttccctcttaacactgctttaactgcatcccagagattctggtactttgtatctttgttctcattagtttcaaagaaattcttgatttctgccttaatttcattatttacccaagagtcactaaggagcaggttgttcactttccatgtagttgtgtcgttttgagagaatttcttaatcataagttctaatttgattgtgctgtggtctgagagactgttatgatttcagtcctttttcatttgctgttgagtgttttactttcaattatgtcatcaattttagagtaagtgctgtgtagtgatgagaagtatgcatattctgttgtcttgggatggagaattctgtatatatctatcaggtctacttgatccaaagctgagttcaagtcctggatgtctttgttaattttctgcctcgatgatctgtctaatattgtcagtggggtattaaagtctcccactattattgtgtaggaatctaagtctctttgaagatctctaagaacttgctttatgaatctgggtgctcctgtactgggtgcatatatatttatgatagttaactcttcttgttgaatttagccttttaccattaggtaatgcccttctttgtgttttttgatctttggtgggttaaagtctgttttgtcagaaactacaattgcaacccctgcttttttctgttttccatttgcttggtacatttttctccatcctttattttgagcttatgtgtgtgtttgcatgtgagatgggtctcttgaagacagcataccattgggtcttggctctttatccagcttgccagtctgtgtcttttaactggggcatttaacccatttacatttaaggttagtattgttatgtgtggatttgatcctgtcatcatgctgctagctggttagtttgcaggcttgtttatgtgattgcttcatagtgtcactggtctgtgtatttcgatgtgtttctgtagtggctggtaatggtttttccttttcatatttagtgctttcttcaggagctcttgcaaggcaggactggtggtaataaattctctcagcatttgcttgtctgaaaaggatcttatttctccttcacttatgaagcttagtttgactggatgtgaagttctgggttggaaattcttttctttaagaatattgattattggcccccaatctcttctagcttgtagagtttctgctgagagggctgcttttagtcagatgggcttcccttagtgggtgacctggcctttcagcctttctctctggctgcctttaacattttttctttaatttcaacctcagagaatctgatgattatgtgtcttggggatgatcatcttgtggagtatcttactgaggttctctgcatttcctgaatttgaatgttggccttcttcctaggttggggaagttctcctggatcatatcctgaagtatgttttccaacttgattccattctcccggtctctcccaggtacaccaatcagttgaaggtttagtttctttacataattccatatttctcagaggttttgttaattccttttcattcttttttctctattcttgtctgcctgtcttatttcagaaagttaggcttcaagctctgagatttcttcctctgcttggtctgcctgctattaatacttgtgattgcattgtagtagtgtgtttttcagctctaacatgtcaattatattcctctctaacctgggtgttctggctatcagatcccatattgtattaccatgattcttagcttctctgcatggggtacaacatgctcctttacttcagtgaagtttgttattacccaccttctgcagcctacttctgtcatttcagccatctcagccttagcccagttctgagcgcttgctggagaggtgttgcaatcatttggaggaaaaggggcactcggctttttgatttttcagaattttttgcattgattgcttctcatctttggtgtcttatctaccttcaatgtttgaagttgctgatttggagatggagttttgtggggtttgttgttgttgttgttttgtgtttgtttttcttttaatagccctgtagaagtctggccactcatccatagggctattgtggtttgctgggagtccactcgagacactagttgcctctgtttttcctgtacctggaagtataatatcagcaatgaagcctgcaggacagcaaagttggcagcctgctgcttcctctggaagttccatgctagggataactgacctattgctggcccaagtgtgcctggaggaagtggttggagactactgttgggaggtctcattcagtcaggaggaatgaggtcagggattgacttaaaaaagcagtctggctgctttttgatagagccactgtgctgtgttggagatttcttcagcccctaatcggtttgggctctccaaggcccacaggctggactagctgagaagcctgaatgtccaagttggtgacctgccccacccttcaggcactttgtcccgtggagaacacaggcaggggtggccagaggccccagctgggacaacctgccctgggaagaagaatggatggggggatggggcagttaaagaaacagtctggtcacaccttgacaaaacagctatgttgtggtgaggaactgcctctgcccccatcagcttggactctccaaagcccacaggctgtggaatgactgaattgtccaaacaacccaggtggtgaccctcccctcccttggtcactccatcccagggatagaaaatagctctgtcatgcaggcaggtgtggttggagggccccagctgggaggtcccacccagtaggaagaatggatcagggctctgcttaaagaagcagtctggccatgatctggcaaagccactgtgttacgctgctggggaaaccttcctccttgtctggactctttggactctccaaagcccacaggctgcaaaggcccagtcgaccaaatagcagagatggtgtctgtacctctcctcgaggctccatctggtctcaagaaggctttgtcctgatgacagtggctggctgaaattccaagccagtgggtcttttcttgtagggtgccatggaaatggggcccacagaacaatgccattcggctccctggattctgcccccttcctaggagtatgtgcagacctcccgccttgcctgagttgcagacacctttgttggaaatcccagggtggagtttgtaaagctccaccctgtctctgtgcatgattgagcagttgttctgccaagactccacacagctctgtgtgtcagacccaaggctctggtgtcatgggctcacaagatctcctaatctgtgagttgcagaaatccatgggagaagcatggtttcttggggtcacatagtcactcactgcttcccttggcaggggttgggggttcccttggctccacgtcgctcctgggtaggctgtagccccatcctgctttccttcattctccttgtgtgaagttgtttccctaatccgtctccatgtgagaacctgaatatttcatttgaaaaggctgtatttactgatcccttccattcctctccttgagcactgcagacttcagctgcttctcatcagccatcttggcccctgtctcacctgtttctcttgattggctaaaaattctaggctatttgatttatttggcaattaccaatttgagtggtccaaacattcctgaatatgacttgtatctcatatattaacttttattactttgaaattcagtattatactaaaaattgcaacttcacttaggctatttttgtaggtaatgatacattaccttaaagatgtacccttgattataaaacttttcacattaaagatctgatctgatagacacaatagcttctataacaaagaagaaaagtcacacaaaattcgccatcacttagttacataaaatattattttttacattaaaataaaagtaacattaaaatgcatgcaaaacctgggaaatacaaatgtcaaatatactggtttaatataaatcatgaataagaaattataccactgcataataataccaagacattaggagaaaatataggcaaatgatatacaagataactcataaaagaaaaaaatattatataaacacccaatgcttaatttttatcaagtaagtaaatacattttaaagtgatactttcagtgttggtatttgacaaaatggatcctttgtattgttctgcaagtcagaaaatactttcaggaaaatagctagacagtatgtcttcggacacttgaaatctcttacaatacagtattttggtccaaaaatcataaggcaaaaaaagaaatgaccactaggatttaagtccaaatatgtaatttgcaacattaattacaatgtcaaaaattgggaaaaaattaaacacatagaaatatgttgatagcatttaaaatgtgctaacttttaattgtatggggaaatatataatattaagtaaaacttgtaggatacaaaatgtatcaatctatcgatctaattaaatatatgcagtcatgtgtcactttaaaatggggatgcgttctgagaaattctgtgtgagtttcaacactttgtaaatacaagagtctgcaaagacaaacgtaaattgtatagcctattacacacctaggctatatggtagagcttattgctcctagtgtagaaatctgtatagcatgttactgtactgaatactttaggcaactgtgtaaaaaactggtaagtatttgcatatcaaaaaatagaatggatacagtgaaaatacagtattaaatttgatgttaacaccattatatatgaagcccatcgttgaaagaaatgtcattatgtggtgcatgactgtttgtggaaaacatatgaaagaaaatagaccaaattatttttagaggtggaaatatttttgcattacatttcacttgtttcttcataatattctctgcttctaataacgaacgtgtattcattgtgctaccaggggaaaatagcctgaaattatttttaaaacaagacccaatagaggaaaagaaggaagagcagggggagagtaaccagaaacaaaagacatttttgttttttgtacacataaaaacattttatgtgtacttccataaaatatgcacacatgcacacgtgtgcacacacacacactgcagttgaattatatctaaagatgtttattttttcaaacttttcattttttatcccaaatgaaacatgtagagtaaccttttaaaatcaactgtggcttatagcagtgtgacattactgttttcaaagaagtaactgactttgtgaccttaccaaaaaaagtttattagctttacattggaaagcagtttactgatggagttttactgactgactggaatttacaacagccagggagaaatatccactcaaatatctactgccattctttaatgcagttacctaaatatcagacgtgtctacctgctgctcagtctactagtgtaaatatttaaataaaactcagtgtgaccttttcacttagttctgaattttcttcctctctcttcctcttcctcctcttgtccctctccttttccttgtctcattttacgcatacacactgatttaccatcacacatcaacatttgatttcatcaccataaaagaagaaaatatgttctaggaagataatagaaaatgtaaggtatgggggcattagcatacaaagggagaaaggaaggaaggaaggaaggagggagtgtgggaggggaaagaaagggagaggaaagaaagaaagaaggaaaggaaggaaggaaggaaggaagaatttagtgtgacagtcaattgtttatctcttatttccattatgctatttattctgaaaccctattatatttttatagtgattaattttgcctgaccataaaaagcaattcttgaatagacaacatagatgaaacaaactatgtaaactttatccagggatgaccttaataaatatgttagattctaacaatcttttacttttatttatagttttgttgctatggagatcttatttcagaactaaaagctacatatataattctgaatgttatcattttaattaaaagataacaagtaaattttctatgccattaacaattgcatattgttctctttacaacaatgtcttttggagtcaatgaaaattaaaaatggtcttgctatgtggtcttaataataattataacagtcataaaagattaacaggtaacagttatgttcactatatgccagaaagtgtattaaattctttgcctgtactaactcattgaatcctcatgcaaccttacaaagcaggtactattatcttccctattgtatatatgagaaaatggagaccaagcattctcaacttgtcctggaacccaagctaaaagtggagccagcatcagaacccagaaggcttctgtaaaagcccacgtgacactgactttataacaaacctaccaaaatttagcagaattcattgcacagtcataaaacactcattttccccctttttaaaaaagcacttttttccatgtttaataacttgtacgtactttgaacataaagtatttttttactattacattttattttatttatttatttatttttcttttttttcatttattattattatactttaagttttagggtacatgtgcacaatgtgctggttagttacatatgtatacatgtgacatgctggtgcgctgcacccactaactcgtcatctagcattaggtatatctcccaatgctatccctcccccctacccccaacccacaacagtccccagaacataaagtatttttaagtgtcgttacttactggtatcccaggttaactcgaatggatagagctttgatggaatgtcagcctctaggtgctgtaaatgaaagatcttctgcttcacagagttggccatagcatcattgcattgtttctttttcacttctgtgtacgcaggaagcaaccagcttggccccatatatggccacacatcagtgatgacaggaagtttgctggatgaccaccactggcactctgtggtcattgagcgccaggggcggagcattaacctcactctggacaggagcatgcagcacttccgtaccaatggagagtttgactacctggacttggactatgaggtacatgtgatgacgtagaaattgtaataaaatgtcaagcaattgtgtcactctcctactgtattgtattattgttaattatattactacttacaccttttttattttcttctctaaacaagacactgacaattttaaaaacctgattaattcgtttcattttatttctaaatttataatcatgagtacttgaactattataaaaatcttagtaccaatgtaataatttgaagagaggaaccatgctatccaggccatttaataaattcagaataaatttaatttgtaatcctttcattggtagttaatcatgttatcaattcttcttgagaatgtgcagtacattatatgcagagggttgtctaatatttattataaagtattgaataagaaatcttagtttctggtttatattaagtcatttagaaactcatgactgtagatgggtcttttgacaagctctgttttctcagaatcaatatcacaaaagcaataaagtaaaatacagactattttaaaaagattgttcatgaacaaaaagacatatattaccttctcaataattagagattaaaaataatcaatgatcacgtttatataaataaaaatatattctcataggttaaaagtaggtatatcatatttttaaattatttggagagcaattcaaccttaaaatatccattaaaactgttaatcatatacgtaggtgagctctttaagatgtttgtcagccgggcgtggtggcgcatgcctgtaatctcagcactttgggaggctgacgcgggcggatcacagggtcaggagttcaagaccagccggacaaacatggtgaaactccgtctctgctaaaaatacaaaaattagctggttgtggtggcacgtgcctgtaatcccagctactcaggaggctgaggcaggagaatcgcttgaacccaggaggtggaggtggcagtgagctgagattgtgcccctgcactccagcctgggcaacagagcaaaactgcctcaaaaaaaacaacaacgaaaaaaagatgtttgtcacagtattatacatcctaggagaaaaggataacactatacatacaaaagcagcagaacggtaagataaaagggacacaatgctattacttagccagaagtttccgaactttcttagttcatggagcccttagtgtcttcgaactttttccacagcagtcctgagccgttaggtccaaacaacctaaaaatttacgtcctaagactttggtagccatttagagaaataaacacaaaataaaagtgaaagtagatttttatttcattcttaaacaacagcaattattactaatgggatgagtgctattgcactgtacgactggcagaaatggggatcagatttgccaatggcattctaattttctgttccacttttactctacatgatactctgtcttaatcagagtaatgagagtaatgaccaaatccaaaattcacaaagacagcacatcattaaaaggaatgacacattatctaatactggaacagtaaactaccttaagctagagtttcacacaatgtccaaaaggtgtcaaatattgttgtgttttctttaaaaatttcaaacatgctatggcacccctattagttttctgcaccaccttcatgttccttggcacccagttctgaaattggagatgtattcatatatatatgtgtgtgttatgtatatttatgtataattttataagaatatggaatatgctcatcataaaataaatggaaaaaacaggattaatagctgtgttttctattatctttatgtttaaatagtttctagttttttgcaatatgaatatacgatatatattcttaaataaaaaatttagagtagaatatgctatataaacactgatggagactttattaacattaaatgaatttaagattattggaaagtattttatccctccccctaaaaaaaactcttaaaagcaaactgattgttaaaagaaaatgtatgtgaacatcccagaaatttctatcttctctaaattagtatgtgtcttggctcatgtgacttatctcccaatgtatgagagatcttaaagatgaattattcatcctctgttaataaactttgaagtaccatagaagaggtgaaaattctggaacattaagaatgaagaaatataattctaattttcaaaaaaccaaattaaaaatttggggtcataaaccctgttgagtgtgtgacgaagtctatgactattcacgcacacacaacacttgctatatcggatcagcagtttcatggacactttgaagcccatctatatacaatgtcgtgtttgagaactgcaggtatagactaaaatacctggaacttatttattagacagaaacagtaggaagaaatttaaattaactgacaaagaatcagggtagacttaccatttctggctactgccagattatggtcctcttagagactgcaattattggcatgaaatgtaataaaagtggctgtgcttacctttatattgctacacttttctcttaatggaaagggactccctttgcttatttgtttagaaaaaacctcagggactgggccaggcatggtggctcacgcctgtaatcctagcactttgggaggccaaggcgggtggttcacctgtgctcaggagtttaagaccagcctggccaatgtggtgaaacccccgtctccactaaaaatacaaaaattagccaggcatggtggcaggcatctgtaatcccagctacttgggaggctgaggcaggagaatcacttgaactcaggaggcagaggtttcagtgagccaaaatcatgccattgcactccagcttgggcaaaaagagtgaaattccatctcaaaaacaaaacaaaaaacaaacaaacacctcacggactgtattagagtcagtctctagttttgttgtacttatctccttgatatatccacacactaactatactcaaacctcacagactgcatgaaaattagcttcaaacctaaaataatacaaattatacaacattcattcctgaactatttaaaggctttggcctaaaggaagagaaagctcgtcttgttatcttcacaaaacctgaagatgcaatgtcctgcttccccaagattatactgcctcaatcaattcttccagagtacactaaggacaaaggcattgaggcccaaaggtggaggtatgctggtaaatgcttaacaaccagctctctccagggaggaatggtcaggaatgccctgatatatagcatttgttaattttcatggtgcgaatttcccaccatggttgatttcatgctaccatatatggaactgagcagggagttgcaaagaggtgcctaatagcactatatgacggtatttccatcatatagttgcaataaatataaatgacctcaagaacatatacgaaagtaaagtgtagagataaattctgaataggtatgaattttgtgtttcatgtaatttacttaatttatagcttatgtagtggaagttttaataatagctctgcttagcagtcggttcttgtgaaccagtatgagtgggattcagcacagcactgctagcgtaaattaaatatacttaccacaatttctggagatgaacatcatgaaagaagtgatggaatacaagttcactcctttgatgtaactctatgtggacatttcctttttttcctttttttttttttttttttttttgagatgaagtcttgctctatcactaggctggagtgcagtggcgcgattttggctcactgcaacctccgcctcccgggttcaagtgattctcctggctcagcctcctgagtagctgggactacaggcacctgccactatgcccggctatttttttgtatttttagtagagatggggtttcactgtgttagccaggatggtctcgatctcctgacctcatgatccacccacctcggcctcccaaagtgctgggattacaggtgtaagccaccccacccagccctaatttttgtatttttagtatagatggggtttcaccatgtcgaccaggatggtctcgatctcttggcctcgtgatctgcccgcctcagcctcccaaaatgctgggattacagacataagtcaccgctcccggcatatatggacattttttgtgacctagtcctaagagtttgtctcatcccctcctcttgtagctgcctacactgcaaagtgggccaatcaccacctgcaatgaggctgctagctacagggtggcttgagactgtgtggtgatatatacgtgcacttcacttcatttttcctcagcgtagtcaataaaaaccaaaggggagagcagcaaaatggtgtttggcttagattctctctgttcttcagaggacacccactgtggatattatgctgttgtcttttgcaatacagctctgctagggaagtagaggaatgactctcttgaccattgcagaaccacagactgcctaggaagaaaatcagtcacaggaggagaagcccgagtttgaacctgtttctgccctttaatggttgtgtgacagtggacaattcatattcccctttgatgaaatgaatctaatcgcattctttccatagggtttatgaggaggcaacaggaagtaatagaaaaaaatgtgtgtgagttaagattacataggctacatttaatggatgcacgtttattctcctttatgtaaaagaagactggaggcaaatggctgctccacgatcttcaagatcacagtcctttttaatcttgctcttcctctatccctgttgcaaatcactcaaagacggctgctaacatttcactttgcacttcagctagcaagaaggaagagagagtaaacaagactgtgtcctccccctcttaatgacagttcttagaatcgcatacagcccttccacttaaatatcatgagaccaaaactggcttcaaagaagttgataatttattatattgactggggagcaatgtgcccagctgaaaagcattattttttttccctaatgagggtaggaagaaaggatatgtagaggtatccaatagtccctgcgacattttgtgtacacttgaaagctaacaaaatcgttactgcagttatttctttagaggcaaggttattggatggcaaggtcattaataaatgtatcatatgagccacaggaataattgaatattaatcggacaactgcaacaatatttgttactatcagcttcgttaaagtgtcagaaaatattctgtggtccaaccagtttattttaccaatgagaattttattttattattattaatatttgagacggactctttctctgtatgcccaggctggagtgcaatggcaagatctcagctcaccgcaatctccgcctcctgggttcaagttattctcctgtttcagcctcccaaatagctgggattacaggcatgcaccaccacgcccagctaattttgtatttttagtagagatggggtttctccatgttgatcaggctggtctcgaactcctgatctcaggtgatccacccgccttggcctcccaaagtgctgggattacaggtgtgagccaccatgcctggcccaccaatgagaatttataactagaaagaataaatgacaacctaatatcctataattagttaccttaggaattggggtcagaattcactaaattgttcggatctgttaacttgagcctgcattgcttttccagagcaccttgatgaggtggacttgtgcctagagttgctgaaaacagggaaactgtaaggataatttgaatcccctgcagaaagtgaaaggtccgaattaaagaaatatgcacacagaggaatatgtatttaataatattaaacattgacggtattattactgtcagttggggaaaaattgttcaaaaagattgtaaacaggagacgtagtactccattttagtatcaaaaatgattgcctttggtactaggcacacttaggtagtacctaatatgttcatttcagtgcaacttgaaaacattttcccaataattctactttagattactatttcttctttgtagttttctgattctttgggatatatttttcctcaattttccttttaccttcttatatatgaactgtgtggcaaataatacatattcagctaaccattattaataataattgattttattgtaaatgaggcctttgtttttttttttaccatcacctcataaaccacaatttgtgtttccccccctaaaagtacttaagcatttaagatgccataacactaaatcatagaacataatttgttcatggaccttccagaacacagaatatttgacttatgcttcaaatatgaagtcgtgatttttaaaaatgtcttcactgttgctttcatttcaccccatcaaacatgctctggaaaagcaccacaggctcaagttaacagattcctaaccatttagtgagttctaaccccaatccctaatgtaactaatgataggatattaggctgtcattgattctttatagttatatattctcattgaaaataaagtggttggaccacagagcattttctgacattttaatgaagctgatagtaaaaaaaatagataatggtaatattgtatgataatttaaaagatatatattacaagtattgtatatcttgatattataattagcggttggcttcatttactactaattcactattcatagtaaatatcatccttgaccatgcaaatactaaatgcaattttgtatcatataaatttaatgctatagtgtatattgatcaaaaatgtataagaaatggatattttctttctataagcgatagcagccagagaaacacagtaagtagcattgtcttatttcttaagatttaaaagacctataatatctttaagcctacacagctcaactttgagttcccaaatcctaagtggtccctaatcaatattgtaatgatattttttgaactattttctacatccaaaataaatctaatgaatttttgacaataatggtcattagactacaagtctgcatagggtaaatacgatatcccttgctttgggctgcagttttatcagcttattaaattagtgctgattatctcatgcttactggaggcatttattgatagtatgtctttgaatgataaacataaaaatatatttctaatattatttgatacaagaagtttgctgaataaaaatcttttaaaatattctcaagaaaatttataaaatgcctttggggcagtaaaattgcaaaggatcattgcttttttttgttcaagttataatctaattatcagaatgaatgactccattagacacttcaacaacaacataatttaatatgccatagattttggaggcagaatgctataatatttgtatattttggttgaggtatagatacttgaccttcactgtattcatagttttgtctagttcatcataatacaatgtggacgtttacatttaatttctttttctcaaagataacctttggaggcatccctttctctggcaagcccagctccagcagtagaaagaatttcaaaggctgcatggaaagcatcaactacaatggcgtcaacattactgatcttgccagaaggaagaaattagagccctcaaatgtggtaaggattttcacccgcaaaatattggtctataaaatatcaagtaacatttttgttttttggattattgaacaacaacaaaatcatgacatttttcatcatatttgtgtttgggcaaaatgatgtaaaacaaacattagagttatcagaattagtatagatacttgctattctttgagaatagctaatgggactagcttgaagtaggtggttggttttattcccacggagcacagaatgttagactcaatatttctggatgactcgtggcacgtgcttcatcccagcagttagcagcccttaaaccggcagcatcgtgttttcaaatatctcatcacatgtgctctaagttacttgcttatggtttaatttaatatttttaaagtttttaaatcagggactttattatatttactcctgtgcttccaaagatgatttgtttgaatatgtaaataaatacactttttagcaaatctctaaccagactaaatattacacagttaaataaagcttgatttccactgcatagccaaagctgtgccacagaagttcacagtgatttttttctgccttttgtgtgagttggtgccaggtttcattagattttggaaggagagcaaaagtcaaagaaagccccagcacacatgcttccaaacgacactactccacatccctaaaagacacttagtttgcaattttagtatgagagttccctatggctctgcaagaccaggagctgctttagcccagagaggctatttgggagagcttagaattccagagacccatacaataagaagatattatgcactataagtacaataatgtcatgagtgtttgcactgtgctccaaaagagctctgatggtctcgttgcctcaaatttgagcccagggtttcataaaatgatttgacaaatggaaatccctgaatgaataaacagttcaggttgaatatggaaggtttaaaacaataacttcatgcaaatgattatttaataaataattttcttaaagtaatcataaatttatactagaaattaaaacttgaactttggttaaattttctcataaagtatattgactatggaaaaataataatagctccatttataggcaacaggtattgtgctaggcaagtcgtattttatatttaggatgatctgagaacaatactgcaagaaggatacaaacattttgtagatgaaaacattgcgatttaacatggaaaaaataagttattttatgagaaaaataacttttattttatgagtaggagataaaaagatagatgtatagcctggtatagtgggttgctgctgtaatcccaacactgtgggaggccaaggcaggaggatcacttgagtccaggagtttgagaccagcctgggcaacatagtgagaccatgtctctacaacaagttaagaaaattaaaattaaaaaaataaatcaaattgaattaaaaaattagctgggcataatggtgcatgcatgtagtcctagctgcttgagaggctgaggtaggaggatcacttgagcccacaagtttgaggctgcagtgagccatgattgaactactgcattccagcctgggcaacagactgagactctgtccccccaaaaataaaagaataaaaaaagattatggattcacaatatgtgagtttgattatgctctataattacattttattttaacaaataattgcagtgagaaaacatagaataaacttttgaatcaaaatatacatacatacagaaaatcttagatgggatagagacaaataggacattttgcaagcaaccctgcaaagacaagtgtttatataagaaatgtactttcaaagatgttgggtgctggtatttcagtgaaattgactgagcactcattctacctcctcttcccccacatactcattccctcattatgcattgactccaaagtcagcaccgttactctggaaggatctttaattttgctagggagacaatcccctcaaaagaggtatgtggtcagttataaaatctcaattattatgcataggcagttctttttatcagtaaaagcgagcatttaaaaataatcatctgtgatggtacagagcaaatttaatttgaatattaattcagagagactgcctgccttagatttaatggttattgtgctaaaatggaagaaatcagcatcaggtatatatatatatacacatatatatatgtgtatatatatgtgtgtatatatatgtatatatgtgtatatatacacacacatatatataccatatacatatatataccatatacatatacatgtaccatatacatatatatgtaccatatacatatacatataccatacacatgtataccatatacatatacatataccatacacatgtataccatatacatataccatatacatatatatggtgttgttaaaaatatatagagaaaaagagagacagacatagagatagaaccaatgaaaatatcatccaattacattccttaaaatattatgataggataaaagaagttagaagcaaatacagatttttagacctgtaaagagaatgtagttaggcactgaaatatacaatttagtgtatctgaatgataaatatttttttcttttttttcttttgcttataccaaggaggaggagtatagaaggggaggggaaagcctgaattattgcaaattttatctccatttagcccatttatagtgctagttatacaggaattaatgcattgtgatataagcacaattcatgggaatttaaatgggattttgagttggatactaaaataatctccaacaaccacaattacattaatgctgaaaacttaatatctatctatctatatatgcatatacaaggtatatagataaaaatccaaatatatttccctaaaatatcagtttcataaattgcaaacatatgaccatagtccccactgagaccagagtaatatgttaattaatgttggcattgaccacccagaataggacagagcatctctctccctgacttatgttcggccagcagtagctttgctgtcttcagaaagtctagtgatccacagtcacacccacaacacacatacacactttacaactcatggtcagcctatcacatcaggctgtctggctgtcaatcccatggtggaagctgcttgttatagttagacagccaactgctgctcagtagtaggtcttacactccaagtagatccgtagtggtgcatccagtcactgaatccatgctctgctgctgtgtgtgagtttagcttaggctcaggctgtgcttcaaaacttgtagaactatactttcatcagtggtctgacatggatgttcattttattctgtgttttcctcagagcctgtctttctattttacagggaaatttgagcttttcttgtgtggaaccctatacggtgcctgtctttttcaacgctacaagttacctggaggtgcccggacggcttaaccaggacctgttctcagtcagtttccagtttaggacatggaaccccaatggtctcctggtcttcagtcactttgcggataatttgggcaatgtggagattgacctcactgaaagcaaagtgggtgttcacatcaacatcacacagaccaagatgagccaaatcgatatttcctcaggtcagtgaaacctatttgacatttgttcctgaaacttattgcaatttccagagttaatgttgtgctttgtttggttttgctggtgttacacgctcaggattaggttttaattcagatcttcaagacgcttacttggttgtagtgtgtgctgattgaataaagaaaacttggaaagttgttgagagagcaaggcatgggtgaaggagaaaattggttgagattggaaaagcaaaatctattccttaccaatgctagtttatttttaatagataaattgctcttcttttaagtgaataatttatgtttaaaaacaaggaatgtttattttaaaaacacaattgtatctggtatcttttctctttatcaacattcgtgtaccttttactattagtaacaagattatactaattttaactttaaggaatattccactgctggaatcagaacttcaaaatgatcttgctaaaattatgcaaatggttggaaaagaaaacgaaagtgaatataaaggtggaatgacaagatttgtgtatcaactgacggaagactggcttaggcaaaaataggataattttaaatttggctttgtagtgatatgacaaatagaggcttaggtaatattcttgttatttgaatagacttcgcaaccttggaagttctttgataaatacagtacaaagaaaggtgacattgtaaattgtgatgttataagcaaagaaaaattagtctcaatattggactgataaatagtaactgttttcatctatttttcttgagatagtctttgcaatagtcatacatatatattgtgaagaactacttagaaatgggagatacaaagaaaactaacatttactgaacacttagtacagatgtagcagatactgaaaggagtcatgacagagagctcaattgggtgaccatggactctgatttctgaatatgccatatactctcatggcaccctatgcatatacctgacacggtttctaacacactatgatttttgtccctctcttttcccctctaggctccatgctccttgacagcagggaccatgctcctttttcttctgtctctggcatatagaatagtacctgtaagaggtgctctccaatatttgttgaattcaatactctgacccctttcaactaacagaatatcccctgctatagaacatatatattttcttgtaaaataggctttatgtttgtgtgtggcctgaatgtatggtctattactgaaaaggattcaaggaagccacaagaaatgttatgtcagagatgtgcctaaattattgaaatcaaaggtattgggaaatacctagttattcactttctccatttctgctttattagttttgctttttccttgaatgtctagtcaaaatgattaatcaaccatattttatcactacattcgtttataagtatacctagggaggtttacagcaaatcgaaaatatctggagagaccagaaaaacagataaaacaaaaacaaaagcaaatgtttgccacagttgaaaaactcccacattatattgttatgattaatgattattgcctaatgactaaacataaaaatattagtatgaaggcctgtctccttgcagtctctgagcaaatccgatttgctggtgggtttccatgtaacaggagccaatatatttgaaaggataagatattaaccctagtggtcaataaacatgtattaatttgatttggtgtaatttagtactccaagatactctcacctaatttaagctgtgtttattttgaaaattaaagatagaatgaacaaagaaatccaatacatgacagttaattcaccttaatagatttgcttaaacctaataaaaatggactgaagagtttttgtcaatttagccaagaatctgtgcaaattaattgaaaagatataaaatctaaagatttccgtagtattacccttctataatccagtgaaaataccttactgcttcaagcattttatataaatatatatatatacagacatacatacacacatacatacatagtggaaactaagtgctcatatttgagaaacattagttgaaaaaaaaattcaaccatttaaaaaagttatattttatattcattcattcaatctaaaagtacatatggaaaccataggacataatttcctctgtcttttaatgtattttatcaaattcaattaaatgtgtaaataagttagtaaagtggcaacactgagaaaacagttaagtcaggattctaatgtttgctttaacaaagggaaatatatctgtatcacagctattctactcttatcagcatgagcattgaagaatgtcagtccacttctccttttgtcaaatattttgattgaaagaatttagaaaatgcagaaaatctagaaaagaaaaataaccagtgataaaattttggtgtacacacacaaagtagtgcactgagaaggtaatatagagactctcagatactgttaatatatactggtaacttagtttttatttaataaattccatggtccaggatgaatgtaacccaattagatcaaaaacctttttttccatcttggtcaacactgttctttgggaattaatttaaaatattaaatacatcttacaagtaaaataatgtttaatatattgttcaccctatctttgtatctttctttccaagttgtgattactgtcttcaagagtctcattagtaatcaacagtagacttgacttatgaaattcagtcaaactcagtagccttgaatttacagagtggattatcttaccatgaaaatattgaacaagttgcaacatcaacgttttctgatggatagccaaaaacaaacaaacaaacaacaacaacaaaaaaccctacttactttttgaaataagtttttatttcaaagtgactcaattttatcccagtacatcattttttaggacagaagttactgatttatgaatacatatttaggcattacttttaactaggcataaatgataatattaaacaggtgcaaaaagggtctaatgaataatagctgttcattctgggcataattttcattttaactttaaaattcaaaactctggggaaggtggacctagaaccatgtttttcaaataattttgatcaaagtacagtaagaaaatattttatgtcatacccaaaacctactgacacaaagtttgatgaaataaaacttgccttgctattttagatgcactatgataagtgtgatattttcttttcttttgctttattcttaaaaaaaaaaaaagccataacccactataataatttcatgtcctaaatacagtttggaaaacaccgacctgacctgcattctttttcttatttgaagtgttggaatttttaaaagttttagttgcctggaagtattaactccatcactctatattggaaaactaaatttgtcttatgggaacagtattataatattataatggtagtaaaaaagcattaatgtacattactatttgaattatagcaaaaaaaaaaacctaccttttgaagtaagtttttatttcaaaatgcctcaattttatgccactaaatacaaacatatttagaacaatactcagttgtcgtctgccaatattaacaaggtaatacaatgtgattcagcatttattatagtggggagaaagtgatttatcttaatattctctctcagttattggaaaaaaattaacttctctccatgtataaacaaagcctttccaaaaagtcattcagaatatgtcctgtcctaaatcagctgttttcttatactcaagtattggaacatccttgttttgttaatgtaggtattgcttcaattttcgaatggctgttcagtgtccacactgtctcagaaatatgtaatcagaaaagattttctcatttgtattttcatctccaaaggaaatcttctgtggacttgttttatttactttgcttcttagtaaaatttcctttgtaaatcattgtgttccattgggtgtctcaagggaggagtgggagttttcttggttcagtgtgtggctgggagcatgctgggaaatagttctcagttcaatctgggcaaatgtgtttgggaacactccaggcagtgtctattctaagcaattaaaatatctctgttcttgattttatgaacacttggaaatgtagccagcatattaatatttctttaaaaaattaatttataccgttttccaaagttcagtgataacttgccccatgagacatccttttcatcatatgagaaaaaaggtctcatttgaaatacaatttttgatgttttagttgtttactgaaaattttttttcagttctatactgatattatttcaaaatgtcttaaattcttgtaactcaaaaactaaatgtttcagcattactacaaatactttaagagatttgttttattatgttttacagcaaaataattggagacttatttaacaagatatgttctctaattcaagtttaaaccatatttattagaagccttaaaagatgttacttccctttgatccattaaatttaagtttttctgattctaagaaaataaagaagcacccagagttatttatcacaacatatatacaataaccaaagtaattgaaaacaaactactgaaaatggacatgtgattttaaagagtgtatttttatgtggaatactattatgtcattataaatcacatttcttatataaaatttaataacatggtaaaaaatgctaagaataaaatttttaataaaaacttaagtagactatgaatctaatgtcattattataaatataggaattttatttcattccaaatcagaatgaaataatataatactaatgttgatcatctctaattggtgggttatcagtccattatattaactttttaatatattttctctaatatctatattttctccaataaacatcaattgttctcagaagtcaaaaacaatatgctacaaaacaattgaggataaaatgatatttctgaaaagtatgatgcttaacaatgttacaaatggaaattaaatagcatatcaatttaaaaattctaatttccttacttagaaacatgtacagccaatttcttaaaagtttcaccttaaataataagcttcaacagaatttcaattgcatttacatacaaatggagcattttataatcaggtgcagaaatttggaggttgtgtctataatgtttaattatttgaaaatattcataactcattttgaacaaattccgcaccatctatgtaattttaaaactatttttcaacctgggtaaataattggatagataagtagataaatgattggaaaatagatagatacgtagatagatagatagatagatagatagatagatagatagataggtagatagataaaaagtattgtcccttaaaactattgctagctatcaggtaacaacatattcctttttctcaataaaggaatagattgaataaataaataaatcatcactttattcccaaataatctacatacaccatacttttacaaaataagtggctaaaaagtaatttttagatttttgtaccttttgatgggcttgtagatatctaaaaatttccggtaaaggcaaatccatcatcttaagatacaaaagataaaacatggctctgtattcttagggcgaaaatggagcctaagaaattctgattcatagagcactgtactcactttaattaggagcctagaactgagctggaaaggaatagattctattgtttggtggatcccaaaagtgagatagataaagatctgagtactagatctaaatagacacatagaaataagatacccttggacatatctaaaacatattttgctgattttattccctgaaattcacaaatagacttgctgtgagagccacatggtaccaagtaaaaggcatttgagtcaatggtatgttgctcctgggtagcttcacccaactgactttttattatatatcaattcctagtgtggctgtaccactatcatgcgaactgagtggaaatctacctttaattatactgcagtgaatgctggtgcacatttttcatcaatagaagcattatagtgcagaatgaaaggaaaaaaaggaccgggggagagttttatgatgttagatattgacttattctttagaaagcaaaagggacattttaatttataatcacactccaggacaccatttccattctagtttctacaatatttttgagccttttaaaatgttctatgcctttttcagggaagatgaataaaacatgttgtgtgtatgtgtgtataataattttttaaaattccaaaaaggcaataaagttttagtaactttgttggataaaatggaggcaaaaggtgccaatgagaaccagactgtgtttcaaaagcttcagtttactgtacaaataaatcgaagagaaaaaaaaatcagatatcactagttgatactaagagaataaaaatgaattatgaaagaatagcaaagaacatagcccaggaactccaaaaataatatatgcatgtagttgaagatgtttctaagacaagaacagggaggacatagaagcaaattaactttgctgaaaagccagtatatttctcagttaacagataatattgtatctacttaacatgtacagaatgatgtcctgaagtacatatacaatgtggtcctttacctttcatttaagtgtaagggctgacacttcatgtaaggttgaaacttttgtagtggataaatgagtaattggtaaatttaagcaatatggatttacatagtagagatatatctaagtcaactttagatgtttttgcaattgcgtgtctaattttgtttcaaatagttaacaaaataaatagtgttggcatgaaacaatcagggatgatgtaccttcataatcagaaaaaacacaaagcagtcattggtttggaaccttccccacaccacttcccactccccccattaacctcatgttgagaattaccagggataattaacttgaccaggaaattcagactgtgagatagtatcattgcccagcatctacctccctcaccttttaatttttaagtaatttgggaagaatgtaggctcattaggttatctgttgcttggttgtaactagatgtggaaatcagccttcttgggggagggattctgcagattctgtgagcctctgaaagtgacttgggatcagctgaaagaatgactcctttggaaactcagtatcatgtttagccacatatatttcttagtctctttcctttcttcatcaaggtttttcacaagaaaattttgggagagtcattcaacatgcatagaaagtaattacctttggtaaacatggtatcaggaaataattatggatatggccccatctgcaatcatgactacattttctgacttattttattctgatatatttcccttgaggcttttctaacctgagctcagaccctacttctgggaactgaaattctgtgctatttctgagtcctctttcttctctccagtcagtgcttttttcctttcattcattctctacgattcaattttataattacagttgtgcctagattcttactgtagcgcttggtagactctgatgttttctgaaagatactgatgacctgcctagatgtctgttctctctacaatcacttctagtctttcttctagcacttccaggctttctgagtgtctttccgagattgaatctctattgctgaacctctgtccagaggccgagatcttgctacccctagacgtacaacctgctgcctgttccctgcctggatattggagtactgctcacctccaatttcccaggattctctccttccctcattccaatcctctgctattttatttttaaccctgacatggttgacttgattattttaggtcataacttcctcttgcctatgaatattgcttacccttttgggcatgaattttaactacctcccaatctcaactgctgctatcaatccttgtgcacacctgtgccaaatctcagccacccctgtattctttgtcatcaaattcctattgcttcttggaatgcaaatctaacatatagtggattggggaaaactacaagcagaaaactagtaaagttcacatagtcccctaagatcttagctttggttgagcacagcttgtcagctaaccccatggccaagatcctaggatcgagagacctgcatctgtaatgctgtacataattttatgggcaggggccagaaaagttgtcctgttaggaaaggagagcctctggagctcattggtagttatcaggcaacttctcttttgtgctccctcagatctgctgagctagctccttgctgtactgctataaaggctggcgagaatgagactccggggccatccagatatgcctcttatctactgctaagattatgatgacaactgtgataatagataataactattgaatgcttacactatacctgtcactgtgctaaagcctttgcattaattatcttgctatggctccaataacctcgtaagttaggtcctgcattattgagaaacctttctatctcatttatacaaatggtaaagtcattcttctggtgacacgagttcaaaactttgagaaaaatcaaattttgccttttatcttttcctgacacatgcgaagatttaacaatcaccacccttcttttaaagtgcctcattcatccattatctctttaccctaattcaaaaattcataccttgaaaaactaatcaagggcatcttattgcctaaaagaatgtttatcttcaattgctgacctatttgttagggtataggcgttatgagcatggactctggagccagattgcctactggctatcatggattgagttctttctctgtttcagtcactgttgaaacaaacataatgtacacaacggttttaagccatttaatgcttggaacaactccacaagatgaaggacattatcatctgcatttcatagattaaaaaaaaacacaggaatagacatgagtaactcaccagggcccctttcagctagtgaatagaagagctttaaaaattgcccagagcatttgagtctaaagtcactaaccttggccactacctctcatattcatgaaacactttggtgttacatgatcacacaggatcaggtactgtggaatatgacacatctgaaatatttgttgaaggcagaacctgacatcaatgatgtccttatcatgtccattggggttctcacaggagcattttaagtaatctcccttatgtttctaattctgtctcccatattatccaagtttctatttctacaatacaaggaagataattcaatagtttcccattactaaagaataagtcctgagactttgctgaagttgcctatcagcttaaggagattttgggctgagatgatggggttttctagatacacaatcatgtcatctgcgaacagtgacaatttgacttcctcttttcctaattgaataccctttatttccttctcctgcctgattgccctggccagaacttccaacactgtgttgaataggagtggtgagagagggtatccctgtcttgtgccagttttcaaagggaacgcttccagtttttgcccattcagtatgttattggctgtgggtttgtcatagacagctcttattattttgagatatgtcccatcaatacctaatttattgagagtttttagcatgaagtgttgttgaattttgtcaaaggccttttctgcatctattgagataatcatgtggtttttgtcattggttctgtttatatgctggattatgtttattgattttcttatattgaaccagccttgcatcccagggatgaagcccacttgatcatggtggataagcttcttgatgtgctgctggattcagtttgccagtattttattgaggatttttgcatcaaagttcatcagggatattggtctaaaattctctttttttgttgtgtctctgccaggctttggtatcaggatgatgctggcctcataaaatgagttagggaggattccctctttttctattgattcgaatagtttcagaaggaatggcaccagctcctcctaatgggtgcagcacaccaacatggcacatgtatacatatgtaactaacctgcatgttgtgcacatgtaccctaaaacttaaagtataattaaacaaaaaaagaataagtcctgatttcttagcatgccacacaagaacatgcacaaactatgctccactggagcatttggcctcatttctcctactttgcgtcatattgactactttccactccctgacaaggatttccttctctatattccatcctagcaaactgccatttatcatttattgcccaattttagtatactttccttccccaaaccccaggaaacaatctaccatcctctagtatagtgccttgtatcttgaataacaattattttttgttacatattaaatcacatactcctctactattatgtctccctcatatctgtactcctaacgccactcatgtgtcaggaaataggtaatcaatactttcatctttgcttttttggtttgattcacacctagactgttgcagtttccttgctcttctctctgcctcctgcctctctaaacaagtccattccacacatttcctcctgattacaatttcaaaatgactgcttccattgagtcatgttcccattcaacaatctttcatgaacccccaagttttaaagatggtctcacatgtcctctacaaaaagcctgaatactaattccatggcgatctcaaatcctttacaaattttaaattattgtttacatttgtttgacatgatttattatattgttaagatatttgatactctgttcaaaaatgcttcatcttctaaatttttttaagaacaacaatcccacttttcctttgtctgtccacctctgagtttagcacaatgtcttacttatggcatgtttctagatatccagttgattgatttttttaatgtactgataccaagatgttataaactataactttacaattctgttatcttcatcagtttatataaaccaaattcattataaaagaagagtagcaaatatctcaaaggaaataattgcttcactgtgggaggctaatgtgtgtgaaattgatcaggaattaaattttaatttgatacttttataataagagattttttttaaagatattaaagcctagagatgtactgggtaaactatttcaggagtaaaatgaaagcgtgtatacatttgccagaaaatgtattctcaggagcatgacgtgaagtaaagccttgaaattagtcatattccctttgtatttatttttttcacacagaatacaaaatataaatgtgcatgattaaaactaatttagttttattcttttcttcaggcttgggaatgcatttgacacgattaactccagggaaaaacaagagaataaattttttttgtaccttctacttgagatctcagatctctagtcagttctacacgattaaaacagagactgtccctttattgtgggagtctagtctgacttgctttgttaagtgaaatggcatctattgatgatcaaatcatgttgtctctgaagtattttatttgaaaactccaagcaataagattactgtttagaaaaccaaacagaaaaacataaactttagagtaactttatacgagacattacgtgtggacacggagaagtaaatttcacccccaccatacttccatcctgaccccagcacctttatcttgggttcacgtaagaccatacagcatacacatactacacttccagcacactttgttcagctatggttgacagaatagagctaacacattctccacttttaccacgtattctttataatgcaatattctatagggaaatgtgaaatctggatcacatgtagatctattggcaggtacgtttctaatctttttctctccaaaatctactgtatcctatttcatgcaggataatcagtgtcatcggcatacatagcaaatggtttgttcataaaaaagcttgatgagggaaataaacccttgatagtctctataggaattatttccattaggaaactgaaagaaaaagagggtgttctatatgtattgttttactgcccatagcagttttgtaatacacaataagtttattacatagaatagccaataggcatcaatattgaaaaatagagaatgtgagctgtattcctgtacatgcgtgcattctcagcaatgttgtgtggctgatcggtattgtgtgagtgcgtgggtgtgtgcaggagtacatgcatgctttttaaaaaatcctctaatctttgatgaagtaaaaaacgttaaaattcaataattctaattgagtgctataatgtctccatttgccacgtttgaatgatttagaatagaaaagattaaatcagtaagatgatatgacattagacaagtcagaattatagctcatctaaaacttgtattaagtgtttgatttctttcattcctcttctcaaacatttgcatattaactgttaagcaacaaaatacagcaattcctaccatttctaatttccttttgttctcttaataaaaccatgacaaataatgcaggcaagtaaggagaagaaatattcagtgaagaatcctcaaaatcggtggttctcagctaggagtgattttgacccccaggggatatttggcaatacctggagacattgttggttgtcacagctggagagtggggggtaggatgctactggcacacaatgaatagaggccaaaaatcctactgaatatcctgcaaagcacaggacaatacctacccacctgcacctcccaccaaacaaaggtttatttgtcaccaaatgtcaatagcatgcaggttgaccaccctgacctgaaggagctcctctgttgcactctggaagttgagtgccccagagggagaagcctagacctcccacccaccccactccacggacttccattttctcccatactgaataacaagttaacacgtttagacaagctgattcctgtagtcccttttaggtttgtttagagcttttctcctgttttatcattttgctctatgttgttatggtttcctgttttcctttcccaacatacatatttagaaaaattccagactcctttctttgatttcacttttgctttctttgtggaaattttgtatttcaaagcaatgaagagacgttgtcaattcctcttgggtatggtcagaataaagtataagataagagagttctcccggtacacactttatgtactattctaaggcatattttgttatttgttttctacagatgtcaagctctatttttctaaatatttgactctctagtacactgcatcactatgacttgttcctaccatttttatcattagtagatgcaaacataaattatgcaactttgtgtgagcttgacatgaggcagcagataattatcgcactggtcaacataacagattgccaatattaggttcaggtgttatgaaaatttaattatattacagcatgagaaaaaaattgagcggggaaaggagccttaactagcctgtgttagcctgcaaagtgtgttctaggggctcattctgcactttcttgttcttccgtctctctcctctgctcaccttctcagtctgccatgccctgctctgaagaggcacccatcatttgccccagcaagccacctagcctgtggagcagagtgacaaacagctccactttgcttagctctgggaggaggccatggtcctgacccaggggtccgtggggaccacaggctatgacctggacagtccctacaactataaaatgccaccaatggaggaagctcttgtgaaaacagacattcagatagctcttctgggtgttataaacgagtaactccttgttctggcttggatgcaaaacagattataaatgtatggctagtatcatacttgaagattatagaggaaatgttgctgttctactgtttaatttaggcaaggaaagtttgaagtaaaaaagaaaaagtgatccagttgcacagctcatttgtgaacagattttttatctaaatatagaagaagtttaaattttgaataacactgaagtgggttcaggaggtttggctttcatcggaaacaattaaaatgtatgccaagaatagaagatgagaaatcgtacctttttcttaaaaataaagagtttttgcttaaagtgctttagtgttttgcaattctgtcaacttattagctttactttctaaaaaataaattttcttatgatcaaggaaagagtacttctgctgggatcacatagaagcttaatttcttgttttcccacaattgatgattgtatgtgtattagtccattttcacactgctgtgaagaaatatcagagactgggtaattcataaagaaaagaggtttaattgactcacagttctacatgactggggaggcctcgggaaacttacaatcatggcagaagcgaaggggaagcaaacttggaacttttcacatggcagcagaagaaagagagtgagtagcgaaggggaaagacccccttataaaaccatcatatctcatgagaattcactcactatcaccagaacagcatgagggaaactgccccatgatccaataacctcccaccaggtctctccctagacacttgggaattatagggattacaattcaagatgagatttgggtggagatacaaccaaaccatatcagtatataaatctgctttgtggtgacctaatgcaaacagtttctttttaaaatcaaatgtacatcaactacttacacaaaaaacctctattatttaattcaataaatgattccttttcagcaaaaaaaacaaaaacaaagtgtgtcccttagagctctaagtgggagagagctgaaggcatgatagagcaaggagagtgagcactgaacacctttgtccttccacggctcagcatcctctgcgtggactgtggtcaggatgattttgcatcttctttcagtagtcagcttagaagttcctcctcctcatcatgtgttcctcctttctattaccagctcccaagtgggcctcttgttttgctactgataacacctgacatgctactgcctttctatagtagccgaacagaggagaacaatctttcttcctctacctttactaacttgctctttgatcgctacaaaaaaaagtacccagtatcctgtgagagtaataaatgagatgaaaaaattatataatgagagaaaaaaagtaacagtcctccatgactatcatctcatctctgtgattttattcatacgtgaatattgcaaacacacacacaccccacagagtctttcattttgggtacataatatattaagcactgagggtataaacagagtgccctcactgtatagataaatacataaaacattatagattagaaaaaagctataaagaaatcatgcaacattatatggtaaaaagtggtgggggccgggcgcggtggctcacgcctgtaatcccagcactttgggaggccgaggcgggcggatcatgaggtcaggagatcgagaccatcccggctaaaacggtgaaaccccgtctctactaaaaatacaaaaaaatagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaagtggtgggtattcaatttagactcagacagaaaagataagaaaaagtcacgcttggataggaaaaacctaaaatacagaagtcctatgacttgtaaatgtgtccagaattggttccttccagtgggtttttggtctcgctgacttcgagaatgaagctgcggaccctcacagtgattgttacagttcttaaagatggcgtgtccagagtttgttccttctgatgttcagatgtgtccgaagtttcttccttcctgtgggttcgtggtctcactgacttcaggagtgaagccacagaccttcacagtgagtgttacagctgttaaaggtggcacatctggagttgtttattcctcctggagggttcatggtctcactgacttcgggagtgaagccgcaaacctttgcagtgagtgttacagctcttaaagctggtgcatccagagttgtttgttcctccaggtgggttcatggtctcactgacttcaggaatgaagccgcagacccttgtggtgggtgttacagctcataaaggtagcacagacacaaagagtgagcagcagcaagatttattgtgaagagcgaaagaacacatcttccacagcatggaaggggacgagcaagttgccgctgctggctggggtggctgctggctggggtggctagctcttattccgttatttgaccccgcacacatcctgctgattagtccattttacagagagctgattggtccattttatagagtgctgattggcccattttatggagtgctgattggtgcatttacaagcctttagctagacacagagtgctgattggtgcatttttacagagttctgattgatgcatttacaatcctttagctagacacagagtgctgattggtgtgtttttacagagcgctgattggtgtgtttacaatcctctagctagacacagaatgctgactggtgcatttacaatcttctagctagacagaaaagttccccaagtccccactcgacccaggaagtccagctggcttcacctctcataaacatatcactattcaatgaatacaaaaaagggcaaaaagaaagaaattagtttggagaggtaggtagaggccagattatggaaggtataataaactatggtaagaaattagaatgcaagcccactggaggatttcttttaagggaattgaatgatatgatttttaaaagatagctctatctactatgtggatagtggatagatagatggatggatagataggtagatagatctctatctactgtgtggatagtggataggtacatggatggatggatagatagatacatagatagaacagaaggttatacagattatggagtgggaggtgagaacagggaaaatgagataaggtggaaagcattgcataatccaggagtaagtaatcgtagttttatctatgatgatagccatgtatatgaagagaagttggaggatgtgagaaatagttaaaagatataactatcacaacttggcaataggtctatgcagagtgtgaaagaaaggtaggaatcaagactgaattgtaggttcctcactttatttataggtaacagtccctttagctgatatggaaaagaatgcaaagagtttggagagaatccagtcctgttgtggacgtgtcacgttttagatgtctgctacctatttaggaggacaaggcaagttgtcagttagggatgtgagtctggagctcagagaagagtcaaggcttatgttatcagcatgaggatggcattggtattggaagccatagattatttactaagtaagaacagataaacagagaagaggaaagaattccaagccaagcctccaggagcttcatctttcaaaatttggtaagaggaggaaaagccagcaaaaagacagagaatgggcaatcagataagaagaactcaaagagtactgaaaggaacaggagcacgtcttaagaacagtattgtaattttgttaaaagaaaaaatgtagagtagagtatagttcagaagtacaaagaagataatagaaaaaaaagtaataaacctaagcaggcaactacataataggaaattcacaacttagatcttgactaagtgcaaggcagaattgtaagtagtctaagaattattttccaacatctactgcttactaattttatggaaggcttagacaggaaagatactaatttcactagatagagaaaacctaggctaatgctctttgaaaactgaaaaatattgttatatacgtatgaattatgaatgttgatttattgtctactccttgttcaaccccttcctccccactccttatgagaaatctgctcaaaatggtgaaagtacaaaaaacagaacaagacgacaacagagtaggtaagtaatcacactgtataataaagaaaataaactggaactacttggaatgactattgaggggagatggaaggatcagacaaaaccccaaaagaaacccaaaggactataaagaaatagaatatcagccaagggatgtttttaatgaaaaccaagaaacagaaagctcagaactaacatcggctaaggggcagtctgtggcaactaagaggtgcttgatgtattttaattcacaaaattgtcccaacacattgtgaaatgcatatgatcaaccttttgtaaagagaaggccaaagcttaaaaggtcacacaaattctcatagttttatctgtgatgatagccatggatatgtgagagtatccaagttttacagaggccgagttggtacttgaaatgaatttggctttatttttaaactcctatactttctagtaccctaggctagtgaaaaacaatgaagtggcaaatgttccaaagccagggaaaatgttaagtaaacccaacgctaagagggaactggtgtaacgggaatgataaacatgagtataattactcttttgtaatgttaggctgtgaaaaaagtgagaaataggccgacaaaatgatagtaaagtcacatatatctagcatgcaaactattgaataaaacaaatagccaaatataactaaatataaactataatttttttcagctaatccctagaaataacttaaagatgacaatgcaaatattcacatcttgtttgggcaattcaggcaaaagtctaatttaatggccttaagtttagtgtttccattcttcactttcacctgtgtaaacataattgttttgtttctttgccaataattttatggaaagctttttctaaagggtaaaaacaaaactaaaaaaaaaatcatgtacacataaaacataatttttatttaacatgtatttggcagtctgttttgtttgcaaatccaaaaaaggatagttccttttagggatttttttaatgtgttactccaacatgttttcactgctcctgagcagttacaaacacagcacagagctgggaagagcagctgggtctatctttggctttcatgcactaatgtggaaatggaactgtctttgggaagccttccttgttaattgctaagattggatgtacttttgcatccaaattcattttccctgatctagttatggaaaaaaatgtgctatcttgtactttaccaatggaaaatggtggaaagcatcatgtcttctgcccccaaatgtgtattttgaatttgataattacagcaatgctgacatagccaatacccagcctaagcagtttatagcaaagacaatgactcatgtacataggggattaaatctgcttctggaaactacataattatctagtcgtattcaaaaatgttatagtcagaaaagcacctaatgattcattggttctgttctctgccttctgcttgcttaaataactaaaatatattgagtaataaattaggagcagtaggttgtggtggttaattacatagactctagaacctgaatgcctgggttcaaatctaccacatacttaaatgcctatgaattatacttaatctgtgtgtgccacaggcttttcctttgtaaaatggtataatggggataaaaatagtatctgaattcctaggctagctataagaattaagtgtgaaatgattaggagggtaagtggctcttacaagtattagacttcttgttgttattatgttattggtactgatcttggtagtacgaaaacaaaaaggacaataatcaatacctcaagtaatgtgtttacagtatagttgaggagataactgcataaaggaacatttagcttatcatatgtgtttaaaaacattattagatttgatggtaaaataaccagtttagaatgccttcttattagacaaatatatactgtaaacattgtgtttaaattatgcttaaagtcataaaaaattagaattaaaagaaatcttacagatcagagtattcactgtattatttaaaatggggaaattgaggctcagatgttcagagaacagcccaggattacacggctatgcactgacatgacccaaagcatagtaagtctgatgttcattcctgagctttttccattggttcatgctggctttacaaactgagaacaaggaggtcagtgtggatcagagtagagctctggagtacttttacaattcagctgggtgagggaggaaaggcatttaggaagaaaatcataaagataggtatgctaccgtctcctctgttaaaaaaaaaattaggacatcatttgagggaagcagagacttttcatggagaatgagtggttacataagtttctacactcatgtaacaaatatttactaaacattttctctatagtaagcctactgtgttctgggcatataatataaattggggaacaaaaagctttctgaactatagagagcttaaactgttgtagaagtagcaaacatagcttataattgttatatataaataaagtatatagaaatgatatagaatgttagaagatgacaagtgaaaataccgtgaaaaagaaaggaggagaataagagggatttggagtgtaggtggagagggccctcaacagtgcaaaacacatcagcataaaccttataacaaaggtgataaacccatttcaaacagatgagggagttagttaagtagatatctgggggaaaaacattccaggcagagagaaaagccaaagctaaggcccaaggataggagcctgacttaagtgtttgaagtacagtaaagagtaaatgtttcctgaacaaaagtgaatgacgagagagtagtaacagaagaaacataatgcagtgaacagcgcatgtaaggctgagcacacaaaagtccaccttgaaaacgctgactttcactcttcatgaaactggaagcaactaaagttttgagcatagaagtgacataatctgtttcacattgtaaaaggtcattctgactctgtgctaaaaggtagattttcaaatccagtaatagaaacagagagttgctaaatccatttgagagctgattgtgtggtagtagaagaagagttgaagtgctgagaagtggttggatttggagtataagttgaaggcaatttcctgatggactggatatactgtctaggagctgtcaaggattgctctttcaagaaagtcaaggattgctcttccaagaaagtgcagtgtgaggaggtaaagaaattacatcaaggagaagatctgatactattaagatgcccgccctccccccacaaaaaaaaagaagaataattacccactagatgtaataacattcataatggcattgataagataaaacagtttctatgcattggtaaaggtgaaacctggataaagtggttttaattgaaaacgagaataagcaagatcagagtaattagagacagagtacaaccatctcatgtgagacgttgggcataaaagaaatgagtagcaggatgggaaatttaggatgattatttttcagttaaagagagtgtatgtttgacaatggaatgatccaataggttatacaaaattatggagtgcttttaatcttttctgaattgagtactgtttaaaggaagtatggatttttacctcaaatttaaaaacattttaaacttacttgtttatcataaacaattgtagacactgatagataatacttgctgacttttaaatcatcttccattttatatattaattttgtgcactctagtctctaaaaaatgacagtctgtcctatttctcaggaaaggcatggcagctgtcattaccacttctcacaaattgaaatgaaatgcacatagcacaccaaaatggagagttctgttttaaactgccaccccctaaaagatactgaactgaaatcagcaacttctaaaactatccttgtctccaagaaggtttcaaactactaatcattgaatgtttaaaatacttgaagtacaggtaaatatttctctgatatagtttctgatagaaaaaaaaaagaaacaaaaacatatagttagattatgtcttcgattcattatatattgttgtaattaataaggggcaagtcaggaaagtggaaatcacccagttatttcaacagagataatttaatagagagaaatggctaaaaagacatcggcagactgaaaaggctcaagaggaacactggagcaccacagctgtgaaggtctgaatgtttctccccaccactcccgctccctgccaaaagtcatgttgaaatcctaaccgcggaggtgagagtatttggagataagactttgcaaggtgattaggtatggaggacaaaaccctcatgagtgatgttagtgcccttataaaagagagctcagagagatcccttgagccttctgccatgtgaggacacagtgagaagacaggcatcaacgaggaagtggtccctcaccagacactgaacctgccagtgccttgatctggacttctcaaccttcctaactgtgagaaataagtatctgttgtttataagccacccactctatgctatcttgttatagtagcccaaacaaaccaagacagcaggtagcatagttactgaaggaacaaaggggaagagtttgaactattagaacatagacatttggaggaggccccctagagaaccggtacccagacttctgcatagctgatatgaatgttggcagggatgtaattaacagagtgcactatttacaattaaagatttaatgcccaatataaatggaagacgagccattggtaaagaatattcatagagacaatattgtacacaattaagcataatatatgacatgtattgtattttaccatgaataacatgttaatgcttctattggtgtattctacaatttgtatgggtgatagcacatagtatgtactatgtaaaactaagcctatgtagtagtagtatatatattagtggggaaaggtgcccctgagaagttgatgttgcccagcttgtgctaataccctaagaaattggaagagggaccctgaggagcttagatcagacctctgagtacaggtgcctgccatgtgtgctaatatatctcagagtgtgggaaaaatctggaaatggtaaccaaatgctactgataccatttagtaggtgcatggattaaaggaccatttttgtggcaacactggaaagaataggaaatgcaacaggaacaagtccctactttttcctcacgccttacagtcttcctccagtacttgtatcatagagtgtaatgcagagccagctggtaaaggagaaaggtagatttcggagcctcatacccagcatcacaaagcaaaatataagagaagtgatgaactgagagacaatggtttgttattcaactaaaattgtcatatatgtgtttggtccattgataggttaaaactctgttgaattgccacttttggtattacacaaattgatgacccaaaaaagattttaggatcatttgtgtgaattcagcacctaccgtatatgtgggaaatgtactgaataaacacagaaagatatgctttgttctcattctgacatttaaataaacctcacaaaggctttcctttgtttgccagagaaaaatcaatgcaaaattgtcaaatatattacaatggtctttgcccttctcttaggaattctcacctgacttctcttgcttttgctgcattgcataaaccctgcatatgcacactgtgccttaaaccattcaatgtgctgtcattgatgtcatctcatctgagtcttaaaagaattttgagaggcaatgagaaaaggtacagctcttctaagagggcaaacaaggatatgtcaaggactgtcaaggatatggtagagaagattttttatttgggacagatgacctttacagttcttccccaacattgagctttaataactggactgaccatgggtatgtcctcatcatattctgtaccaaaaatgaaagtaattatggcatcttcctagaggagattgttacttttaccttcacactagtatggttgcaagcatatgtcacctttgatatcacacaactctggtaccctatatagagaatcacaagaaaagaaaatacttgtgcttgtttacccccatatccacatttctgcttcattaaaaatccagaaaggtcagaaagcctaaactcacctggcttcactctccatttgtctccaggcatggctttttgatgccctgacagtagcccaagaaaacagaatattttcaagaaactcagcaggagtgaccttcagttgttgcctcattggcatatatttcttggtaaccagggaaagctctccatgacaccctccaggtccccaaaatatactgaatgcatgatgccagaaacattcacattagagcactatttctttctatggtgataatgggggttttgacctctgttgacatgcaaatatttctgaaagaagttccacatcttcttccctgagatccaattttgatgtgaatattgtataagaagtgatcaggaggaagaggctacttaaaagagaggcaaataagatagcctgaatggaaacaaatataactgtttttgcaaaggccagtgcctgcccataaatgtactttttcagaacaattgtcaagtttcttttcatccaccagggttgaggtgcttcctcaaagacactcttgtgtagtcaaggctcacctttatttcccttattgaactctgctcgtttcctttaacatctattttaatactgtgcaatggtattatatttttctgtgtttcctttttaactctagcactaatataaactttttgaaaattaggcttccacatccctcatttgtcattgttttgcaagatcctagcccagtgcctggcacagatatatgtgcttaatgcacttggctagatggatgaacaaatgaatgaataaatggtatgaataagtttcatatgctttttagtccacccagattccaatgtaccatatttatcagaaatgatataataaattattaaactttaattcaaaggtttatattcttattgatgtttttattatcagtaattcaattagtaggacatagtgggatattttattgatttttaagggatttaataatttcacattaaatcagcaataacaaaaacaatttatatgcttttcatgtccttaagaagtaataaaaacactcagctaaatgacaatttaataaggtgaagtttcatttgcaaatctctcgtttctttgagttcactctgacattgtcttctgtttccctgtttccccagtgacttcttatctttagtttaaaatggaaaagtgattaaacatgtcaaaacaaataactctacattttaggttttcaagtaaattaaaatttcatggacctcttaaaaacagacatatggaaatatctaataataactacatgaactgctaatggagtaagtttccaccaagcttaaaaaacacctttaatgtttttataaagccattttgaatgatagctgaaaaaaattaagttcaactcattcctaataatgctatttatgataatagttcttcagtgactttattctgcaccatggattacatgcacaaaaggaacacatatcgactgtatttgtgaaaaggaactacttttttcacactgctaagttaaatcccatcttattcagctgacctgcgattcagcacaattaacctgttcattagttgcaagtaaaatgggacatcaagtgatggtttaatgcaagcattaccacatctgaaaaataaatgtaggtgtttgtgtctcagagtgatttttcttcaatatcaaaaagcactggaaacgcctaaatctaaagcaaaacctgaatgatggagttttctgtctctatcattttcccttcctatatgtgccagaatgaattacgttcttgttgagcaactactagaggccatgcaccaagcaatacacttagaagataaggagaggaataaaacaggctccctgagcagaaagaatttattctctaaaggagaaaacagatctcaaacaaaaaattacaatacagtgtaataaaatccataaaactgatgtataaaagttgttttatgtataaaggaaagagtaacttgcttccctgaggattcagtggttatttgacagaggaagtaacatttgatctgagacataagggaaaggtcagggttcttgatttgggcaagaggatgagtcagtctaaacaggcaaagggaacagcattgacaaggtatgaaactgcacaacatcttcgggcaattttagaggtttctgaagcatgtgggccataaggaaaaagagcagaaagggcttacatgaattcaaattgggaagtcatgtgtatcttttaggggattcagattttattctatcgagatctattagaagtatataggtaagagaatcatatgatcgaatttgcatttcagaaatacgattattctggcattcttaacttttatgtttttaatttttaaaagataatatgcattattaacatatctacacctgagattagagttgaactaaaataaaattaggtgaatcatgtatttggaaagtcagatatacctatttatctttgatgttcagatattgtttgatttggatgcaatcttttaagaaataactttttaaaacatataaccaactctattcatttttaaacacagattaaatgcatcagtcttcatattaatattttaaatatgcggaacaaggtaaagtagtctcatctcgttttagtcaaccatatgttctgaaggccagaatcactgcatggtctacaaataatttttccatacttatgaattctcttatgtaatatgacttacccaggtgtacaaataaattccaattaatgatgtatctaatagactgtcatcattttgagtcatctaaccctatggtcacgcctaccaactcacaatatgtgaggagggcatatcactgcctccgaaactgataaatcttcaaataaagtgcagaaaccttaattaagaaattggtatatctattacttctctatgaatcatacttttttatatgatatgaatcaaagtttttttttggtacaaaagttgcaaaacagaagtgacataaattatccaatggttttggttacctggttgagaaaatataattggtaagaacctagaaacataaaaggtttgcttggataagtttaatattatttttaactatgcagccactgaaccactgtgactgacaaattggtttgtcaatatcacaagcaattgcaaagcgagatagctgttttcttaaatgctatcataaaactaggaagtgtttccaggataatttcagttgatgtaaaaataaatattcaatatacagaaccatacgtgatgttagtggatgcttatcaattattatatccaggccatttatttcatttatgttcatattctcaggaaccaaatttgtttatcaaattatggaaatatggaataaaatgccccagttaacctctggctcagaggataataatgttgctgggagtttataattgcagaagttttatccagattacaaaccagattgctaggtgcctctgtcactgtcaagattttattttttattattataggtttattttaattacaaccccctccttttattaattaagcatatgtttattaaacactagcagctttattgcatacaatatgcccattataggaaatttagatatttcaaaccctaatagagttcagcatttaataaacaagatataaaattgtaatatgatgtgttaagtactgtctgcatatgtatgcatttagaggcaactaaatcttaaaggggagattgtttacttatttttattgttgttgaggatgtaatatttaagctaaaatatgcagaggcataaaggaattaaagatgaaaagtaatgccatcaatagacacagaatgctcaaatgcacagagataatttcatactcagaagcctaagagaagaaagaagcaatgaatctgctgagtaactagagaggctgatcctaaagactttttcttgcttactaaataaatttggattatttcctaaaagtactgggaaactattgaaatattttggaaataacttagatttttagctgcgacattagacatggccagaaagggacattcaagagacagtgaacaggtaagtgtgaaagaacgtagtgaccagttgcaaggggtgggtaagcaagtaaagaggagataatgaggtctccctagtttaagacttgggtaacttggtaagtgatgttgatgataatattagagatacaaagtatagaaaaagaaatctctatggggatgatgaattctgcttaagacatgcaatatatgaagtaccagttgcatagcgcaactcagatttgctataaccataatttggagaatgtgggataaggataagtgagcctcctcctgtgaggctgttttatatcctgggtactgttgttcagctggcctatcttttgagcacatatgtgtatattaacatatagatatgtttatgtgtaattaaggaatatgtatctgtttataactatatacttggagccaagtatactggctggcactcagcaggaactcaataccaatatgctgaatgtatgtggggatccacccagtggttttccctaagaaggattttgctgactgtcttggtacaagttctcttgctttgattccaacttaaaagaaaagagctgactcatcattcagtattctctctctcatagggtacgctggcatcttcactgaagtatctgctaatctctttactagaacctctgttcacagtttgaagaggttaattttgcttcactcaaaattgaaatattttcctgtgaatctatccattctagcatgtcctttcttacctgtgatggtatagattttatcccaggagaaccttacaagtttatgtgatgagcattcattccaggaactctaatgctgtttccatttttatgaccaatatgctttgacctcctttctgttccagaacaaaaggagagcacagaaagggtggatattttatcataatacttcttcaaggccttgaaattgcatattgcctcctatatgctaccaaggcctatgctatgaatggaatctttactcttaaacagatcaacaacaaaaaccatacccagtgtcttgtacccttaaggcaaaaggcatcctgggcaatccctcaactcactttttgcacactcacaaatattctatctctcagtactaaagatttatcaatattcaactctgggacatgtgggaacacccatttatagatggtctactaaatggtccaccagtattcttatttagcttagtgtttatgtgactccatatatcactgcttaaaatttaatctttaggttatctgcagagcacatttagtaaaagaaaaatagcaatttgtcttttaactattattatgaataatgttgtacagtacaaaattaaaaaaagactgttttcataagctaatagttgttcttccctctgatctgttaataattagtcaatccatcattaatggcaaaggcaattcagcattcctccatgtgttgcacatgggtgtagacaggtattaacttagaaattgaaaatgtcttctgtggatctaattatgctgaaaatatttgtttataatagtccttttacacagtatttactgcccactttattttctttgttcccacccagaaatcaaaccacagaatttaggttggatagcatgttaggtttgggagctgttgtagtagttaaccagcaccctcaaagcattactcagtttcagcacatctagaagcataagcatcggtaattttggctaatgtatgtcagctgaactaagtaagcataaaaacatgtctgacatttaggaaaagaagagccacccactctcttacttaagtatatatattaataatgtttctcagcaatcatgttacacatgcacagtgacttctagcaatggagctttgcttctcgctcttgggttttcacgtcggctggggttgtgttcatgtctgctccatgtgcacttcatcctggaccagcagcttctccaggagtgctcttctcgtggcgatgataaacatgcagtgccctaggccaaatctcacaagtgtgagcctctgtcatgaaaactaggaaagggtgaaggaaagccagggaaatgaaattcaggctgtagaagcatcacatcccaggctgttatatctgcaagaacacagaaagttaaggagagtctcagtgtagttgatggtggcaagaaccagaagacagaggacaatgagtctcatgtcagaaaactcagaaaggaatggatggctaggctgtgcataaaagaagaacaacaacaatatcttaactgttatctccttaaaaggtctgaaaaattggaaaccagtctattaaacagaaataaataataacacagcaccaattactagtaacttaaaagatgtggcatatctttttagtatgctatttttaattgtttcagtgaatttaaaatatttataactactttaatgagttttattattcttttcttcaagttacttacccaatttctccttctaaatggttccttaatctcctatctcctatggtttgggaacaactacaaccttaggaaatcctctttattattctgacataaaattctttaggtcttattttgccatgcaatttttatatggctatcttattattccaattaaaatttaactttaagtcaggcaatgtgtgacatcctctatggtatctagaagagagctcacaagttaggtgtgaagaaatttctataaataagtatgtaccatatcaatgaaattcatgagttctgggatttgtaaattggacatctcaaatggaagaacagagtagatggctcacacccccttttcccattttctacattttctgtttttgaacaaaatcatcttagtttttcccagcatcagacattcacttgtataagattgaatttacaaaaaaatgagattcattcgaaaactcaggataaagcaaaattcaaggagaaaatgaaaatctgttctaccataaatccctccacaactagagagatacatattgacttttttggtagcagagacttacgtgacaggtgtttatgcctgaactgttccacagataaatggaagactttattctcaagtgatcctggcatactcatgtggaaaaagcaaaaacataattgaaagaacgttatttcattctcctattttggtaagttaagaaacaaagggaactgtttgtaactatttcttatattttgaaagccaggtgtgacagttgacattatttactaggactgagtttataaagcagacccaatagaggctgcttattcattgtgagacatcatgcctgcagctgcctccaggtaaatggtgacttgtcttacaatgcataaaccaagtagttaggctctgcgccaagcaggacttgaaaagacttatagaaagcacatggttcccattcagatgtgcttttattttttaaaaagtactaaaataattattgcatttattctttttatgttttatttttaattgacacataacaattgtacatatttatggagtacactgtgaaccataagagatagttaacataaggaggaatacatttaaataaatgcaatatttaggtctcatggatttttagaattgtaagcgaaatttaaggttgcttaggtaacactcttcattttaaatattagactgtggaagtcaagagggattaagaggttagtttttctcagtttaaactttattcccttccccttgttgcagattctaaatatgcgcttttcaaattgaggggcgaccacatcaactggctacaattgtcccctctgtgatttttgttgtgttttaatgctccaggctggatctcttctgctactttaaagatttcaaatgagacccaatgcttgagaagaaaatttgatgttttagaaatcattttcatttcttttgatgggaaaataatttctttatacacttaatttcattacctgaaacacttgtcaaagaatgactgaatcttataagacaattacttgacttagttgtttcaaggaaatctattgagttggaatatcaatctacatattatttgaaagcttgaacaagagatcctgatatagatccctatttaaaaagtactggttaagtccaacatccttttatcaaaacagtgggatttaaaatccaaagtattttttgatttttttttctttatggccattcttgcaggagtaagggggtattgcattgtggttttgatttgtacttccctgatcattagtgacattgagcattttttcacatatttgttggccatttgtatattttcttttgagaattgtctcttcatgtccttattctactttttgatgggattgttggtttttttttctggctaatttgtttgacttccttgtaaagtctggatattagtcctttgtcagatgtatagattgtgaagattttctcccagtctgtgggttgtctgtttactctgctgactgttccctttgctgtgcagataagtcccatctatttatctttgtttctgttgcatttgcttttgggttcttggccatgaaatctgtgcctaagccaatgtctggaagggtttttctgatgttatcttatagaatttttatagttgcaggttttagatttaagtccttgatccatcttggatcgatttttgtataaggttcagtttcattcttctgtatgtggcttgccagttatccagcaccatttgttgaatagggtgtcctttcccaacttgatgtttttgtttgctttgttgaagatcagttggctttaagcatttgggtttatttctgagttctctgttttgttccactggtctgcatgcctattttataccagtaccatgctgtttaaaaaaatccaaaaataatagatgttgacatggatgtggtgaaaagggaacgcttctacactgctggtgggaatgtaaactagtacaaccactatggaaaacagtgtggagattctttaaagaactaaaagtagaactaccctttgatccagcagtcctactactgggtatctacccagaggaaaagaagtcattacatgaaaaagatacttggacacaaaagtttatagcaacaaaattcacagttgcaaaaatatggaaccagcccaaatgaccatcaatcaatgagtgtgtaaagaaattatgagatagatagatagatagataggtatggaatatacactcaaccatgaaaaggaattaattaatggcactcacagctatctgaatggaactggagactattattctaagtgaagtatacaaggaatggaaaaccaaacatcatatgttctcactcataagttggagctaagctatgaggatacaaaggcataagaatgatacaatggactttggggactccggaggaaggatgggaggcgggtgagggatcaaagactacaaattgagttcagtgtataccgctcgggtgatgggtgcaccaaaatctcacaaatcaccacgaaagaacttactcatgtaccaaataccagctgttccccaaaaacctgtggaaataaaaaatgttaagtttcttgtgcgtccgtgtgaagagaccaccaaacaggctttgtgtgagcaataaagctgtttatttcacctgggtgcaggcgggctgagtctgaaaagagagttagtgaagggagataggggtggggccattttataggatttgggtaggtaaaggaaaattacagtcaaaggggggtttctctggtgggcagagtgggggtcacaaggtactcagtaggggagcttttgagccaggatgagccagaagtaggaatttcacaagacaatgtcatcaattaagacaggaacggccatctggatgtgtacatgcaggtcacaggggatatgatggcttagcttgggctcagaggcctgacattaagataataaaataaaacaaaatctgaaagtaaaattgtttgcccagtttttaaacaaacccagtagtagttttgttatatctagaattaccccatcactgtaaggctgctttgtttttttaatctcttttcctctgaacaaccctgacaaaaatcggatggaaactgacattttcctttctcaaccatgctcatccatgcagctttgacatctacatgaatggttaatatcattgattcttgttattcctgtatctattatgctctcacatgcaaggatcttcatgttctttgccaggattcccagaaagatgctccctttaatattaactggtcaattttgataatggagttgatttttctttaacgtttataatcactgtaaacttcttgacaagatggtgctattataacactgactgtttctgccgaaagaagaatgttcagtactaagacatttctgccaaacgttactacaactttgaaaagcccttcctctggcttgctaggaagctcattggagaccctaacttggagtttgttgccatgcctgcccctgccccactggaggttgccatggacccagctttgacagagcattataagcatgacttagaggttcttcagacaactgctctcccagatgacgatgatgacctgtgagaatgaagctggagcccagcatcagaagtctagttttatatgcagctgtcctgtgatatcagcggagcagggtatgggccaccttattattatctagctaggtggggcatgtggttcatctgtgggatgctgaaggagatgagtgggcttcggagtgaatgtggcagtttgaaaaataccttcattgtttggacctgcatattgagctgttttggaatgcagttgattccttcttgagtttcaaatgtaagactgctgcaatcacattagtgaattcaggggtgagatcttgttactgccatttctactccttttcatttagaatcagaataaagttgtatttcaaatatctttttaaaaatatatttacattatatgtgtatatatacatatatgtatatagtatatgtataaatttacatgcatatatatacatatatgtatatgtgtgtttacatatgtatatataaaatgtatataaacatatatatatttatacatatatatgacacatatatgtataaatatatctatgacattagacataatgtatttctatatctaatgtcatgcatatatttatacatataatagatatataaatacatatatattaatgtctacatttgacattacatatgcatgtcacttgaaaatttgtgtatataaaatatatgtataaaactcaattcaaagatatgtttccagtgatgggtcttgtcaatgtagacatttaaaatgatatttgggaattactgatgttattttaagagcttggtatgtcagagattttcaaatggaagcagttgctatagtaaatatggattttctcctaattaattcagacattaaaaagttactaattgcctacttttttcctaaattgcttctggaatataaatatttataatcttcataatattcccatctgataaaggttaggtttgatttcactttctttctaaaacatctgagcattttcaggctctaactccaaaagaacaaaactcgtgaagatttaaaatattttaatagattatattggaattccatttccattatattgaagttactttttccattgctatcatattaggaaaattaaatttatacatgttctatacttaaagttaagttttagaagtatcttttccctaattgttattgagaaattaattttaatacacttttcatctttccaacagactactgcaaacaaataataagctagaagtttagtttattccctttcctaaagctcttctataaatattgactccagcaatggaaaaagcaaaagtatagtcagcattctgtatcatatatgacatatagaatatagaataggctataccatcaataagataaatcagtgcctttataagaccaaatgagtatatcaatctcagattaaacaatgcaaagcacttcgttcaagtggcattttcaccctttcaaataactccactaaatatataatactcatgaacactaataaaataaaaatatatgtgttactcttctgtatatatctgtaaattgggctccaaacactacattttccatttatctatacgactctaatgaaagcatcttggcttaagaaaactaatagatctgaggtggtaaagtctttattattgaatcacagaactttgcctaaatgcgaagttctagcttcaagttaaaaaaatttataaatatttcaacatttaatttagatacagcaggtacaagcacaggtttgttaaatggaaatattgcatgatgctgaggattgcagtatggatcctgtcacctaggtagtgagcattgtacccaataggtagtttttcaatcaacgccctccctctttcccctctctagtactctgcagtgtctactgttcccatgtttatatgttcatgtgtgtccaatgtttagctcttacttataagtgagaacacgcggtatttggttttcttttcctgtgttaattttcttaggataatggcctccagctccatccatatttctgtaaaggacacaatttcattaaggaaggagggaaggaaggaaggaaggaaagaaggaagggagggagggagggagggaaatctagaggaatggataaattcttggaagcccacaatctgccaagactgaaccaggaagaaattcaaaccctggatagaccaatatcaacttctaaaactgaatcagtaataaagtttgggtctttcttaaaatttctattttgcctttcagctcttaaatgatattactggattgcttggtttccttgaattgaatttcaacgtttccctggatcttgatgtgctttcttgctctccagattctgaatttcatctgtctgtcattttattaatagttatttaagattgcttaagaaccattgctgaggaggtagtgggctcgtttgggggtaaggaggcactctggcttcttgaatttccagagttcctgtgctgattctttctcatcttggtgggtctctggtcctttaactgtggcagaaattgagtatagtcagttgacttcatttctggacattttcagaaggccacacaagactctgtgcaggggtttttgtttgctgttgaattcttgtccttggcttccaaggcgggtgaatggttttgtggtggtgtagtttggggtgcaatccgtagatggtgctttagagctatgggtggtagatggatactcagcgctggggactgtgtatcctcgcgtgtgcagctgtgctctgaagtgtgagggggagaggggtaaccccctcaccagttccactaataggccttcggaagccactgctgatcaccggcactgtgccgtggctttgtttgtttgtttgtttgtttgatgtttctggctgtgggcttccctggggcaggtgttgggcagggggatagaccacgcccttactgggccagctctgtggaaggaggcattccaggtgccacaccagcctgtgaacctgtgcatctcacccttctgagtgtgggctcctctcctactcaagttccgagcacaggtaccagctcagcactcctgagccataggatccaaccctgcagtgccagaacctgctcacggctccctcctctggactgggttgggttgggttctgggtgtgctggggatctaaggggccgcaggctgccagaacacactccagtggaacacagcacccaggctgggcagcagacgcttcactgtgcatgtgctgctgcggggcagccaggcaggagccctgggaggggctgacaggcaggcggggctgcgggacagatgtgcctcagtgccgtggggaagctcgccctgctttctcccagtccaggagttttctggggccagggcctctcagagggagatggagagccctgagagacgggtgcctatagctgggctctgtcagatctgttccacacacaaatgtccccagctccatgtctgctgaatccccgcctctatcaaatctcccaggagatgcccctgccagctcaaacatccattggggttttggggttccctgcagctaggatcccagaagtctgcatgagcgtgggctgtcccccaggctcttcactcaccccttcctcaggagccatttgaggcccggaatcagctttagcattcaggcacctcccacagggcttccagcctcctcttgcttcagccttagcatctgcgtgttttcttcatccacattcggtattttctctctgaagatctttttaaattacagtggtttagaggtggtagcggcccttcctggctgcctctagttggccatcttaaaactcctctcctgaaaagaaaatgttatggaaacatgaggagaacaaatgcctgcaaggaaatcaaaacagtgctgtgacaccattcagtgtcagctacacaaaagaccaaaaagtgaagctacctgtaatagactagaatctgttggttaaccaaatggtacagaggtcagtttacttactcctaactggtaaattcagtttataggtacagtgtttcagtgggacttaaatcatgtagttggttcagctttgttatgaggatcgtgaaatacctctgtaataatttcatttctgccttctccaaatatacatgtggtatatgtcatgtaaattaccttatatatttaagaaaccaaataagaagtttcgagcttggaataattcatgtgagctaactagtttctgattaaaatagcatcaggaaactgagtcaggcattttttttttcatttgccattccctgtaaattgggtattacatcgtgatcatgaaacttaccagtgaaatatgttctatgaaaaaaacgagaatacctgcaattaaataactcaaaatgccattcatttaaaacacatttattatatgcccagaattttcaagatactatgcaagacactgtcgggaatacagagatgattaacatgatgtttctgccctctctggatatgatcttcactaatactggttcattgtaatttccacttttattacctttcttaatgatgatattctcagtcggtgattttgaagataagcagatttctcgatgactatttaatgcataccaataatagctttatttttgttatgtctgggtaaagaaacaaaggtttatttcttttccttgacatttatagcatcctatgtatctgtgttccatgaaaggttacctaaatcacatttattccaaatgggcaatatttaactttaaaaatgtcaaaggaagggtacaattctctgtagggcaatattgaattggttgactgaatgataattatggaataatgcattatgcattctcttttcatttcaaatattgattaatattattgattctaaaactcatttaatctgttattcagtagaatcattgccatatactcacttaccttttaattttgatgttgataattaattgaatcaaatattttttcagagtcatttgtaacttcatggttataatttctcaattcatgttaatgtaagctttgtaagatatgccattgttcaggtaattatgtataattaggcacaaagagaaaatagttacctacctttaaaaaaaagccatcaagatttttcagttgaaaaattgagctaaaaacagaattagaaagatttcttggagctaaactcaaggatctaaaatgaaggatgagctcaggacattttgtaatttaatattggactcatatgcacgagttccttgcaggagctactcccactcctagtcttgactacaagggcaggtgagataatatctgcattgtttggtatatttaaaccctgcttctttaagtgttatcatttaccacaaaatatcgtaatataactgtcacagaaagacaaatcaagaagaaaggaaagaagaaagaatacatattgattgtcagcattaacacacaggctataatttgatgtaatattcaactctatactttatggcaaccaagatacacaagaaaacacaacatttacatagatcttctcaaaaagaaagaaccatacctgaagaaataaatgtgtcttgatggtattaaagtctgcactttctcacttgagtcctaaaacagggaaatgagcattattcccaacaactataataacatatttaaaaatggatttcttaaatctgatgacaaatgtttagaactaccatttacataagccaagtcctactttttttttttaacaaatcctttctcctgtctcctccagatgccattgccattttaaatttcctgactgacaatctcccaacttcccaaaaagtgtttatgaagtacctaagaaacaatttgaaacttataatgagatccagaactagtactgactttgaatccattgtatggagggaatgttattacctataaagcagatgagattagatttataaaaacaaatggggatcatcaggatgttgctaccagaaagagacccagctggcatagacacctgttagtaaaaggaaaaacattttgtgtatttcgtctactgacccccacttcagaaatgctcgatctgtataaaccgtacaactagacaggcattcacctggtggatgctgatattctgaagtagccagagtgatttctccaccctaaataaaactttcttccgaatttcattcagagatgacaaaaatgaggaagtgaagtgggatggggacatcacaagtgggacattgcatcccgggaagcaaggggactctgcacacgttgctgctaactgcagcggcacctgaggtggttctgaccgctgtaaactctgtcacagaattggggagtgagtatacatggagaaaatttgttttgagtacaatttcataaccagaaaatgatacagaatcatgtaaaacaccctataattcaagggcatcaatagcaagcatagggaactgattatgcctaaaacagaggcaggtcctctatattcctccctctgaatcatgtatgtcctcaaaaatgtcccatcagcacaaaaaaaccagcaaaccacagtccatcctgatagcctcctttttcatattaatagcagcattatactgtagtttttctgtctcaaaaactgaattttttaaaactttcattttcttccctatatctgattacttgtcacctccctcccaaactcccttacatatgtaattgtcttttcccatggtcaccatatccaagttctgattaccttttaataaaatgaatgaattagcttcaacaatgcaatttcttatccaggtatccattctttcaatccttcctaattttgacatacctgtagtagtttcaaagcacagatcacatcgtgacactcctgcttatcattttcaatactactccattgcaaatattaagaaagcaaaactgagagccagacaacacccaacagatattgtctctcaatccttacattcccatgaagaaaggatatatgtaataagagagaaaggaaccgtgacttagaaactctataaaatataatccacatagattatacatatgcttatggtgatattactatactgactttacggtgctttctagaatttagactctgggccattttggcaaaataaggagcctgcagactgcttatgcctttgaagagaaaaaagaatgtgaaagatgttatttttgtgatacatcaagagagaatatgataattaatattgtatttttattcatgatggaaataaaaataggcaaacactatatatgctgtaaacctttggagtactcctttgtcgcactgggaacatggtaaaatatataattttttcatagatagatcgcactataagagacaataataatggaaactgtcatagttccctgaaattcaagttgaaatactatttacatcaaccataccgccgactccatcataatgaggaaacatctcagggattattaatggggtaaatttcactatatagagaaaaaagacagataaaaacatgtatatgcccaaacttcatttgaaaggagggcatgtagggaaaggtagattaacagctgaacttcattagccatttacagaaaagttaaatattatatctaggatacatttgtcttaaatcacccaggattaaatcttccaagattaaggatttcatctaatcaatttcacctaattgaaatatgcagcccttctgctctttttttgtaactcctatattccctcctatcctttaaattatttttcatttaaaccattcagcagtttaaaccattctagactactctggcctgaagtacttcatcagaaatctttacactttagcttaaatattcatttaataatgaacaattcatcttctattaaatgctactactcaatttttgtttcaaactatatgtacatttcttgttaggcataattttatatatttattaattggtttcccttccaagacacagaacctgcccttccctcccagtgaaaccactatgaggtgaaaaatagtgttgaagaaggaagagggacacagagaaagaaataacttcacacatctatttaaagatggccctgaggtccacccacagcatcgcagggatgagttcatgagggagtatgcagccacaatacctcttaactccccatgacttccttgagcttccttgtgtgggagtagaaggttgatggaatggttagcctttcctggtatctgtgttcatcatggttctcagcagatccagctgcataaaatgtctctatctgttaggatcaataaaacaagctctctaactgctctataatcagcatcaatttgcgaacctttatcaaacttcccccctcttttcaccaagtattcaggatgacatgatgaacaactggaccaatgattggtcaaacatatcctaatatcaaatactggcagttacctggagtaaagaaggacattttgtgtgtccctactttaaacgagatccttaaagctttttgtatggctggtctgagtatttaacagaagtcccgtactcataaggatggctagacctgaaaggagcctctcacctgcagggtaatgattcggtttaatgaggaccttttggaagttacttggctctaaggccagaaagcctaactgagatcaagacataattgaataggaattgaagatccatttacctcatcagttggaaaataagcatttttcaaaatagagagataattaaatgtggtcccttcagtgctacggattaagttagtattatagttttaatatacatttcaaacagtttccctcttattctgtcataggacattgcaattaatttaatcaacctttaaacagacatttaccaagaatttatgataatttagatattgtgcagatggatgttcaatgactttttcttcttaagtcaaaatatttaaattcttcaaaatagaaaatgtgtaatatgtgctgcatattatatgcctttttcctctttcccagaatgccttttactagttttgtgaaataaacaagatagattatatcttatatacatatgtataatatacttacatacacacgtataatataatatttataatataatagaattatattctgtattttatataatatataatagaattatatattatatataatagaattatatattatatataatagaattataattataatatataattataattatatagaattatatataattataattatatattataatatataatagatatagaataattataatatataattatatattataatatataatagatattatagaataattataatatataattatatattataataattataatatataattttaataatataatatataatagaattataattctaaatataattataattctatatataaaattatagatataattctatatctataattatatataattctatatagaattatataatatataatagaattatattctgtataatacatacacacgtataatataatagaatcatattctgtcatcttttcacttcagtctatctctttctgtgtcattttactcctttacaaagaccatatcttctttaatcctgctgagggaagcaacttaaaaataactttgatatggtttggctctgtgtcttcacccaaatctcaccttgaattgtaataatctccacatgttaaaggtggaaccaggtggagttaattaaatgatgggagcggtttcccccatgctggtttcctgatagtaagttctcacgagagctgatggttttgtaaggggcttcccctctttgattggcactcatttctctctcttgctgccctgtgaagaggtgccttccgccgtgattctaagttttctgaggcctccccagccatgcagaactgtgagtccattaaacctcttttctttataaattacccgttctcaggtattgcttcatagcagcatgagaacatactaatatgtacttctagcttctgtagtcaatgatttctggatacatactcttcttctaacactttaagataatattcctttctcttcatttaaaaatatgtaggcaacttcatattcttctcttcaaaccaaaatataggggaaactgcatagacttggtgtttgttggtaggatggattgctttctgcttgcagtatgtgaagcccattcagggttgagggagatccagtttcagcacatgggtaggctaattcacgtaactcttacttcaatttctaatatccaaaagcaattatgtagcacaaccctaaatgggtaactgaggtgggatttttttgcttctgctcatatccaccatacttataaaaattgaaaataccttacgtctaggctgtatgatcctgatcacccacctgactataatacttacatgcagagaatccactaatttctagcttacccctcaactctatctgtggaaggcagaataatgccccatccgcccccccaccacgaagatatccatgtcctaactccaagaacctgtgaatgtgttgccttacatggcaaaagggactttgcagatatgcttaagattacagaccttgagatggagagattattgggtttatccaggtgggctgagtgtcatcacatgagtccttcaaaacggagactgtttattatctgtggtcagaaaatgataggtcaaaggaaggaggcagaagaaatctgaagtgtgagaaggactcagtctgttactgctggtttgaagacagaaaatggtggccaagagctaaggaacgtggaccccatttagaaggtggaaaaggcaaggaaacagtttcttacctagagcctccagaaaggaatgtagtcctgccaacactgggttttagtccagtctgacttttgctggacctctgacctacaaatgtgcaagataatgaatgtgtgttgttttaagccactaattttgtagtagtataacattctggagtttaagagtctgaatggatacttaaagatagaaagaaatgatacaacatcactctgcccctcttacccaaatactgtctatgccctaggaatggctaccctgattttctcattagtgcagtgtccgggtctctgaaacatggaggagaaaataatgcaagaataaagtgcctttgaccatatttaagctaagagaactgctctgttttatgacaaagtagaggaatttttaatttcttgatgtaggttatgttcgacctttagtttgaaaaaacaaaaaccgttgattaaggcagtagttattatttttaaattttttagtcactgtttgttagcatattccatctgttttggcaagttcattgtggaaagatgactctgttaggattaaggactccagataaagcaggggtctttcattttcatcagaagactgatcagggtgctggagttcaggggctagctgagcactcatcccaactgcagtgctgtggccttgtgattgtcatctaacctttctgagactccatatccttactttttaactaagcatactctgttaagtgccgtcttaagagtcttctagatttctatgcctgtaattccaataaattcattaattctttcaacaattatatagtgaacaattatatatcaaacttggaataacagcaaaaggttcttcaattttaagaaacaaaatattaagactagaagcttagttggatattgtggtatatgcgataaagaaaagtaaagaggatgttatgttcaagattattgaaagtggttagggaagtcctctctgaggagacaatattataatgaaacaagcctacagaattagaagctcccagtcttgcaaatattggaggaagaaaactccagacaaagaggaggctaaacacaaaggttttgaaataagattatctaccagattctaggaacaaatggttgacctgtacacccaggcttggcatgtgagtgagaataatattattataaacttagagtgaaaccagttgacccattttgttatcttttacagataaaattcaccaaaagggtaggtaattagtcttatcaaaatcggttttatttacaaatatgaaggatggaagagtgggcacaggagatgagagcctatattaagtagttggtaactcagtaaacaatggagtctaggccagacaaggagggagagaaatataggaaaactccagtggttttgggaaagaggatagattcaaaacaaaaactttaaagggttacaatgatagttatatgggtactagagtaagtgatcttgaggacaagaggcatttttgagaagaaaatgtttgaaatgaagatgcaagatgtgcccctgccccaggttgtgacaaaagtgaattgagtccataggaacaggtgtcagggatagaggatgcggttgtttgagggagggtatcaggacctgagaagccaaacttgatgagtcattttacgaagggtgacctgttaaagaatacccaggaacaggcctggagtagtcctgaaagagggaggcaggtgccatggactaagggaccaggaaggtgcacacaatctcacaagactccagctgccatcacccatgttcatttccttgaagaaatcatcttattccttaatttttccccaatatatagtttgagactttctgattctctttctataaatacaaagccctagagatttttattatctggtgatccaaccctttttggagtgactaatcaaaaaagcacatgacagtatgcatattttataattttggaaattactcttcctatttacatatactttggagtatatcacaactccaatttagtacattttgttattagataccagaaaatcatgagttcatactacagtccctctgctgccccatttccaacttaaaatagaattaccaacttaaaataggagaaacaagcttaaaatagaagaaacaagccatcacttaagtagatatagaaatatagttgataaaatttaacacctgtaccagataaaaatttagtaaactagaaatagagctttaccttagtaagagcagccattaaaaaaatgcatagtaaatgccattgtatatattaataatttcatttaaaattaaatatgtgacaggaatgcctactgaagttaccttcattcaatttttaactagagatccaagccagcatacttgtacgctgtactgattgaaatgacaatcaaattagtggaataaaaatgggaaaaaagaaaatgaactgtcattatttgctgatcataaaattatttacataggaagctactaaagaatacagagaaaacattataaaatagcaatggatcagcaaaatggttaatataaaattaatatatagtagccaattgcatttctataacaaacacctagaacacaaaattaaaaataaattatagcttaaaatatgtcagtaactattttcaaaatattttgaaaaggaaatggcagggaatatttcacaggtgggaatagtatatgcatgggacaatgagggcacaatttgaagtaagtcactataagccaagaagcttcatgataaagctgactttaggaaggttaacctggaagcaaagtaaaatagtttgagctggggggacagcaggtggcccagagagaccagaagccggagatccgggaaaacacatctccaaagggcacagaggcagagtgaatggactgaacaggagagaattagacctcacacctttcttgaggaaggtggatctcagtgcatattttaaagattagaattcacatagatatattattttactagaaaacattttctcatgtctaaaactttttaaagcaaaattacttaaaatctttggtaagttttaaaagtttagataatgtaaatgtttatatacttttgaaaagtaaactaagtattacctttaatatttgtaaactttcataacctatcactgatatttactaaagaagagagtttaacaacactgagaaatattccaacagaaaggtgaactgttttgtttttaagcaggtgaagtacaagaagtttgatggaggccattttacttaattaaaaacttcatcaaaatgctgttttcactatctgagttgtcagaatttctacaaggctttttcatattcagtcctttcaaaaatataaaatacttgaaggcagttctttatagaagaatttaaagttacatgtcaaatgtagctcttctttttttaattactgaagccatatatggtcaagagtaacttcaggctggccgcagtggctcacgcctgtagttccagcactttgggaggccgaggtgggtggatcactaggtcagtagttcgagaccagcctgaccaacatggtgaaaccccgtccatactaaaaatacaaaaattagctgggcatggtggcatgcacctgtaatcccagctactcaggaggctgaggcaggagaattgcttgaatccaggaggcagatgatctcagtggcctgagatcgtgccactgcaccccagcctgggcaagagagtgagactccatctcaaaaaaaaaaaaaaaaaaaaagaaagtaacttccacattaaacaagagaaataaaaacaaaagcaaagttctttgtctaagcaaagcctgttaactctaattaaccagctttgcacagctgtgatagtacagcccattaattattaataagaaaataatcaatattaacctcctcttttttattggtaaatgttttttggggtctttgtgttaatttgttattttttaaattactgttttaataaatttcattatagatgctggagtaattacattacctaaaaataagatatagtcatgtagcacattactttgaagagaaaaataatatttgtaactttattaaccctatactaagcacattagtttcatttttgaaccttgaaccttggtatttgatttgcagtcctttccaaatatttaaatttccatatttactctctattctttactaaactctactcattgccttagattgaaacctaagtatctttttaaaaaaaaacccttttatgtggctatagaacagaattaggaagtttgctaatcttgaaccttgctttcttaaatggtatttttgttcattctcttcctaaactttatttttttattatttctctgctttacaatttaataagccattttactggagcttcatactctactttctatatcatataatgggaatagttttaatgcttgtgaagacagcatgtattcagtacacaaagatgaaaataatttaatcatcttcatacttattagaaatacttatattattcagtcagtaactgtgactattgaacttatctcccaaggatattataaaaataaatgtgataagagctaaagaaatttttaaagtcatcaatgattcattttaatctaatttcatcactggaatttcttgaatgttgtaagagtttatgttagtgtgtcatctaatcatagttactctaactggctagcagcttagaacaagcttgaataaggttcaaactaacagtggatgactgccaatggttagaaaaaaaaaaaggaaacattaagctacttctaatctaaattaaaatacaaaaaaatcattaaaatctacttttattttatgtcaaaattgtatctcagatactctgatttttaagtcatcaatactgttttgaaaactggacagaaatagtcactggctaacagctaaataaagagattaatcataaataagcactatctttaagcagctcacagtctactaaagcctaattaagatttataattagaaagttaaattatacagcaaatctcagacttggaggagtcctttacaccatctcgtccaaccactccatgacacagatggccaatctgtacttcattctcgttagttgccttttcagcatgccagagctattcattgacatattcagccactttgttaaataagtgtgtgtgtgtgtgtgtttttccttacaagttgagtgaaaaattaaaatgtaacaaaatagtgtgaaagcactaatcccctattccctattttcttagtctgaagcttggtgcaaaggcatcaatatcacgggcttgggattggtcacagttgagttctgtgacccttctctgtcacagactgactctggggatagtctccatggtctcagaatggagattactacctgagctgcaggaggggaatgctacctctgcctgctaaaattgttgccacctcctattgtggctgaaacatggtacttgcccagtaaagtggtgcctactatagtttttatttctgtatcaagctaaacacaaagtaaataatctggcagtagtgatcagtgatgcattgtatttactatacattaagaagaatttgtaggtctttaaaaacatcacagggatgtcatctattgcaataaatgaaaatgggatatttaattacccattaaaaattattagaagaaagagtgactatacttcccaaatgagtattgataagcctgagttcctgtaaaatggcctcgggaagctttgccttcatagcttctacattcttcacctgaaatacaaatgtgggctgttcaaagatacataggaaatactttactttgaaactgaaataggagctggggagaagtgtttctctggagggactggatcgctcctaaggctgcccaacttgtgggttttccaatgcctgaggtctttaccatttaagtcgttggatttggattttctcttgctttaaatcagaattattttatctgaggcagacagaaaaattctcaaaattgagatgaagtttcatctgatgcattaagagagtatatagaactcttgtatacttatatactcttacagactcttgtataaactatggcaaaggattctttaagacagaggccaggtaaagaacaaaatgactgaaccagactgaaaacacagcccacaccagggacagggactagtagcatcaggtgcagaattccaatcatctcctggcttgtagaaattcaaattaagatagcaacaagtacactaaacagtaattgtgagtcagcacattaattggagaggaaatgagggaaggaaaagggaaaaagagagaagttggaaggagaagaaagaaggggatgggaggaaagaaaagaagggatcgcaatgtacttaaatgtccaaaacgaaccaaaaatgttaaagaaagaacatgttgggaaaattcaacacttctaaatgctgaaaacaattaacaatggaaatgtaaaatgcttggaaccaagtgatccatatctactacaaatcaaagctaaaacattggtactattgggaaaacgttggtaatgccagccatgtaaatactgtctatataaaataacaataatatctaacacataggggaggaaaaagccacttaaatgggcaaaaataccctgtaaaccaggaggacatctaaaatggtttatgtggggaatgttatcagctaaaacacttacattacaaaaggaaggctaaaaattaattatacaaatattaatcttaaaaagtaaaaaagagcaacaaaatcccaggaaaatagaaagaagtaatataaataagaacattagataaatgttaataaaaagaccaaaagcaaattatttcataaagaccaattggtataaatatattcattaataatcataacatctttagataattatttagcattatcaaataaagttgagcttgcacgtaatctacaaatcagcaactctacttcttttaggtatatatactagagaaattcttggatggaggcacagaaaatttgtatgaatatgttcatattaacattctccataataataaaacctggaaacaaccaaactgtttatatcattatactatcagcagtagaatgctaaataaattatggaataatcaaattatagaatatgacccagtgttaagactgaattaaccacaactacatacagaaatagagatgaatcttagaaatctaatgttaagcaacaactttaaaaaaccaaaattcagaatactaggaacactaggacactatttttataaaactcaaatgagtataaaacaaaacactatgcaatgatgtggtttaggtgtgtccccacccaaatctcatcttgaattgtggctcccataattcccatgtgtcgagggaggtacctggtgggaggtaattgaatcatggggacaggtttttcctgtgctgttctcgtgacagtgagtaaatctcatgatatctgatggctttataagggagagtttccctgcacaaactctttgtttttgtctgctgccatgtaagacatgactttgcttcttttctgccttccaccatgattgtgaactcgctaaccacgtggaactgtgagtccatcaaactctttcctttataaatcacccagtctctggtacgtctttattagcagtatgagaacagactaacatgtgcatatgttaaaacgacattttgaaagggaagagaaggaaaatattacatttcagaatagttattctgggtgaaagtgaagaagatgggaatggaaggagacactgggagcatcaatcttaatgcttacactaaattctcttgttgggtcatagactcaagaggatttgtttaattggtatgccatataatctaattattaataatatatgggttcttctgtatcaagtattacataataaaatatttttaaaggcatagaagatcttttctgttctgtgcctcatataaattatctcatttactttgaagcaaacttttgaggcatttattattgccctcattttaaagatgaggaagctgaggtttagagaagccaagaaacacagttcttgagagacatagctagagttcaggtctgtaccgtagccccttcctttaaccattacactgtctttctccatttggaccctttatagagggaagatcacagcactgacccctgttctcattggagtaggaggtgctgagagagctatgtaaaaagtacacactggagagtggaaaattttcacagaaatattgacacataaacttaggcaaacagaaggtagaaaagatgtttcaccaccaaaaactgtccacgtagagatgtggagagaaccaagaacctggaggatgtgagcacagtgggccttctggcatggcagaagcagagggaagtgaaggagggaacagcagtgctaaggatagaaatgcaggtttggtccagttgaagaaggcacttgatcttttcgggctgaccagtaggtcttaaactgtagtgcatattgttatcacctggcagacttgttaaactgaaggttgctgagccccattctcaaaatttcagactcaataagaatgagtggagcctaaacatttccattctaacaaatgctcaggtggaaatcactttgaaaagcaaagctttagggctggcatataaggaggattgcttttagaatgtcagtgatggtgaagctgtggagaatgggctggggagaaagaatgaacatggagagtatagttaagccactgcaggagctcaggtaggtctgaaacagtggtggtggagatggagagagagtgctgcagttgaggcatgtctgaagtctatgaacataaagtagtaaggcatgagttgggggcataaagatagagaggctcccaagctcctgccagaggtactgagtgaagagtagactcattaatcaatgcagggacaacagagaatcaactcaggtgcccatcaacggtagactggttaaagaaaatatggtcacaaataccatggaatactaggtagccataaaaaagaacagaattatgtcctatgaagcaacatggatgtagctggaggccattatgctaagtgaactaacctagaaacagaaaaccaaatactacatgttcccacttgtaagtgggaactaaacattggggacataaatatgggagcaatagaccctggggactgctacagcagagagagacggattggggcaagggctgaaaaactgcctattggatactctgctcactaccagtcacaccccataccttagcatcacactatatatctttgtaaaaacctgcatctgtacccctgaagctaaaataaaatttggaaaagaaaaataatcgatacataaaataaagagttatgctggctcacacctctaatcccagcattttgggaggccaaggcagatggatcacttgagctcaggagttcgagatcagcctgggccacatggtgaaaccctgtctctaccaaaaatataaaatattagccaggtatggtggtgcacacctgtggtcccagctacttgggaggctgaagtgggaggaccatttaagcccgggaggtgtaggttgcagtgagctgagattgtgccactgcactccagccagggtgaccaagtgagacttcatctcaaataaataaataaataaaatgagagaaaaaagaacaaacaaatactcttttcctccaagagggcactagaaagaggatacataatagtaacttttagaagagatttataaaaaatagagtgtgaattaattgtctctccccttggaaacaagagtttaacataaacaacatgggtttgcagatgtgtgtgggcaggatagggcaagaccaaggacagcatggtatcagtgaaggaaatgtgtaggagagtccagaaaacagcagccagttgagaagttcgaagcctgtcaaggaggatattttgatactatttacaaggtacttcacatacacgcatgatattttgtggcaggtaatagtaaggatgtaatattgatagaagagggagagctatgaaattgactatccccaagtagcaaacaagaattatagggtgaattatcctctcctatccctgagagaaagcaccagattgggcttctgtaaatgcaaaatacaggatgaaataaaggctcagtctgacagcggaagcttttggtttgttttctttggttgtccctcaaagtagaaagtaaagagaaggaggaagtagttcaaggtgcaaagatattctgaagtggagaaggaagaagtccacaggagtcatatgcagttaggtaatctggataagagcaaaagtaaactgaaatatgcagtagggtttgcatcatgggaacaaagaagattaatttgatgtgagtgatatgagctagggaaataatttaaaaattgaaaaaaatgtgaataataattgtagagattattccttttataaattgtgttaatacacacttcttttttaggggctagcatcacaaaattaccagaagcattgtgttgttttgccaattaaaggaatccaaataactccaaaatgattaattaccactttctgtaaatcctcaggtgaactcatttgcacagaattccctgcagttgtaaagaaaacagaacacttgacaacttgtcaggcacctacattcttttttccttttatttattaaattcttttactattacatgttattttccacagatgttatgtgaaatttctctcctaagcaaaataaataacttttttaagaattagaaaatctaaaggacaaaattttatattataaaactatacatagtattttattttgctggcataaatgcaaataatcatcttacagaaaaacattaatattacgttttgacttctttccacatgacatctacaaggcaaataacattacaaatcctcagtactttctaactgatatatggaaatagtgtggaaaatcacatgtagaattacatgtagtatgcttgtaatactgatttcctacaatgtacagatagggtaatactctgtccttggaactttgctgagaaagtatcaggaaacataacaggaaacatatcagaaacaactaaatggtgatttgtactaacattaatatattgtttatatataaataactctatacacatctctaagtataaatgcacacatctgtatgcatacatttattaacatccattgatataccacaaaaagtttgattaatcattttgagaaatacattaaaaaagaaacaaaatttttaatcttctccttactctatgacttccaatcttgggctcacattaacaccacttttttttgttgttgttgttgagacggagtctcactctgtcgcccaggctggagtgcagtggcgcgatctcggctcactgtaagctccgccccccaagttcacaccattctcctgcctcagcctcccgagtagctgggactacaggtgcccgccaccacgcccggctaattttttgtatttttagtagagatggggtttcaccgtgttagccaggatgatctccatctcttgacctcgtgatccacccgcctcggcctcccaaagagctaggattacaggtgtgagccaccgtgcccacccttaacaccactttttgaagatatctttaccttcaaggggtatttgtatcccaaatatattcagtccattgtctggcacatcatctgtcacatatagagctgcaagaagctcttccagtatcctagcatcaaaagaacattctcttcatgaccatttcactgcacctcagaaaaacaagaggccgaattcatcttcctagtcatgttgtggtgtaattaaatttaaaggaatcactacttatgtaatgtattttttccctttaagttgtctggagtaagttttggagaaacttgcatgataatatcaaaacttgttttcttattgtgttcagaaagcaaaagagaaatattaacattatttttagccttcttgtgttactggaaccatgtcacagaatgagagtttctctgggaataagatgtattgcaatattctgactaacagaatgtcagagtaagaaatttttatcagttgttctttgggtcattgtcacacatcatctgcatataatttccatagcagtgaacagtgaatgtgacattagcttcgcaatggtgttggcttgagggctggatataccgatgtgcattccagtcatggcaattcctggagaaaaaaaaattaattataatcattttgcataaatcaccatgaacaatgaggtactcatcaccttgtcagttagtttgcagcattcagttggctggcaaactggtgactttatgaagcattaaactatgtcaccgttagccagattaaactcactgtaacattatacttacataaagtgctttgtgaaggaaatatgaaaaatgttaactgaaccgatctcagaagacaggaaaatgattgtgatataatgcttgggttgaatattgtcactttcctggtgtaagcccattatggtttccaaaggactatattcaaataataagaaaaaagtcaggactctaacttggaagatgtaaagacatatatatattagatgaaatactctaaatgagaaagaaagaaaagaagaaaagggggctgtaaaatgactcaccatgtacagtctagaatcatagagacagggtgggagaggcccagagagagttgaagggtccagtatatttcacccctcagattctgtggattagaaaccaaagtctggagaaggttaagtgtctagcccaagacatagctagaaggtggtgggtccctaacctcgaatatagtatattttcacaggagcctaaatgaaatggaattcagggagtaagataaagaccagttttcattaacatttgcgttaaagttaaatatcatttttatgagaagacaaaagtaagatcaaatcctgaagtcaaagtaaataaccctgtgtaaaaacgcaaagttcatgggctttacaggctgtgctcacaagtctatgaccactgcttggaaggaacaggagtggaggctgtggcttattttcctggtggcatgtggtatgagccacaattttagtgaaagggtacagtcatgtcttaggtctctggaaactgcctaatgatttgatatcctggagattttttctggtctgctttatggaagacatttatatataggacagtgaaaaacactatttctggaggggaaagaacaatacggttaagtctaggttttctatttcttcttgagtttgttttcttttttgcttttagatttctaatcagctcaaaagatctccaagtctccaaacccttcacgaattaaaaaaaatgtaaaccctacaaatttcttaactccatctgcataacactgccacagatagaaaagtgtaaacaagataacaagagcatgggcaactctgtttttaaaaaagcaaaactgaattttattccagaagattctgtcctgtcctgtttgtaagctacgctgccaaaaatgagtgccaacactttgggagtggggagtgtatattgtttgaggtataaacatgattataatgtacaaaaataataatttacaaatgaaccacaatttctaaggttgcttcatatatgtcaattagtaaataaataaatgcataattaaaagaaaattgaagtaaaatagtcatttggtctcagcaagactctcaacaccagccaaagcatgaaggaagtaatgtccttttctctattcaagctgttacagctttctccagtggtcggaaacattttactcttcaccttctgataaaatcccagtcagctgcctttccctggtccgttcctccagcctcccatgaagaagtgatccttctcttttttaataccacttcttctcctctttatgtcttttgtcacatatcactgaaattttacccaaggactataccctctttctcctaaaagttccacctccctacttctatattctgatccattagttctcagtgtggtcctgggaacttgttaaacatgcaaattatctggccccactgcaaacctactgcatcacaaactctggggtacagtccagtattctgtgttttccccaccctctccaagtgactcagaaacaggctaacatttgggaaccacagctctaatatattctatcttaaagagaaaaaaaaaatggtactgcagccctgggtttcccttctactttccttcttccctgaactgtcaaattcctcagagtacttgttccctttcctttctcttattacatttgttttccaactcactggtcatactcagtgtcgtttggcattttgaggaattacatgttcggattgatttttgtgctgccaaataactacaatgctttctaaagttggaaatacagttgtgactagtggatgattagattcttctttgtagctctatttgactgtaatgggcgcaacttactggttttaccccagactagtccagaaaattatttagtgaacagaattgtatttttgcagtctaccaattatatcactagatatcttggaaaaaaacgccttgcaaagtagtgatagctggacaacctgggttgtgatcttggcttcttcattgtgtgacaataatataatacttaattattcttcacaataatattagtagttaattactcgttgctattagtaattattttgcttgctcacaaaattcaaggttattcatgtatttttctatctaaagcctcataaagcacagtgaagtatatttaatatcaattttcagataaataaatggaagtttagtgctattagggaacttgtccaagttaatgtagctaaaagtaggcaatgagctggatttccaaccaaggtctgtctaagcctgtcgaacaggctgctaatgaaaccttctgggaagttgttgtgtagattattctatttatgtattttattagttcattcaaaagcagtgttaagcctctgctttctggggtgcactaggctaagccctggaaacacagagaagaaagatacagcccacaaggaatcacattctggtgaaacaacagataactaaactatttaagtagatttttgtaagagtcatgatttagaggcacacagagcattgagggaacatggagactatatgaggtacataacctgggatggggagctcatggaagccctgctagggtcagtgaccttagtgttttgttagagaaacaagagccaggaaataaattgaatgaaaggaatgtaggaaaggaacctcagacataaagaataccagttgcaaagcaggagagagtaaataaataggcagaggtaagattacaaaaacttccatgcccttcaaaggaatcagaatgtctagaaggcaagaggaggagagtagggatacttttaagacaaaatgagagttagaaatctcataatgacaatactgtggaaagtggatttaagcattagaaggaatgaatgccaataattatcttagattgttttttttttcttctaaaaaaaagtggggggagatacatgtgcagaaggtgcaggtttgttacatagttatacatgtgccacggtggtttgctgtacctattgacccctcctctaagttccatcccctgaccccccaccccccaacaggccctggtgtgtgatgttcccctccgtgtgtccatgtgctctcattgttcaactcccacttatgagtgagaacatgcagtatttggtttttggttcctgtgttagtttgctgagaatgatggcttccagcttcatccatgtccctgcaaaggacatgatctcattcctttttatggccgcctagtattccatggtgtatatgtaccacattttctttatccagtctatcattgatgggcatttgggttggttccatgtcttttctgttgtaaatagtgctgcaataaatatacgtgggcatgtgtctttatagtagaatggtctctattcttttgggtatatacaaagtaatgggattgctggatcaaatggtatttctggttctagatccttgaggactactgtcttccaaatggttgaactaatttacactcccaccaacagtgtaaaagtgttcctatttctccacatcctctccagcatctattgtttcctgactttttaatattcgcccttctcactggaatgagatggtatctaattgtggttttgacttgcatttctctgatgatcagtgacgttgagctttttttcatatgtttgttggctgcataaatgtgtttgagaagtgtctgttcatatcctttgcccactttttgatggggttgtttgttttttctggtaaatttgtttaagttatttgtaaattctggatattagaactttgtcagatgggtagattgcaaaaattttctcccgttctgtaggttgcctgttcactttgatgatagtttcttttgctatgtggaagctctttagtttaatcagatcccatttgtcaattttggcttttgttgtaattgcttttggcatttttgtcatgaagtctttgcccatgcttatgtcctaaatggtattgcctaggttttcttcaagggtttttatggtttggggttttacatttaagtctttaatccatcttgagttaatttttgtataaggtgtaaggaagcagtccagtttcggttttctgcatacagctagccggttttcccattaccatttactgaataggagatcatttccccattgcttgtttttggcaggtttgtcaaagatcagatgattgtacatgtgtggtgtgatttctaaggtctctattctgctccattagtctatatgtctgttttggtaccagtaccatgctgttttggttactgtggtcttataggatagtttgaagttaggtagcgtgatgcctccagctttgttctttttgcttaggattgtcttggctctatggcgtcttctttgattccatatgaaatttaaaatagtttttttttctaattctgtgaagaatgtcactagtagtttcatgggagtatcattgaatctataaattactttgggcagtatggctaatttcacaatatttcctatccatgagcatggaatgtttttccatttgtttgtgtcctctcttattttcttgaaaagtggtttttagttctccttgaagaggtccttcatgtcccttgttaactatattcctaggtattttattctctttgtagtgattatgaatggagttcatgatttggctttctgcttgtctattgttggtgttaaggaatgcttgtggtttttgcacattgattttgtatcctgagacttggctgaagttgcttatcaatttaaggagtttttggtatgagatgatggggttttaagaggagccagctatctggattctagattttatgggctaaatggtgtctctcccaccacaacatttatattaaagggagcttggtactctaagccccagtaactcagaatttgactgtagtgagagatagattctttaaagaggtaattacgttaaaatgaggtcatatgaatatactgtaatacagtaaaactagagtccttataagaaggggaaattaggacacagacccatacagatgaaagaccatgtgaagacagggagaaggttaccatctaaaaggcaaggagagacagtagaagaaaccaaccctgctcacaccttggtcgcagacttctagcctcaaaaatcataagaaaataaatgtctatggtttaaatcacctgctgtggtgctttgttatggcagcccacaccaactaacacacaaaactgaaatttcatattttcattgatggctaccattttagatcagaatgacaactatatgctggacagattcttctgtagataacatcagacccacctagcaaatgtgtgctgaatttgctaaaagtaaaatattagctaggaatggaccatgttttcctttaatacttttgttaagacacaaacaccaaagactttccatttttgccactgtcttttctaaaggatgaattagtatgatataaagcatttgaagccttaagatgaaggaacactgcattaagttcaatgtaatcttcactttaaatctcttcttgagtgaagagtgcaaacatgcatccctgcctgaacacaaaggaataaaacctcgcctaagcactcctgacagtctttcatgcccacttgagaactggtcatctggaaccagccatccctacagctaccagaaaatacaacttcctctgtcactttcctgcagtatcacaaattacagaatggcacaagcgtgaaagagcaactactgaatgacgcgaaaaatatacagctaagagtgtgcaggcgagtgcaatggtgaggctcaaaagacttggtggagggtaaaacacagtgtgatcctcaagatttgccaccacagctgacttcctaattactactatactgctgttgaggcaggagaatagggtctggaggcagggaacctaaggctgatttacgcggacttctagaactaaatcaaaaggaaaaccccaactttccacacctaagtaacaaaaggactggaggatacgccctttgcaatcccccctccttttctgtgtggcagatagaaaattgaaagtatctctgattggttgctttctgcaaccaatcagatgattgcataggagtataactttgtaacttcacttcagcctctgattggttgctttccacaaccaatcagactagttgcacaggccactacttcatttacgtagggtatacaccaagtaaccaatggaaaaacctctagggggtatttaaaccccagtaaattctgtaaactggcccttgagtccctatgctcgggcctgcccccccgccccccgtggagtgtactttcgttttcgataaataatctgcttttgtcacttgattcttttcttgctctgtgtgtttcgtccagctctttgttcaaaacgccaagaacctgtacatcctccactggtaacactatctctgaataagataaggagtaatattagagctatcgttaataatataaataataggagatctctcttgccggaaaaaaggggaagcaataggcaagaaattagacaattcacccacatctacgctgctattaacaaaccaatgaacaggtttttctcagaagatggagaatatccagtaatactctgcgtgaattagaacatttggtgtgattaactgatttttgaagtgcacatattttgcctgactcttctaacttataaacaatgtctaaggatattaaaacattttcttcaatagctttatattggtttctaagatatctttatgaaaatatttgttttctaagatgttgaggtaattcagtattctttcagtaacttttgttttttctttaaaattgtccaaaaattttgagctctaaagtttaaaatatttgaagacttttgcagaaagtttttactaagacttaagcaaaagcgacttcagaaacttggtaatatggtattgcatgcctaaatacttgaaaaattcctatgattctttaaaaatactttttgaaagttcatgcctaaagacaaatgaaaaacttgattatttcaaaaacttattgataaatctattttactttaaaaatatctatttaaaacgtttatttataaaatggaatatataaaatgtgttaacactgcctaaagaaaagctttaagtaaaacttggctaaccaaaatgccagcatagttggtttccaatatcctttttttttttttttttttttgagacgaagtctcgtaggcccgggctagagtgcaatggtgtgatctcggctcaccacaacctctgccacccaggttccagcaattttcctgcctcagtctccagggtagctgagattacaggcacctgtcaccaggccaggctaatttttgtatttttagtagagacagggtttcaccgttttggtcaggctggtcttgaattcctgacctcaggcgatccacccacctcagcctcccagagtgctgggattacaggtgtgagccaccgcgccaggctggtttccaatattctttgttgaaattgtctgttgttgttatttggaaacaaagacaaattgcaatttgcggattttaccatcactgctgttttgttgtttaccaaacgaactttaaatttactttctggaagcttactcagatgcctcctaatcctgtacattttatacatttatagtaattttcagtgatagtttgtcatatgaataatgaacctaaaaccctgaatcatttgtatttatcaaggaaagactactataaattcattgaaatgtctttattacaacaagaaactgcaacaacaaacttttgaaagatttataggaagaaggaatgggtgattgtggataccagagctgagccagaatttaacaagaaagagcaatggcctggaatattgccctctaactagctaatcaaaggacttttttttttttttttttttttttgagacagaatgatgctctgtcacccaggctggagtgcaatggcgtggtctcagctcactgcaaccttcgcctcctgggttcaagcaattctcctgtctcagcctcccgtgtagctgggactacaggcgcacaccgtcatggctggctaattttttgtattttattagagatggagtttcactgcattgcccaggctggtcttgaaccactgagctcaggtaatgcacccgccttggcctcccaaagtgctgggattacaggcgtgagccaccgcgcccggccctaatcaagatcttagcatcatagcatgagttaagggcaaatacaggttctcctcacagtctaagggctattaattgaataattaatagtattaaaatttcacagcaagatgccctatgaaaataaattcaacttaagtgatagatattaagaaatgcaaaactttcattttcagataatatactatgaaagctaaaacagtatactacgtttcaaactcatttagtaattattcaaacatataacaatctcctgctggtttttaaatggatgttttacattatgtgccttctcttcaaatgtggccttttctaagttttgattgaatagaatgggtttttttttttcaagatcaagtctttttgtagggcttgttgttgttttttattgctagctaagtggttccttggagattgtggatgaatattgagattctttagagaaatgaagttcgtctgttacaattacactggcatgcttccttgagaaaagcagaggatatacagaaacatctaggaaagcctgtacatttttgagaagttagaaaattagttcccgattttcttttcttttgaaaaaaaaaaattttgtttcattatctcaagaaatgtggaattagctagagagggttgtcttatttttaatttgaaggagtggattcaagtgagaattaatataaacacatgctaatagggctgctttatgcttatgaggggcaagttcttcaccttcagccacactcaggcacaaccatgaagtgggttgagttggctctcagatcctcagccagtttccccctccccctccccctcctcctttctcaccacttgctgtaccctgttttcttccctctggcacctggtgttctctttacccactgctgcttctcccctgttgctccagagacaaccagtgctcaagaaaaaaaaatagtaaatgacttccatgaaagcatcttgaaactccggtttagacagagtaatgccaagacttgtgagagggctgagatttcactctgcttacaaaccaacaagcttgctaactcctgcaacagctccacggatgctggcagaagacatggcttctgggtctgggatgaaggacagcttattgctcgtagcaatagtggacagaatatcaacattttcatggattccctgagccctaattcagagggtctgcatacagcagggtggatttcaggagagaggtctcaagcttaggaaaccacaatcctttaaaaaggactgcaaccaaagctgcccaacatacaccccagagggacattatctttgttctagtggacagcaaatacaccttcattctgcacaggcagacgccaccatttctaccttccaaagtggttcactataaaaagttttttagaaaatgtccagaacaaaagatgattagtgtctctgctcacaagggcagaaaagcaacagactcatggagaagtctctcccaacatgcatatgttctgtgtatgcaggagggaggaattcatgggtgtaaagttaaaatagggcattctataaagcctacccaataaaataatgtaatcttacatttgtatggagaagagaaagtcttcgttgtttttgtctgcttgtttttgtaagatgaactataaaacataaagctcaaaaaatgcatggttgagatgtgtatgtaattgaagtattttcaactgagggtcatgttagtgttttaatattggcatattttagaagagtgaagatggatttaaaaggtagagaaacactggcttaatcaccgattatccacagggatgtttacattcagtggaggctaaagcctaattctaacatgatttcagtcatcggccaggatgtggggcagtgttttgagggtcagagagaggccttttcacagaaattactccaaaagaatggaggcctactctatatctaaaacattgtctgaataatgaacacaataattaatttgcttacattccttttaggaaatactgaacaatttctttgaattccttcagggatcttcgatatttattatacacatttcagtaaagaatgttaaaataagtatccctgtcccaaacacccagtctgtttctggtattttgaaggcgtgaatgtctcattaaccgagacaatgggaatgatgctaagaaaagctcttttttatttaactctcatgctcagtttatttttattctcatagttattatattctttagaaatattatatcctggtttctgcagttacactacttaagcaatgtcagtaacacagtcttctgcatagctccttgttagaaaaaagcttccctaatgcacagacataggagagggagaatcaaacagtaacacctcttgacatcctcaccagcactgtcactgggaactaattggaagataaactcggagaagcttattaaccctcctaatgtggataggaattggataggggcagggtgatagaaatcagtgcagggcaaaatgtgggtgtccctttcactttcacagttcagtaagatataaatactgtgtcatttttgttttcttgtttgctttttatttttagagatagagggagaaataatctagcattgtacattaaagtaatacattagaaaaggaggaaaactaatacaatatttttcctgtagcaaaaccccagaaatgcaaaaagacaagcaaaaagcaaggacttgagcttacacaatagaacgaatgtcctttacataaaatgttagcatatctgtaccaataaactaatttctaaccataaatatttgcattacgagaataaagatgaaaataaaccaatactttattaaatgggggtaagaaaattctcaagatagaatgaaagaaaaaatagtaaagataaaagtaggaattaatgaaaaagaataaaaattaattctcataaaagacagttgccaaaataataaaatagtctaacatccaaaatcgggctagcctgatttaaaaaaaaaaaagaaatctaaatgctccaaaatagtgatggaactacaacatgcaatctgaaacagtagagaaaatgaagacacaatttaaagcatgagaaaatgaaaataaatggtaaaaagtatcatgcacaatgagattatgcatgattcttttacaaatctgaaaatgtgtgaaacaagttattctgaagggaatataggttgccaaaataaaataaaaaaacatttatagatgaagaaaggtacagtatcaaactgtccattaaccattgatcaaaaattaatgtcctctaagagatattaggagaggccccaagaatgatagactggagtaggaaaatgtggcacatatacaccatggaatacagccataaaaaaacggatgagttcacatcctttgcagggacatggatgaagctggaaaccatcattctaagcaaactgtcccaaggacagaaaaccaaacaccgcatgttctcactcataggtgggagttgaacaatgagaacacatggacacagggcagggaacataacacaccagggcctgtaggggggtagggggctggggtagtgatagcattaggagaaatacctaaagtataattaaaaaaaaatatatatatatatagtcaatctttcaaggaatagatcaatattgttatggacacatttccagactgtagagaaatatgaacaactcttatgttcaaatattccataagtctgattcttacacatgataaaatctgtctaccacaggaaaaaaaaaagcttcaagccaaactcatttttgattatagatgctaagattgaaataaagaaaaagtaagttacattgagctgtatagacatataaaatagcactttaatacattaataggtaaacttagtttgcaaaattatttacattgacacaaaaagttatttgataaattcaatactcatttctgattaaaattttttgtaactgaggggggaacacttatttcatttaatttaatattttaatttattttgggatggagtctcactctgttgccctggctggagtgcaatggtgtgatcttggctcactgcaaactcggcctcccaggttcaagcaattctccccagtagctgggattacaggtacccaccaccatgcccagctaattttcgtatttttagtagagatagtgtttcatcatgttggccaggctggtctcgaactcctgacctcaggtgatccgcccgcctcggccttccaaagtgctgggattacaggcatgagccaccacgcccaggctcttaattttaattttaattgtctaatgacagaaaccatgagaatagtccagaaatacttcttagaataacactttaatacacatagattcttgatataatttaaaactatattattaaagtaaataccttccaatgtttgcttttgcattaatattaccatgggtatcaagatagtactattgaaacaaaaacagaaaaaaatataaaacagaattcaaatttgcaaatgatatggaagctgaactatgtatacctgacactgatagttgcaatgctgtatcaagagtttccctgataagctctactactaattgtaccagctagaataaaaagcaacaatagattataatagcaaaatgtaagaaattagatctgataattaacgtagtagggaggggatgtgaagatatgttgtttagaataacttagtttttctgaaggacgtaagatagcttagaaaattaaaaagaaaggttgtgtcataagagtgtgtaatgtaaagctcttaactttccacaaagtaattattatgtttaattatattataataaaaatttcaaaaagactttttgaagacaaattgattctatagttaatctagaagaataataggatgatatagattattctgaaagaaaataagagagcagcttatgccaatatatatgaaaaaatatatgcatatagaataaatgtaatagtaaggaattgaaacaaaaatagaatagcatcaatcaataaaatagagtccaaaagtatgtataaaaatgttgcatttaaattgaagatgaaattaattatttaatacataatcctggaagatgtgtttcacaatgaaggggaaggtaaatttagattatttgctcaattttccaaagtacttagcaaatagattaaatgtgtgtctataaataaactggaaaataaacttatcttaataagcatttgttgggtctcaagatgaggaacaccatgctatatgaaacagtgaaatccatagtaaactccatgaaaggagcaattaaacacaaaatcaatttttaaaaaaatatttaaaaaccacaaatcagtgtttctcaatttgggtttctaggtacctagtgttgatgatttatatttatgattttataggtaatgtaatgtatcaatattgcttcattaattttaacaaatgtaccacgctaatgtaatgaataaatattaggggaaactgggtgcagagtatatgtaaatctaaaactctcttaaaataactcattttaaaaaatggaaaatgttaatactaagcaattcagaaaatctattacaagtaatagaaattgctaaggtaagaaaatatcattaatctcttcagcatgaaacaaatgtaccaataagttgccttgtttaacatattaaagtaataaatgggtggatttatatctgggtgctctattctgttccattggtctctgtgtctgtttttgtgccagtaccatgctgttttagttactatagctttgtagtacactatgaagttcaatatgaattcaggtaatgtgatgcctccagctttgctatatatatttcaggaccttttgtggtacaaaagtttttgggttacatgaatgaattggatagtgatagtctgatattttagttctcccatcaccagagtagtgtacatcgtattcaatatgtagttttctatctctcattccccccgccaccctccctccttctaagtctccagtgtgcattataccactctatgtctttgagtgcccatcaactttgttctttttgctcagggttgctttggctattctgggtattttgtggttccatatacactttaagattattttttctatttctgtgaagaatgttattggtactttgaaacggattgcattagatctgtagattgctttgagtatggatattttaacaatttgattctttcaatctaaaaacatggaatatctttacatttttgtgtcctcttcaatttctaatataatattattcaactatgaaaaagaataaaatcctgtcatttttaacaaagtggatgggaagtggtgaacattatgttaagtaaaataaggcagacagaaaaagataaagtagcatgttctcactcttatgtgggagctaaaaaaaataaaattttaaaaaaaaaaaggaactcagggtgatagtaagatgatacttaccagcagctgggaagggaaagaggagaaggtgattaagaagagttgcttaatgagtcaaacatacagttagaaggaataaaaactagtgtttggtagcacaataggttgactatagtccacaattaatttattgcatatttcaaagtacctaaaagagtggaactggaaagttcctaaaacaaagaaataataaatgcttgacatgatggatatccctattaccctgatttaatcattacacattatatacttacatcaaaatttcacatttaccccataaatatgtacaactattatgtatcagtaattaaatatttgaaaatgttcaaggaagcatgcttataattatcctttaaatctgtatatgtaaactcttcataataaagactaatgtagaaaaaaaagaaacgtaaaaacttcttctcaactcatgcttacaagcttctttgttaaacacttccattcactgaaagaaacaacacataaagcaactttaaagaagtatgcttagatttactttttaaacctgtataaaaaaaaaaaaaaagtaggaccaggcacagtggctcacacctgtaatcccagcactttgggaggctgaggcaggcggatcacttgaggtcaggagttcaagaccagcctgggcaacattgtgaaacccaatctactaaaaatacaaaatttagccaggcatggtggtgtatgcctgtaatcccagctactcaggtggctgaggcacgagaatcacttgaacctgggcagcggaggttgcagtgagtcgagatcgtgacactgcactccagcctgggttctctatctccaatgaataaataaaataaaataaaataaattagcagaggcttttaaacacctacattacacagtggcattaatgtagggaaggttacttttatatattatagtgttaataaagtatcacacattttctgaaagcctctttggcaatatatatcagaaaccttaaaaagattcctattttttgactcactcatttttgtaatctacctcattaaaacaatcataaaaacaaaacaggacttaacttagatggttttatttatgactatttattttgcttcggattttctcagaagaccacaaacccctctagatattttaaatagaatgagatacaatacagagaatcagaagcttacaaaatcatcagaactactggtggagcaaaggtgacggaaattactgctcatttcagtaaatcagaaactggggaagttacagaaaactgttactgatctcatatttgcaccaaggaagtgagttaatacacctgcccactgcagtccctagagcaatagtgacttccttcactccaccttcaaaattctgctgaaatgcctctcgttggcagaatttaatgtgaaaaactgttgtcaggaactctggaaaacatagttctctggctcccagccttttaataaagaggaaaatataaatgtgtatggggaagtggtggtagtggcactgtactgttaacaaaaaatgcaagaatggaaaaaataagtcagcaatttaaatgccaatactcttcagtggggaatagtttactacattggagtattcatttgatgagattgtatgcagtcattaaatatcctattctgcaatacatgataaatcatgtatcattatgttttaataaaatgagaacatttttactattaattggatgaaaatgtagttcataaagcagtagagtacaaacctactttattatataatatagcatcattctattcaagttcaactttatagtaaaactaaagattttctaaatccaaaattcaattttctagacatagttctaaaattccatttttaaaagtctatggaaagaaaatgaagttctgttaaggtatatgtagaatacctggaaaacaaagttctataagtttttttagcttaatgtaacattaagagcccataatctaaaatattacattgtccagtgatattgtcatgtattctagttgtagttacttttaaaataaatgctaagttggaaaagaaagcacattttttatggctaggttttgtaataaccaggtgactattctaaagatctcattcacttataaaccataaaattaaaaaatgttttctcaatggccataatagtggagaaataggttgcttttctccagacatagtgctttgagtctgtacttcatgaaatatcatctgtaatcatctttgtacttacgaaattatcaagatgtaattatcaagatggacactatgggctattgttggatgaacacgccttgacaaacagtcaatactttaaaacaaaacaagcagtacatgaacatattcctttcctttgcagagagtttataccctatttctaattgttgtttgagaaggtattttaatagaatggagttatttactctagaggcacactctggggggtctgcataggaatgtgagtcccaggtgttttccaggtctctctctccttactaatattactcagccactctgtcttctattagttctgttttgcctcaggtttcctaaattgtcaatattttgttttgatttaatgtctagaaagaattccaggatatatttttatactaacttttgttcaaaatgcaattatctctctttatcctcacttcagcttccataagagcatttaaaggtcagggaagagtttttaagcagatcagtttggagaagcagaaaatctctatggaaaagtgcagggtctagtaggaaagaccatgtagaaatcactatatattgttttatttactgtcccctatgactatctgaaagacctagcttaatgaagattgaataaaagcattaaaaagtaatgaagccatataaattctgggcttgggtttaaaaattataattctaaccattttataatagttgttaagatacactcacctatgcacacatatattcagaaatgtttctaatatatgcaagtagtactgtgtgtatgattatgaagggcataatcaatgtaattcaaaaaacaataatgtaatttgattataagaatattaggatttgaaaaataatagtcatattcttgctaaatgaacaattcaaattagtcacattaaagaaaataataaactttaatctgtgaaacccattattaagaaacttcatttaatggattaatctcattgcaaattgcatagtgctatacaaaaaatgattactaaattgaaaagtttccccttatgtacaagttagatatataatctgtttgtttttatgtatattgtgtttaaaatcctcatattgctcaggattaccttggttatccggggtcctttatggttccctattaattttagaattgttttctaattctgtgaaaaatgatattgctagattgataagaatagcattgaatttgcagattgctttgggcaatatgagtatttggccacttaaacaatattaattcttctaattcatgagcaaggaatgtttttctatttgcttgtgtcatctgtgatttctgtcagcagtgttttgtccttctcctggtagagatctttcacttccttggttacatgtattcctaggtatcttgtgtgggtgtggatattgtaaatgaggccatttccttgatttggctctgagcttgaacacttttgctatatagaaatgctactgattttttaaattgattttataccctgaaactttatcgaattagttatctgttctaggagactttaggcagagtcctcaaggcttttatagaatcagatcatcagtgaagagagatcatttgatttcttttctgattttcaatgccttttatttcattctcttgcttgattgctctggctagtacttccagtactatattatataggaatggtgaaagtgggcatcctctgcttgtttcagttctcaagaggaatgctttcaactttttcccatgcagtatgatgttggctgtgggttgtcatagatggatcttactattttgaggtatgttcctttgatgcctagtatgttgagggtttctatcatgaagggatgttgaattttattataaactttttctgcatctgttgagatgatcacacactttttgcttttaattctgtttatgtggtgaatcacatttatcgacttgtgtatgttgaaccagccttgcatttcaggaataaagcctgcttgattgtggtgcattaactttttgatgtgctgctggagtcacaaaatactaatttgctagtattttcttaaggatttttgcatctttgttcatcagggatactgacttgaagttttctttttcattgtgtcttttccaggtttgggtattaggatgatgctagctttgtacagtgagttagggtggaacccctcctccttggttttttggaatcgtttgaggagaattgctaccaggtctttttttggatgtctggtagaattcagctgttaatccatctgattcagggcttttattggttagtaggctttttattaatgattcagtttcagaatttgatattggtttgttaagggtttcagttccttcctaattcaatcttgggagattgtatgttttcaggaatttatccatttcctttagacattctgttttgtgtgcatggagtgtttacaacagtctgtgaggatcttttgtgtttctgagggattggttgtaatgtcacctttgtcattttttaatatgcttatttaaatcttctctcagattttcatttgttaatctagttattggtctattgatcttatttatactttaatatagccaacttaatttcattgattctttgtaatggtttttggcttcaattttgttcagttctcagattttagttctttcttttcttctgctggctttaggcttagtttgctcttgtttttctcctttctctaagtgtgatgttagatcattaatttgagatatttctaattttttgaggtaagttttagcactataaagtttcctcttcacactgctcttgctggatgttgtatctctgttttcatttattttttaaaaatgtattaatttctgccttaattttcctgttcattcaaaagtcattcagaaacaagtcatttaatttccatgtaatcatgtagttttgagggattttctttgtattgatttctatttatattccactgtgatctgagagagtatgcttcgtatgatttagatttttttgtatttattgagacttgctttatggctgaacatgtggtcagtcttggagtaggtttttttttttatttattgagacttgctttatggctgaacatgtggtcagtcttggagtaggttttatgtgcagatgataatgtattgtatagttgataggtgatgtattctgtatgtgtctactaggtccaattagtcaaatgtcaaatttaagtctagaatttcttagttttattccctgatgatctgtctaatgctgtcagtggggtgtttaagtgccttattattattgtgtggctgtctagttcttttcataggtctagaagtacttgttttatgaatctgggtactccaaggttgggttcatatatgtttatgacagttacgtcttctcattgaattgaactctttatcattatgtaatgctcttctttgccatagctcaacatcaaactatactataaagctaaagtaaccaaaacagcatagcactggcacaaaaacaggcacatagaccaatagaagagaacagataacccagaaataaagccacacacctccaataatatggtctttgacaagtcaccaaaaaattaggaatggagaaacaactccctattcaacacacggtgctgggatagactaaccgtatgagaaactagacctctgcctttcaccatatacaaaagttaactaaagatagattaaaggtttaaatgtaagacctcaaactataagaatcctagaagaagacctaagaaacaacattctggactccagccttgggaaaaaaattataactaagtcctcaaacacaattgcaacaaaaacaaaaattgacaggtgggatccaattaaactaaagaaaatgtgtacagcaaaagaaactgttaacaaagtaaacacaacctacaaaatgggagacaatatttgcaaactatgcatcctaaaaacaaccccattaaaaagtggacaaaagacatgaacagatgctgatcaaaataagatacacaagcagctaacaaatgtgtgcaaaaattctcgacatcactaatcatcagagaaatgcaaatcaaaactgcaatgagatatcatctcacacaagtcagaatggctaatattaaaaagtcataaaacaacacatactggtgaggctgcagagaaaagggaatgcttacatgctgttggtaggaatataaattagcccatccaccatggaaagcagtttggagatttctcaaagaacttagaattgttatccagcacaacaatcccattactggatatatatccaaaagaaaacatatcattttaccaaaagatacatgcactcatatgttcagcatagcattgttcaaaatagcaatggcatggaatcaacctaggtacccatcaatggtgcattggataaagtatggtacatgtacaccatgtaatactgtgcagccattaaataaatgaagtcatgtactttgctacaacatggatgcagctgaaggcctctattctaactagattaacacagaacagaaaaccaaataccctatgttcacaattataagtgagagctaaacattggtactcattgacaaaaagatggcaacagtagacactggggacaatcagagtgaagaggtagggatgtggagaagtgttgaaaagctgcctattcagtattatgcccacaacccaggtgatgggatcagttgtatcccaaacctcagcatcacaaatatacccatacaacacacttgaacatgttcccctgaatctaaaattaaagttgaaattattaaaaacaaaattgtattcttgcattaaaaatgagtacaacaaatttaaatggattgtgtgtagtttaaatattaacagttcttaaatagaaaaatgaaatgtgaacactaagagttaacttacactaaaatatattctcaaattcctggtgtgtttttaagtgaagtttccctaacatcaggatgttaaattaataatctctgagacatttaaattttgttatccagtatattagtcagtattctccagagaaacataaccaacagaatgggatatatatacacacacactcacacacatgcatggtgatttattgtaggaatttgttcatgcaataatggatactgataagtcccacaatccgctctctacaaattgaaaaatgagaaaagctattgctgtaattcagtgtgaatctgaagacctaagaatcagggaaggcaatttctgagggcggaagaggagggatgtcccaactcaaacagaagcaaattcaccctctcttcgtctctttgttctatccaaaccctcaatggattaaataatgtctatccacattggtgagggccatcttctttactcagtttgctgattcaaataataatctcttccagaaacattgtcacaggcacacccaaaaataatattttaacctcactttaggcatctcttagcccagttgagttgacacatcaaactaaccataacaccaaggaaatcatgttagtattattgcaaagatatccacaatgcatttttctcacaaatgccctttttcctgtaaattgtatcacttcatctcttaaatgccctcatcgcaaaaaaaaaaataacattgtattggtcagtgttcttcagagagatagaatcaaaaagatatatgtgaatacagatattttaaagagatttattagggatactagctcacatggttatggaggcaaagtcccgtgataggttgtctgcaggctggaaaccctgagatgctggcagcatgactcagtttaagtccaaagccccaggaactagggaaacctatgacataactctcagtctgagtctgaaggcctgagaactcagggggccactggtgtaaatcctggagtgtctgtgtagaagatcctagatttctgatgtcccaggacaggagaagagtatatcccagctccaagagaaagagggcatcacctttttgtgcttatcctcgtcctcagatgattgaatggtgcccagacacactgagggcagatcttccccacttagtccaccaactcacctgccaatctcctctggaagcaccttcacagaaaaacccagaaataatcccttaccggttctcttggtaattcttaatccagtcaagtcaacacctaaaattaaccatcagaaacatataactttgaacaatttgcgtttacctttacccactcacataaaaacaccatacgtaggagttcaaaggaatttaaattgtttgcaatttttttcttttataactaggaatgttagcaaaacaccatacggtgagacagcaaagcacagtggcttaggagcacagactccaggttcacactgcataagtttgatcctagctctgttatttaataatataggacactggctaagttatttaacctctctgccttggtttgctcctttgtaaaatggagataataaatattttctaccttatatgattggtatgatgattaaatttacttatgtatgttaataagtatattgaacaatggcctgtaagtacttaatgattaattgaaattattatatctcttattaaagatggtttgcttatatctcatatagccataagagatattttgtgattgggatcaggaaaacaggttatatcaaaggcaggtagtcacctgtttctctttgcaatatttttaaagatttgatacttttagaacagttttagttcaaagcaaatttgaaaggaaggtacagagatatcctgtatatttcctgcccccacacatgcatagcctcctccattatcaacatccttgtattagtccattttcacactgctatgaagaactacttgagactgggtaatttataaaggaaagaggtttagttgactcacagttccacatggccggggaggcctcagcatacttacggtcatgatagaaggtgagggggaatcaagcaccttcctcacaaggcagcaggagacagagagagcgagcaaagaaggaaaccaccagacacttttaaacaatcagatcttgtgagaattccctcactatcatgaggacagcatgggggaaactacccccatgatccaatcacctcccaccaagtccctgcctcaacatgtgaggattataatttgagataagatttgggtggggacccagagcaaattatatcaatgaagtgtggtaaattggttacaattgatgagcctatactgaaacatgattatcacccaaagtccatagttcacattaagatttattttgtattgaacatcctatgggttttgacaaatatataatgaaatatagccaacactatagtagcatacagagtgttttcactaccccaaaaatctgccatgctgtatctattcatccctcactccccacaacctctggcaacaattgaactctgtttttctccatagtttagccttgtccatagtgtcacatggttggactcatacagtatgtagccttttcatattggcatctttcacttagtaatatgtgtttaaccttatgtcttttcatggcatttttttcagtgctgaataatattctattttctggtctgtttgtagcacagttcatttatccattcacctactgcaagaaatcttcattgcttccaagttttgacaattatgaataaagctgcttataaacattcttgttcaggtttatgtgtgaacatatgttttcaactcttttgggtaaataccaagaagtgagattgctggatcataccataagagtatgtttaattttaggagaaactgccaaactgtctttcaaagtggccggaccattttgtattttcactggtaataaatgagagttcctgttgttttgcatcctggccaatatttggtttttaaagtgttctggattttggccattttaggtatgtaatgatatctcattgttgttttaatttgtagttccctgatgacatatgatgtagaacatctttttatatgcttatttgccatctgtaaatattttttgagatgtctgttaagggttttggtccattttagttaagtaatttgttttcttattgatgagtgttaaaagtttcttttatgttttgaaaaacagtagtttatctggtatgtgttttgcaagtattagttcccagtctgtgttttttttttcatcttctttatagtcttttggcaaagcagaaatttttagttttaatgcagtctagttcaccaactgtttctttcatgaatagtgccttgggtgtcatatctaaaaattattgccaaacctaaggtcatgcagattttctcatgtgttaatttctaggagctttctagctttgtatattacctttaggtctgtgatccactttgagttaatttttgtgaaggatataaggtctatgtagaggttcactattttctgtgtggatgtccagtagtaaagcatcatttgttaagactttctttgctccatcgtatagcctttgcttctttgtcaaagatgattgtgggtctatttctagactctctgttatgttccatttatctatttgcctattccttcaccaacactaaacactaaacttatttacagtcttatttactgtagcttcacagtaaatctgaaagtcagataatatcaaagcttcaactttgttcttctccttcaacattttgttaaatgttctgggtcttttgcatccccatataaactctagaatcagtttgtcaatttctacaacataatttgctggggttttgtttgggatggtattgaatctatagattaagttggaaaaagctgacatcttaacaatattgagtcatcctttccttgaacatacattatctatccatctatttagtttgtccttgatttctttcatcagaattttgtagtttacctcatattaattttgtaattctgatggatttttcataagcatttcatttttggagatgctaatgtaaatggaagtatgttcttaatttcaaattctacttgttcattgctggtatatagaaaagcatttgactttttcttattaacctcatattctgcaactatgctataattattaattccaggaggatttttgttgttgttgattttaaaaaaattctacatagactatcatgtcatcagaaaaaacatgatttcttccttttttctttttctttcttgctgcattagataggactctcagtacaatggcgaaaataagtggtaagaggagacatccttgcctgttcttgatcttagagggaaagcttctagtttcttaccattaagtatgatgttggctgtagattttttgtagatattctttttcatgttgaggaagtttccccttattcctaggttactgattgtttttatcataaatgggtgatagattttttttcagataatttctctgcatttattaatatacttatgtgattttttaaatttagtttgttgatgtgatggattacattaattgatttttaaatattgaaccagtcttgtatacctgagataaatctaagtaggtcatgttgtataattctttttgtatatatttggattcaatttgctaatattttgttgaggatatttgtatctatatttataggaggtattggtcatagttttcttctactgtctctgtctaggtttgttgctaagatgaggctagcctcatagaatgaggtagaaagtttttcctcagcttctatcttttgaaagtaattgtagagaattggtataatttattctttaaaagtttggtggaattaccagcgaacacttacggacctgatgctttctgttttggaaagattattaataattgctttaatttattaaatacatatagacctattcaaattctctatttttgcttttattagatagattttattttctttcaaggaattggttaatttcatctaggttatcaaagttttggacatagacttgttcataatattcgttatcttttaaatgtccatgagatctatagtaatggcccacctttaatttctaatattagtaatttacatcctctcttctttttagttagcctagctagaggcttattgattcaatttatcttttcaaagaaacagcctttggtttccttgacttttccctattgatttcttattttcaattgcattggtttcttctccatgttttattatttattttcttcttcttactttgagtttaattggctcttctttttctcatttcctaatttagaagcttagataaatgactttagatatttcttttctaacagatgctttcaatactgtaaatgtccctcaaagcattgtttttactacatccaacaaatgttaataaattatatttttatttttatttacttaaaaatatgaatatttctcttgaaatttttcattttacccatgtgttatttagaagtgtgttcattgtttaatctccatgtattttaatctccaaaatatttaaaaatatttttaaatttctcttgaaatttcccactttatccatgtgttatttagaatggttttcattgcttaatctccatgtattttaggatcttccagctatttttttctgttttttttttcttgtttaatttcattccggactataaagtaatttcaaatttgtcaaggtgtgttttattgcctagaatatgatgtgtcttattgaatatttcctgtgagcttgagaagaatgtgtattctgttgttggataaagtagtctgtagatattcattatatccagttgattcatgatattgctaagttcaactatgtttttactgattttctgcctgccatggtcatctatttctgatagaggggtgttaaagtctccaactataatggtggatttatctatttctcttgcaattctatcagtttttgcctcacatactttgctgctctcttgttaggcacatacatgttaagaattcttattatcatagttcattttgagctgctataacaataccacagactaatttataataaacagaaatgtattggctcatagttctagaggttgggaagtccaagatggagaggctggcttcctgcaaaagctttcttgctgcattatccaatggcagaaaggcaaagagagggtgagagagcaagaaggggctgaacccattcttttataatgaacccattttcacagtaatgaactcactccctgtattagtcagggttctttaaagggacagaactaataggctatatgtatatatgaaggggagtttattaggataattgactcacaggatcacaaggtgaggtcccacaataggccatctgcaagctgaggagcaaggaagctagttggagtcccaaaacctcaaaagcagggaagccgacagtgcagccttcaatctatagcagaagacccaagagcccctggtaaatcactggtctaagtccaagagtccaaaagctgaagaacttggagtctgatgttccgagggcaagaagcatccagcatgggacaaagatgaaggccagaagactaagcacacctcttcattccactttcttttgcctgctttattctagccacactggtagctgattaaatggtgcctacccagattgaaggtgggtctgcctctctcagtctagattcaaatgttaatctcctttggcaaaaccctcacagacatacctatgtacaacattttgcatcctttaatccaatgaagttgacattcaatattaaccatcacatttacataataatggcattaatccactcatgagagcaaagccctcctggcttcatcactttttttgttgttgttgagacggactctctgtcgcccaggctggagtgcagtggcgccatctcggctcactgcaagctccgcctcccgggttcacgccatgcttctgcctcagcctcccaagtagctgggactacaggcacccaccaccacgcccagctaattttttttttttttttttttgtatttttagtggagacgggttttcaccgtgttagccaggatggtctctatctcctgagctcgtgatctgcctgcctctgcctcccaaagtgctgggattacaggcgtgaaccaccacacccggcaggctgcatcacttcttaaaggtcctgcctctcaacactattgcactggggattaagttttcaacacatacttttggagggacaaattcaaaccacagcagttatggccaataattttctcctttatcaatatgagattttcctctttattcccaatatattttattgctttgaaacctactctgtctgaaattagtatagctactcttgctttcttttgattagtgttaacaaggtacttctttctccatccgtttacttttaatctacacgtgtctttatatttaaactgagtttctcatagacaacacagagttgagtcttatttcttgattcattctgacaatctctatcttttaattagtgcatttagacaattgatgttcaaaactgattattgatatagttgtaataatatctaccagcataccaactataccaattgatatagttgaagaattaatagtgatataattggattaatatttagtactgctttgtatttgttgcctttctttgttcctatttttgtcttccagtcttttttctgccttttgtagtttcaattgagcattttgtatgattacgtgttctctcctcacttagcatacaaattacacttctttttttttatttttattttttgagatggagtctcactctcttgcccaggctggagtgtagtggcatgatctcggctctctcaacctccacctcccaagttccagtgattctcctgcctcagcctcccgagtagctgggattataggcattcatcaccatgtctgactaatttttgtgttttttagttgagatggggttttgccatgttggccaggatggtctcaaactcctgatctgtgatctgcctgcctcctcctcccaaagtgctgggattacaggcgtgatccaccacacctggccacacttctttttaatactttttttttaaattgttgtcctggagttgcaatatgcatttatatataatccaagcccactttcaagtaacaatataccacttcatgggtagtgtgagtaacttataataaaaaaaaactcttaatttcttcctcccatcccttgtatcattaatgtcattcattttacttatatgtaagtatacacacacatacacaatatatacattaagtatacataattaaatacatttttcatggtatttttttgaacaaatatttacttgttaaatcaattaagaataagtaaactagagcatgggaaagctcagaaaccaacacaagatcccagaaaatggggccaggcatgcagggaaactgagcagccagcaatacctgtcaatgtcatgttccttgatatgcagcagtgatgctgggctgcagctgagagtgccgtcccattgcaaggaatatcaggtccatgcttctgctgtctcaggtgcccaagcttagcatgggttctctcagctcaagccaccagccctccctaggacccgagaaggtgaagcccttgtgtgaagtcctggctcttgtcaaggcagggtgctaaagaagaaacagaaaagaagttaagaaaaaattttaattttatctttacttacttcttctttgatgctcttccattctttgcatacatttgagattttgacctatatcattttccttgtctccaaatgacttaggatgttttgcaaagcaggtctactgacaagtccccttaatttttttctttggccagacaaagtctccatgtctccttaaccattgaaagatagtttcacaaggtacaggattctaggtttgtgggctttttctctctcaacactaaataattcactctactcttttcttgcttgcatggtttctgagaagaagtcagatgtaatttttgttgttgctgttcctctgtaggtaaggtgtcacccaccccctctctggcttctttcaggattttttctttacctttaattttatataatttgaaaattgtgtgcctacatacagttttttgacacttatccttctttatgttctctgaggtttctggatacatggtttcatgtcagacattaatttgagaaagttctcagtcattcttgtttgaaatatttatttggttcatctgtctcttctctttcttgtattcctattacactttcgtagtttccccacagttgttgtatattctgttatagttttttttttcagtttttattctttatgcttttcaattttggaggtttctattgagataccatccagctcagagaatttttcctggaccatattcagtatactgttaaccacatcaaagttacttttatttctgttacagtgttttttagctctagcatttctctttagctcttaagatttccatctctctgcttactttacctatctgttcatgcatgctgtcacctttatccatttagagcccttagcatattatcataattgttttaaattccgtgtctgataatccaatatccctgccatgtctatctgtgaggcttgctttggcccttcaaactgttttttgtctttttgtatgctttgtaattttttttctttatagccagacacaatgtactgggcaaaagggagcactttaaacaggcctttagtaatgtggtggtaaggtatatggggagggaatatgttctacagtactctgattaggtctcagtctcttagtacccctatgcctttggactgtgaacatcacaagtgtttctcagggttttttttttttttttttttttctgcctcgttaggtgggacaggatggttacattgggctggagttggttatttcctttcttccaggaaagttgggttatgatagaaccccaacaggttgaattctggttaaccagtttctcctgaaggcagaccttgttaagaacacagcgttctggcatattgcaaaatgattcattttcatcttttcctgctagaaggacaaaaagatttttctccaatatttgctgtgaaaacctggttgagtcccttggagcaaaactcacaaagtgtgggacccgtcctttgactgggtcctcctggagttttaactctcagactccttcatacttagcctctagcaatttgtcaattacagttcaagtttctatacccaacctgtgaagaaggttcatggcattctagttactatttcaaagggaggactctaaacatttccacccactgcactttgggtgcacaaatctatagtgagacagaatactttcacacaacacattccatgaagcagatttattacagataggcagcaagggacaacagaagcctaggactcatgacaaagctgtcccccaaggttcaggaaagcttcatgagatggatggaatctcatctgcatgcaacttatgtcacactgcagctaagggaccccaaaaagcagcctgtcctcggctttataccctgaggcattgtgatgcactggggaaaagcattgtaggatattctgctctaggaggaacaggaacgcagtgtgggatattctagccagttattccttatctcaagatgttgcattcccagcacatttacagctattaagaactacaagggccaggagcggtggctcacgcctctaatcccagcactttgggaggccgaggcaggcggatcatgaggtcaggagatcgagaccatcctgacaaacatggtggaaccccatctctactaaaaatataaaaattagctgggtgtggtggcacacacctgtagtcctagctacttgggaggccaaggcagaagaatcgcttgaacccagaaggcaaagcttgcagtgagccaagatccagccactgcactccagcctggcaatagagcaagactcaatctcaaaaaaaaaaaaaaaaagaaagaaagaaaaaagaaaagaaaaaagaaaaataactacaagcaagaaatcaaagagagttgggttggcccaaggccacctggagaactgtcagccagcgcttgttcccatagaggtttttgcttcagcatgttgtgattctctgtatccctcatctgtctctttaatctggggggcagcagtttgccctgtgaccttacttctgttttggatctaagaagagttgttggtttttcaatttgctctgctttttatgtgttgttagaatagaatggcaacttccaagctccttacatgaagaaccagaaactacaagtctccataccatttttcaagtatggctttacatttttaaatgattgaaaaatcaaaacaatgatatattctgacatatgaaagctacacaatatcaaaatgttagggtccataaataaagttttattggaacacacacagcagagttaaatatggcccaaagcctaaaatatttactataaccctttagagaaaaatgtagctgacctgtgggctatgtgtgctaccgtaacagtgtgacactttctacccttcttgactagaatactaaaataatccaataattattttatgttttccaggaaatcaagtaaagcagaatattattaagaaacctttagttagaatttttaaattagaaataatttctttcatagtcccagaaagtatataatgggtgaagtatgaatgggtgaagtatgaatgggtgaagtatgaatgggtgaagtatgaatgagtttgaatttgcataactgttaacattatccatgtttcccccctctctatatatacacatatacacacacataaacacacatatacaccagtgatatcctctacaatgaaacatattaattattcctgtactttatttaacaccaaagtttcttgattttgtttttttattagtagatagggctattttctgaaccctcttaccaagtcctctaatgactttagagacaactgtatcttatacactttttaaaagcaaatctcccttccttgtccagtatgttgtgagcacagcgtagaacatttgataaagacttagtgacttgaattaaattacttgcagttaagtaaaacatcccaaatcatgaaccctcaattatcttgtctgtgtttaccatgtcctaaggcctttcaaatagaagtgacaatttaaaagttctaaaataattacagcaccatattgctcactataaagtacaactgtcaattacaaattcaattatcagtggccacttgtgaatctagagaacttcacaaatgttctgtcttgtagctgaactggaaatgtttttagggttgccgtttgttttatagttttaaatatttataacctgattaattattttcctaaaatattttcgttctagctaaaaaatgtgctaggaacaaacacaatacctgctgaaagtgacttttgtccctttcggtgtagggataaatgttatcccacctaaataatatgactcttgtttttaattaggtttaaagtaccctttgcagtttgacctttccctggaatgatccattttctatgctacattttatcatgctgccagtaatgtcatcaaaaacttttaaagaacatattaaattggctttaaatttatattgagctttaaaatgaaacagcattaggacattgtgcttctttgttttacacctgcatactcttaacattccggtgttggagactggaattcttttcactccaagtactttaagttaggaaggaaagaaggaaggaaggaaggaaggaaggaaggaaggaaggaaggaaggaaggaaggaaggaaagaaagaaagaaggaaagaaggaaagaaggaaggaaggagggaaagaaggaaggagggaaagaaggaaggagggaaagaaggaaggaaggaaggaaggaaggaaagaaggaaggaaggaaagaaggaaggaaagaaggaaggaaaggaagaaagagagaaaggaagaaagagagaaagaaagagagaaagaaagaaagaaagaatgaaagaaagaaagaaaactaagaagttatttatgctttgtacaacagaatgggcacacaaggattctaacaaggatttcaattctaatatcagcacttagcccctcaatgtctttgagcatgttaagttgcaaagcccaaacggccttatctgataaggtgtcattatcccttctttgcaatgttcttgttagagttagaaataatagatgtagtgcaattgtcaccataggccctcaataaaagatggttgttgttgcagctgttgcaatatgatcgaggtctttactgacccagtgaaaaccttctactgcttgctctaagaaaccatttccttcttcctaattagtcctcagtaaagtgaataagttattagagaacatggtctaaaaacaatcatttatattaggacttcatcgtgtagttgaaacgtcatgccatggcttggaaatatcatggaaatgtggcatgaactcttcccggggtggtaggagatcaatgaggagcattgggagccaagaaaagaagccaaaaaaaaaaatcattagaggaaactttccttctctcacccatgtgcattttgaattcaacatatcgttggcaggttttctttaggtcaaggacagctttaaagaaaactgttttagatcctccaactctccttcataaacctatcccactacatagctttacaaattgcctcttttggagattttcccagaactatcctcttcactctgcacacagcaagaaattagccttccgctcttttactattccgttcctttacaattcatgctacttcagtatacttaacccagaatttattcaagttttatgtgttaatttaacaaatatttatttagtgactacctttattgtaccagttaaacatataacaggaaacaaaactcaaaaacagttctgtcctcactgagcttatattttggtggaaagatacagacaattaattgaaccaaataaattatagtgtatattagaaaaggataagggctgtgaaaacaaataaagtaaggaaggggagtgaaatatactgggaagtagagtttcaattttttagaaacagcttccctgagaagatggcaatttagtaacataaccaaggttgcaagtcaggaggttattcatggtgaaagcaatgtaggaaggaagaactgcaagtgcaaaggccaggaggcaggaagatgccctgcatggtccaagaagataaaggaagcccttctggttagatcagagaagatgaagttgaatagggctggtgtggagggacctggagaatatctagactcttgtaagctactgaaaaaaaaaaatgttggcctttagtctgagtaggatgggaaacatttgaatatttgaatgaagaagtgaaatgatctgacttgtgtttttttaaaagctcattctaactgccacgttgaaaatggatgataggaaagcaagttgaaaaaggctgaccagttagaaaatattacaaatatccaggtcgttttattggtagggctagaaggaagtggttggactctgaatacgacgtgttaacagatggacgaaagggaacagtgacagtgagggtcatggaggacatagaggtttttggtttttgccctggagtattagaaagttcaaagttgtcataaattgagatggcaaaggttacatacagcctgcttttgggttcagtatcaggactgcaaatttaggcatgttgactttgggctctctactcatgattccagggaagatgtggaataggcacttgaatatagaaatctggaattcaggggagacatgatctgggggtgtacaacttgaagaattcccaatatagagatgatatttgaagttgtgagactgaaggagaatgctaagggagtgagtgtagaaagaaaaggtggaaagtctgaggctgatcttcatttgcactctaatattaatcggttggtgagagaggaagaagcagagagtagaagcagatgatggaggaatggctaaggattggtgtaaaggcctgcaaataaaatcgtgtcaaggaacagtagatgaacaagtaggtcaaatgctgctgaatagtcattaagatgaggactgaaaataatgatgagcctaagaaatgagttggtgtgcctgtatggagtagtttcaagaaagaatgaaagtaaaaagctattgaaaccagagaatacagattcttacttttgaaagtgagttttgctacaaaggggatcagaaaaattgggtaataggtacagaggaaaacatggttatgattatttttaatgaaagaaacgtgtttgtatgataatggaaatgaatcagtggaggctaaaacagtcagtaatgtaggagaaagggggaattgctggagaaatttccctgagcaggaaggggaaaggggctataagatctggtgcacaagagaaggatccagctttaggagcaaggacaattaatcttgttaaaagagggaagactgagcagatgactcactggttagatgtaaacagcctctcagcctttcttggagcattctcatttagatataagatactatttaagtaacgaaatatctaatcatatcatttcagtaaatttaaatgaagaatttccattaggatatggaactcacttttttatttttttattatactttaagttctgggatacatgtgcagaacatgcaggtttgttacgtaggtatacacgtgccatggtggtttgctgcacccatcaacccgtcatctacattaggtatttctcctaatgttatccctcccctagtcccccaccccccaacaggccctggagtgtgatggtcccctccctgtgtccatgtgttctcattgttcaactcccacttatgagtgaaaacatgcagtgtttgggtttctgttcttgtgttattttgctgagaatgatggtttccagcttcattcatgtccctgtaagagacatgaactcatccttttgtatggctgcatagtattccatggtgtatatgtgccacattttctttatatatatatatatagagagagagactagatagaaactcttaaatcctaatatgcaaatctaacctgggaaaaccattacactggttaaaagtagcccatttgggatgcacaaaattcatttttttccttatgcctgacaggacatccagcaactccagtttgtaaatgagcttattcatttgaactgggatccatagctttactcaagaatgaacagcttggttcatctctccttgaaaattgctgttagaattaaactccttagtcaatcttttaactcaactgtttcaaaactcctttggttttgaatcaataaaagcattgaggatgtggcagttgagcagatgggtggtccacttggtaaagctttgttatctccatgtaagccacaataaaactctgacctgacaaaaagaaagtgtttacacaaatcaaaacagaaacctctatactataagttacacagtgtttccagttggtatctacaagtattaatgcagacacagtgacaggtttcaaataaacttgatagaaaaggccattcatattttatcatgttgggttgatggacttacaattgagaacaatgttttactcaagcttagtgaaaactcctaggtagtaatcaatattctcagtcaccattgcattgaaaatatgttcttgtctatgtcgacaaaggcatcaaattaaacttgcaaaggtagattattttttatcttttctcctgatgtaacaaatacatattataactgaaattgcaatataataaattaaaaaataaatgctattcagatttgaaagaaaataacgggacatctaatccatggctctattaatgctttatattttgtggcttaaaaccatctttctaaatattaaatataaattctgctaaaatagtgagggggacatagttgaaacttactatacatcaaactacgagtttccaatctttaagcaaaaatatagttactaaaatgttgtttacaaattatttttaaaattttaatactgacatgcaattaaatgatccaaaggcttcatacatttaccacatgttaaatgaagaacacgcttttgaagaaatctgaggtttcataaactgttatttactgagtttgttttgcatccaagatctcaggaggatttaatctttcatctgtttttcaaagcctcagttacattttattttttattttttgaatttatttatttatttatttattttttgagacagagtctctctctgtcaccaggctggagtagagtggtgcgatctcagctcactgcaacctccgcctcctgggttcaagcaattctcctgcctcagcctcctgagtagctggaactacaggcatgcaccaccatgctgggctaatttgtgtatttttagtagagacggggttttgccatgttggccaggatggatttgatctcttgacctcgtccatgtcagcctctgaaagagctgggattgcaggcatgaaccatggtggatggcctgaaatatttaattgacataacgattatacatatttaaggggtaaaagaagatttgatatacatatataattatcacaatcaaagtaattaatgcatctatcctgcattaattaatccaggctgtacattagacctctagaacttgttcatcttataactgaaagtttgtacccttgaaccaacatctcctcatttactccacaccctatcccctgacaaccactattctcctctttgtttttgtgactgaacttttagattccacatatatgtgagattatacactatttgtccttctgtgtctggctcattttacttagcctaatgtattagtctattctcacactgctataaagatactacctgagactgggtaatttataaagggaagagctttaattggctcacagatctgtgtggctggggagacctcaggaaacttacaatcatggtagaaggcagaagacaaaaaggaatcaaagcacgtattacatggcagcagacaaaagagaagagtgaagcaagcgggaactgccaaacacttttaaaacatcagctctcctgagaacgcactcactacaatgagaaaagcatgggggataccgtcttcacgatccaactacaattcaagatgaaatttgggtggggacacagagccaaaccatatcacctaatgtcctccagtttcatccatgttgtcacatatggcagtgtttccttcttttttaaggctgaataatattctattcaatacagcacattttctttgtccattcatctgtgactgacacttaggttgtttctattacatatcttggctcttgtgaataatgtggcaatagacatgggagagtagatatctctttgacatactattttatttccttttgatatatacccagaagtgggattgccagatcacgtgatagttctattttaaggtttttgaggaagctccatgatattttccatagtggctgtacaaatttacattcccactaacagtgtacaagagttcacttttctttacacccttgccaacatttattatcacgtgtctttttgataaccatcccagcaagtatgaggtgatacctcattatggttttaatttgtatttttctgatgattagtgatgctgagcatctcttcatatacctgttggccatttatatgtctttgctggaaaatgtctcttcaggtccttggcccatttttgaatcaggttatttttaaacattgagttgtgtgagatctttatatgatttggacattaactcctcatcagatataaggtttgcaaatattttcttccatatcatagattgcctttttattttgttaattgatttttgtttttgtttgtgatttttgctgtgtggatactttttagttttatatagtcctgcttgtttatttgcgcttttgttgcaagacacaaaatcaacatacaaatcagttgcatttttatacactgaaaacaaaccaactgaaacagaaaataagaaaatgatcccatttataatagatagcattaaaagaacaagagacttaggaatacatttatccaagaaggtgaagatctgtacactgaaaactatcagacatttatgaaagaaattgaagaaggcacagataaatgaaaagatagcccatatacatggattggaagaatcaatattatttaaatgtacatataaaccacagcgatctacaaattcaaactagtcatcaaaattccaatggcgtttttcacggaaatgccgtttcacagaaatgccacagaaaagacaatcctaaagttttaatgaaaccacaagactgcaaacagccaaaacgctcctgggaaataacaaagctggaggcatcacagtccttgctttcaaattatgttacaagactatggtagtaaaacagtatggtctggcataagcacagacacagaaatacaacaaaagagagagcctagaaataaatttacacacacattatcaactaatctttgacatggcaccaaaaatacacaatggggaaaggatagtttcatcaataaatgatgtttgggaaaactggatattcatatgtaaaagaataaaattagactcctgtattatccaatgtaaaaaattaactgaaatggattcaagacttaaatgaaatatctgaaaccataatattcctagaaaaaaacgtagggggaaactttctgacattgatcttggtaatgacttttttaaaagcgtttatcttttctttttctgaagaacaattattgaaaccaccatttcagggtgatctgtaactggtaagcaaaataaaccatgtaaaagaggagaagccttgagtgtagatgaatgtggtttctctagttcaatcataacattaaaatttcataattaaagaaaattagttctattatttctgtatttatgaacaaattggacaaactattatcttccaatctgtaactgtacatgggcttttcagattgattctacctaaagaaaatcaaaacgaaggtttatatattccttcagtaaaatcactcatagtttcccttatttagttagcatggtgtctttataaacagatgacttaaaagtgaacagaaaatggagaacaaaataactcaggatcccaccttagagataaagctctcatgactgttttagcagggttaacaaacgttccctatttcttccataagttaggctgcctgggtccatgacacggcttgatggacagggtgatccctagtcacctgtgcgcagctgctgcttctgccagctgaactgttgactcacagagtctgcaatatttcttttcttacattaaatttaagccatctttacttgctattttaattccacaatttaacaaattataacataaccctaataaaatgtgatatgtagagaaaacaaactttgtcatgaacacctactttaatgatttgtaaagactccaaagtgttatttaagtattatattaaagtattgtggtgtgagaaccataaaattttgaccaaaaaagcaaaaaaaaaaaaatgcaacaaaaattaatagagacagttgactactggtcacactctaaagaaattgttaatattatacacacacatacacatacacatgtaatttattttttaaatactatgctgcagtgatccaattataccttatttgaaaaaaggaaaaaagtcttatataaaaacattgatgaattaatgaaaatgtatatgtctaaaacaaagatatataatttaaaataattttcatcttttatcaaatattttgatttactatcagtcttgatcatattatttccatgacagtaattatttgctatattcactctaaattcactgtctttattacatctctttgtaattattaatgaaaatattccacttttaaatacctatgtttcccaggggttgctttgtgtaaaaaatattagcatgctacaaactatgagctatccacagtaaaaaaaaaaaaaaaaaactcaaaagaaaatctaattgctattttattcatttgattttataacctcaaactcacagaatactgaagaataaacttttctcctgattcatttgcaagtaagtgggcaagtttccatccatcatctccaaatacttttgtgtctgttttctacaagcaagaacattattctacatatccagattacatccatcaaaatcaggaaattaacattatttcactagttctttctaatcctcagattccatttgagtttcaccagttgtcccaagagtattctttttttttttttttttttttgagaagaagtcttgctctgtcactcaggctggagtgcagtggcgcgatctcggctcactgcaagctccgcctcccaggttcacaccattctcctgcctcagcctccagagtagctgggactacaggcgcctgacaccatgcccagctaattgtttttgtatgtttagtagagacagggtttcaccgtgttagccaggatggtctcgatctcctgacctcttgatgtgcccgcctcagcctcccaaagtgctgggattacaggcatgagccaccgcgcccggcccagagtattctttatagcaaaacgatgcagttcagagtcacatgttgcagcgagtttcattgatccttaatttccctcagcctgggagattgctgtctttccttgacactcaagactgaaattttatcgatgaggccgtttgttttgcagacttggtcttcatttgggtttctctcatggttagtttcaagttttgcatctttggcaggaatatcacaggagtgatcctgtttcatactcatcatgccaagggctgcacagtttcaagccatcccattattgtgattatttgatgcagacgctttgatggttaatgttatgtgaactgagctaggacacagggtgcccagacatttagccagacattatattctgggtgcttttgtgagggtgtttcctgatgaattggcagactgagtaaagcagaaggggctccccattgtggaagagcctcatccaatcagttgaaggcctgattagaacaaaaagactgactcttccccgagtgagagagaattcttgcttgctggccttgacttagacattgtttttttttcctgtctttggactcaaactagtattaaactataggctttcctgggtctccagctttccagctcacctggaagatccttagacttgcgaggttctgtgattacctgagacaattccttacaatgaacctttttatagagatggagtttttggtgtgtgtgtgtgtgtgtgtgtgtgtgtgtgtgtgtatttacatatacacatacacgtgtatcctatttgttctatttctctgaagaaccctgactaatacaggtgttgtgtaccagacttccccactatgagaatgccttttcccttggcaattagtatttttgtggaggtactttgaaatataaatgccttctcctaatcagatctcacatttatttctttatgtacttatatcggtatggattaaaagtgtcctattttatttaaggtgtaataatccattctcgcttctattttttcacactgaagcccacattgttccagatttaacccatgggagccccttccagcaggtgtctgtgtcctttcattatggtgctatcatttcgtgagtgtcttcctgctttctggcagtaaatgttgttccaaaatcatcttgtattttcccaacttggaatataataagcccattcttcaaggtcctcccagtagatgcccgagggactacatgcacatctgtgtgtagatgaataacatacttattcacaacaatacttaatttgctacttttaaatatgaaagaccgtgaattcacacaagtacttccaatgccaacccaatgtcatagggttcattccagtcttcctctttgacataatttgactctcttttccaactggaaaaatcctggctcccattgtctttgatatacttatttatatacttaacccccagttataagcaatttcttgtcactactgctgccatctctccatgtctggataccctccaaacctaactcaggcactgacctccccactgcaggaaactccccctactgcagggacgctgtcttcactaacacttcatatcaagccattctcacttgagaaagcctcttcacctgctcagactctgatacgctgtgtgggctgcccccattccttggttgccctaaaccccactggctctctgattttccatgcctggctaattctctatataactgtgcctattctgctgtgtgtcacctactgagttttcatttcaacaattacattttattttaagcttgtttttttttttttaacagtctatcctcctttaaacatttcatgtacttaatagtctgtatctgatcattccaatttcactggagtctgtaaattttgtttattgtttgtactcactctcacttgtcgtattccttcaatttttttttctttttggttggttttttttttcttttttaaatcttaacctgtaaaaatcccaattgtctaaattgagagtgctttctctagaaagaaatttctattttattctgctcggagctgggggcactgccaacaatctagtcaactcctgtatgacttattttgatttgatagcagaaacctgggactcaccttagagttctcctatccccttatctcccacatccaattactcaattcatccaactccacttcctaaaatcctcccatccagtaacctaaagcaaccctctattgctcaccttccacaatgctaaagactgatgtaaaaataaaccttaccctgtgattgccatgcccaaaattcttaaaaggctttaggtaaaatttataccctttggattgtcaaaaacatgatgacttaatcttttcttgtctgcgtatctagccacctatcatgccacttcctttagccttcacctcctcttttttttttttttttttttttttttttttttttttgacagtgtcttgctctgttgcccaggctggagcacagtggtgcaatctcagctcaccgcaacctcagactcccaggttcaagcaattctcgtgcctcagcctcccaagtagctgggactacaggcacatgccaccacaccaggctatttattatttattttattttaagtagagatgaggttttgccatgttaggcagtctggtctggaactcctgacctcaggtaattcacctgccttggcctcccaaagtgttgggattacaggtgtgagccactgtgcctagcctagccttcacctcttgaattgtactctggcaataacagactctgttgttttccaaatgtgccaccatatttctgcacatgcccagggtaacctgtcttctctaactagttcaagtgctggctccactttgaagagtgtatcttatctacaactccatgcagctcatttcactttgcgttatgaatgcttatttgaatgcctgtgtttataatgaagtgcaatttctttaaggtcaggggtcatgtctattcacttgtgcatttccagtttctattaaagattaacatggaataaattctcaagaataatggctgaatccacttccagcatgcaataagcaattactgctggcatttgtacaagtacacagtggtggaaattcagtcatatgtacatttctatcaactattactaaagcagaagtattatgaaacagttaaaaaatatacatgggttatgattatccctgttcattgaaacagtcctggaaaaacattttttatcaggttgtaaacactcactttaaaaattaataaaaagttaatataaagtctagaaatttaaattccatgggatagtgctaatgacaaaatagtagtagaccctaaattgtgaatttcaattttgaatttcaaattttgttttgtgttttatttttttgagacggagtctcgctctgtcgcccaggctggagtgcagtggcgcgatctcggctcactacaagctccgcctcccgggttcacgccattctcctgcctcggcctcccgagtagctgggactacaggcgcccgccaccacgcccggctaattttttgtagtttttagtagggatggggtttcaccgtgttggccaggatggtctccatctcctgacctcgtgatccgcccacctcggcctcccaaagtgctgagattacaggcgtgagccaccgtgcccggcctcaaattttgaatttcaaaatttagggtctactactatgattgtcacgagatatagtccaaatttcattcctacaaatatgtgtgcagacacacacacacacacacacacacagattttatctggatatcctctagttgctttaattctttctaaatagtcatctaaatcctgatgaagcaggagataggtttagtgatggtttcaatggaatgctatcgaaaattttcattttgtttttttttcacatcagaatcaataaatgttagccaactctcctgcttaatcgtcccattgagaatatattttatttcttagtgtctgtgcctaatatagcctgtttatatgaccacactagaagcttgagatctagtcctacttattatttcttcatttagatgtatttccagtaaacgtaattaaattcaagctctcagatatttctttcattaaccatttattctccctttctgttatcagatacagattcagcaattaatttcctgattaataacaattgctatgaaagcatcattcagtccactaagttgctgtgtttctagaagatttgattcaaaggtttgttcttatttctggcttcaatatccattgttaagtcttgccctagggtagaccacaagagatttagagcaactaaactatactaaattggttataattcaatgtagtttaatatacaaggaaatggataatctatttaccatccaactcaaaagaagaaagaaaaagagagtgagagtgcaggtcattttataggaaaggaatgtttttaagaacctatcaaagattctctcagtcagtagatagatggtatgcaaaactctgcttgataaaaacattgcaaaagtgtttttgtactttttttgagtttacatctcaaaacctgctcactttcgggtgtggtggcttacgcctataatctcagcactttgggaggctgaggtgggtggatcacaaggtcaggagttcgagaccagcctgaccaacatggtgaaatcccgtctctactaaaaaaaaaatacaaaattagctgggtgtgttgccggtcacctgcaataccagctactcaggaggctgaggcaggagaatcacttgaacccaggagacgggggttgcagtgagctgagattgcgccactgcactccagcctgggcaatagagcgagactccgtttccaaaaaaaaaaaaaaaaaggacactttattggtacgcattcatgactgtgcatacatacttaaagttaataaccactctaatgggcatagaaactttctgaaaataatgactatattatgaaggacaaatacagtacagtttaaggaatcttgcttaataaatatttaagggtttcattgccatttctagaagttaaacagaacaaaacacattgtaaattctaaactattcctgcaacatgattttccatgaatctacaacataccgtattcattttatagatatcatcatcctcttttcagtaattgaaagtattttccacaatactgagtcaagtggcgatatgaatatgacaggtgtgagctccaagtcgtaatgcatctttttcatatataatattttttatttcaaagtttttggggtacaagtggcttttggtaacatggatgaattatacagcagtgaattatgagattttggtgtatccatcctgcaagtagtgtacattatttcatctttgccacttcctagccaagtgattttggaaaagctgataaactttttatgcctcatttttttaatccatagaacgaggacaaccatagtatttagcctggcaacatagcaagatgccgtctctacaaaaaaaacatgaaaaacaaatcagctgagtgtcatggcatgcgcctctcgttcctgctactcaggggcctgaggcaggaggatagcttgaaccctggagagttcaaggctgcagtgagctatgattgtgccaccgcactccagcttgggtgatagatggagaccctgtctctaataaaaagaaaatgcatagtatttattttataatgtcgtggcaatgagcaaatacaggtaaaccagtcacagtaaaatctcaataaacaaggtgattagctcactacacatctacataaaacataataaaacaaaacaactttatttcctattttccttcccaagctccaggcgtttcacttccaattttggagtgaacaattaagttaattacttactgtgatttcacattacctacgtttgactcagctgtctatctccatagcctctgtggtgttcgagttccctcagtgtgtcacctttctcattgtcttaggagttttcactgcaggagactctgcagttacggagcccacagcactgagtaggtctcagccaatgtttggtttggccagcagcagagtactgacatcatgtttattatcccaacctcactttgtttaattacatatttgtaaaagaaaacaaatactgaagatatatataaaaattctgtgtcgaagggcattatttctacattatgactcctttcatttaaacatacagacatttggtaccaaaaagaaaatatatttgagccttttggattcatttatttgggggtgaggtgggacacttttatttcagtgtcatctgttttctcgattttgtaaaactaaatggttccatgtttatttgtatggttgaataaacatcataatgcaggtgcaatgcccagtttcaggcagtagagcatctgtacttaaaagaccatcagatttgtattaagctgttgaaatttgactgcatagttaggatcagacgttgcttcaaggtacaagaatgaagcaagtcaatctttaacaacgtttctctctgtcatggaggcagctactgtctttaagagcaaggacaaacacaattttcactttgttagaattctgggtcattctccctgagctctttatatcaaagcaatggcatctctggtcctagatacaagctctaattgtttctccttttagaaaatcatttttctctgccgggcgcggtgcctcttgcctgtaatgccagcactttgggaggctgaggcaggtggatcagttgaggtcaggagttccagaccagcctggccaagatggtgaaacctcatctctactaaaaatacaaaaattacctgggcgtggttgcatgcgcctgtaatcccagctactcaggaggctaaggcaggagaatctcttgaacccaggaggtggagcttgaagtgagccgagatcgtgccattgcactccagcctgggtgacagagcaagactccgtctcaaaaaaaggaaaaaaaaaaaaaaaaaaaagaaattgttttgctcttttcttccctattcttaggcttctgaactttttttgttgttgttgctctctatccttgcaactcctcatttcaatgttgaaacaactgagaggtgaagtcttcgtaaatataatctagaattgctagataaaataagaggcccagttaaatttgagtttcagataacaaatgatgttttagtgtaagtatggcccatgcaattcaaatttgacttggtgtactgtgtttttatttgctaaatctggcaagcctaatctcatatctagttattgaaacacgtttataaagcagaatgatgtataaaaaaatctgagttcaaatatgttcacttttatttcttcgcaccatgcaaaactgccgactgtcctcttggatttgaatttccttcttttcctgattttttcatcgctttgtaaatgtttttctttgactttctctcctccttacaatgcaatcgactttatcattgtttcttcagtgtcctgattcttttattctacctcaacatctttatttccccattcattcttctttgtgaaaaaagaattccaaaatgcttattacctcagtattttctctgacacaagtttgttaagaaatactcaaatttttaatacaggtctttgttctactgaaaaacatttcctttgccaagtttagactacattaaggacaaatatcattgctgtagtccatgcacccagaactctgtaataaatagtagtacccgcttcttctttacatgtgtccagttctgtaacttctatttgggaatttttgtttaattataatccatgtgtatattccttgaaatctgtggtagtatgacagaaaacgagtcttcatttggctggtagattctctagcctttcccttttcagattattttgcatcttattgccagctttttaaaaactggtaccccgatcgttttgctgcctgtacctcaaagttttccttatcgctcttttgatcaaatataaactttaaattcttccatttattatttcttctttgactcgcaatataccccattctaatttggaactatttaaaaataaggctgctaactagaagtctctgcacatttctctacccatcccaaaagtttggtccactctaccttcctcctaagtaaaaagttaacaattctcctttccttaccattaactttttaaaatcacttatgagacactgactttgatcaacccattgatcttttttcaggctaccattcttatgtactttaacatgttttgatgaatttgtggtcattataagtattgaatgttgtattccacactatgctttgcatttttttttttttttttttttttttttttgagagggagtcttgttctgtcgccaggctggagtgcagtggtgcgatcctagctcactgcaacctccgtctcctggtttcaagtgattcccgtgcctcagcctcccaagagctgggactacaggggcccaccaccacgcccggctaatttttttgtattttggtagagatggggtttcaccatgttggccaggctggtctcgatctcctgacctcatgatccacctgccctggactcccaaagtgttgggattacaggtgtgagccaccgcacccggcctgctttgcttttttaaatgttgcaaattagaattcttttggttatcttatctaattttctatttttatgttatgtgtcagatagtctggacttacaggaagacctgtcctcttccagcacgcacccttcctcctcccccatcattcccaattcacatgactttctaactttctaattgggtgctttttaatattcatgagcacaggttttaggtcacacagctttttataattatgggaaaagtaaaggtaaatagtgggtgggtactcaaggagctcacctacaaatcaacttgattcaatctatttaatctattgcttatgttctgatttttcatcagtgtcctggtcattgcttaacaatgcaaaatttgtggataaaaatattcatgttaggtgaagctcactgactagcctacaaatcagtgtcaccaattttgatacattttatccacatctccattatctggttaacatatcattttgcaaaatattaaaagatcttcaggtcacaaagggctgtcatgaacaaagtttcttctttttttaaataaactgaacagtgttactatctagttggcaccaaggacacactaaaattgtaatttataattatggggtttttcctcacagaaataaaaataaataggtcttattgaagacatagacagttttgcttctgtgaagatttctcctttacacataatcagtctgacttttctcactcgtttctgcctgaggtggaggtggggactccattcttgacttaataaatctaaattcttcaactgtcattctctcccaagacacttcaccctttggggactatgctgcattttcccattcttgctctttgtacatttcatcctgggtctggcaagacctatttcaaatatacaaagttatctgatacacacaggaacccaacctactctccacagagtgtggaagggttaaagaaaagccacttctgaacatctccgctttatcagctcccgttgggagatcaggggccagcagccttcattagccaataaaaagaaaatgacgtttctttgcaaggagtagactttactaagcaccctatatgttaaaaaaatatatattaaatgttagtttttgtctccaaaatagatatataattctcagatttccttgtaattttctcttaatggctgattaaatcttgacaatataaagcagtccagtcatccacccattcactggacaaatatttcttccatgtaaatgccaggcaccagtttaggtcctgatgatacaccaatgaacaagaaagatgaagtgatgatccaccaggaacttacattttagtgggagagatacacataacaaataggtagatgatatgataagcagggtaagtagatggagagcagatttttaagacttctgtgagctaagacctgattgaagagaggttgtaattttgtggtgtcagcatgatcaggccaagtaatcacttcctattgcccatatattttttaatcatttgtttaaaaatataatgcaaagagatagttctcagactgttttctcatatagaagatacttatttcttagattcttagtactactcattttaataagctatatgagtccacaacattaaaaaatttactctagaaagtaaagctgggtaaagtgacctcagtgtagaaaacttttattatatggccacaaaaggcactgaaaacgaaatttctagagggccttaggggattaaaagggaaatgtttagaagacattaaacctctggaggtttaattttgcaacttccccaaatacttagacgacttcaaaaataattttgcttttgtctaaactcagaaattatattgttcttttttgcccttgctggccctcagaagagtattaattctcattttgggaaggaattattttaatcatgccattaaatgagaggaaaatatcccttttctaaaaaaataaaaaattaaaaataaaaacctcggtgtaaagtggaattctctagagaatgcattgtgcacaaaatgaccttcctcagtgtattactgggatggagggagtcgtctctctgtggggtagcaaataagccctgtggccccctcaatccacctcagcctccacagagcatcagttgctgtttcatcccgggttggtccagacagccactgccagtccactagagggagcacttgagaggaaacccatttgctttcattgatctagatctcaaataaaatttcatcttagaggctgggcgcggtggctcatgcctgtaatcttagcacgtcgggaggccaaggtgggtggagcacgaggtcaggagttcaagaccagcctggccaacctggttgaaacccccatctctactaaaaatacaaaagttagcgtggcatgttggcagtaagctgagatcatgccactgcactccagcctaggcaaaagagtaagactctgtctcaaaaaaaaaaaaaaaaaaaaaaaatttcattgtagaataaaatccaattcctttcagcttttatcttcaaattttggtcattgtttgcattagtcattgttcttcaggaaaacagaaccaataggatatatgtatctgtgtgtgtgtatacacatatatatgcacacatgtatatatttatatatacaaatatatgcatgcatatatatttacatatacacatatttacaattctgtaaaatcttatatataaataagactcacacatacacatataacgtgcatatatatatacacatatatatggcatatatatatatacatatatatggcatatatatatatacacacatatatatggcatatatatgagatttattttaaagaagtgactcatgtaattatggcagatagcatatccaaaatttgcaggtgggccagcacgttggaggcccagggaagaaagactactgcaaatcaaatctgaaggcttgtctgctcactaaatatcctcttgcctggggaggtcaacctttggttctgttcaggccttcagctgattggatgaactctcctccctctaccctcacctcaataagaaggatgtcttagtttctccaggcttctataacaaaatagcatgcaacagaaatgtatttctcacagttctagaggctgggcagtccaagctgctggcagattcagtgtctggtgaggtcccatttcttggttagtagagagttgtctttttgctgtgtcctcatacgatggaagaggcaagccaattctctgggcctctaagggcattaattacactcatgagggttctgttctcataatctaatcgcctcccaagagtcctgcctcctaatatcacattagtgactaggcttccacatatgaattttagaggtacgcaaacattcagatcatagcagaaggtgatttgctttactaaaaatcagcaacttaaatgtaaatctcatcctaaaataacctcacagaaatatccagagtgatgtctgaccaccatggcctaaccaagttacaagataaaatcaaacatcatgctgtttctgtatagtgacactaaaaatagttgctaaaaacttgtatgacaaaatagaaaaatgaaagaaaggcaaattattttggaaagttacagtaaagaacataatctaaacccaacaaaaaagtttctgagactcaatcactgaacagagttggaagaagcttttattcacttcattccactgtatttaacaagtctctacttcagtccctgtggggtttctaatattataaaaagtaatatcataggttataaagatttagaaagagtgcttctatttttgaaatcaataatccagctaggacatattttctagatattattataacatttttacattaaagataatttcttgttatttgaattttatttcccctctcctcggggttcttagtaatacaaatgagtaaaattgctttcagtaggatgctagacacattgtactgtttgcaggtctgctaaacaacagaatcaagtcacctccttggcaggtgaccagcattaactataatgcccatcaaaacagtcaataagaatcacagatctgtggcaccatagaataatggcctaattaatctctgttcaatttccatttttatacctgctcccagattcccattatttcttatctatgagttcttttctcatttgaaaacatcttctatggattttccttcattcaatcagttgtttttacattcattcatgtttgcattcaaagatatttactaagaacttagtataggttatacatttatgaatattattcaaacactgaagataaagattgactgattaccacagtggacagagatacattgctgttaaaaaaatctgagtcctttaaaagttttttgtttatcatttgcaagagtatatggaatactgaagtttcttctaataatatcaaaggaatagttaaaatgccatagggactaaatgttacatatgtaaagtaacatagccatctggtctgtttcattcttatttccttaggagaagagtgttaagcatgctctaaaacatttattgagggcacgttttatgcttacgtttaggttcagttttaggtatatagaaattttaaaaggaaaaggaaaaaaatttttaaaaaaaggtataaggggatgataaagaggaggccagaaagaaaagaaaatacagtttctctcctttcaattccttaccattactttaccattcttgtgtggaagtgggagggcgtatccacagaggggtagaaataggcaaataccacataaaagggataattgcaggttggataaccgcacacattggaaccaaaactgcttccgaaaaggttataggatttagatagtgccaaagactaagtctgaaacacatttaaaatagttgtttatttacaaaatttggcacaggtccccgtctattgctacttttctgtcaacagaggtttaaagtttttagcagtgaaagttttatatagttaaaagagactgagacaatctctggaaagcattttattaccatgggattcccttttttgtgtgtggaagtgggagacctcctaattggtgttcaggtacacttcgcagtcttggttgagtgcaaggaggcaagtgagcagcatggagacattcaaagacaggaggattgtcctgggttagggtcagtggtattttctccatccagctattttctgtaacaaaagggtttgatgagttacttttcttgtgaccaaactctcttaatagtcccttatggggccggtggctgtcatggcagtttgtcattagtaaagaagttgagactactctagtttggcaaacaatatgaataaagtgacaaggtgatgatgagcatgcccatagtcttgctatttaaacaatgattattaggccactccagtgaaagataatgagaaatagaacttctgcttacagaagatgaattttgaatgcctaaggtttaaatttagatttgatgggatagaactttgcatattatttacatggttttgaaaacaggcatgaagagagaacaaggttgtaaggagcttaggacagaagagaccaagctgtcttataattgagtcaggacgaagcacaggaatgttactttgaatcaatgctggccttaatggtccactgatctatgggagaagaaaaaaaacttgatatttaagcattggtggaaaacacacacacacatacaaaatttctgaataccagagactgagggaaatttgtacccaacctaattagttgaaaatacaaagcaagtttcatcaatatagcttgtatagggttaagaaaaatacttaagcattacatgattgctgtaggagcccattttttggaaaatttccagggactctttgagtcaacttgttaaaaacagaagaaaggctaggaaagaaatagcttgttttatgcctgtgattataggatttcatcattatgtgggccactgagtgttattttctcaagttcatgcatatgcagagatttaaactaaatttgtgttctactcaccacgttaagaggcacaagttatcaaagttactaccaatacattctattcccccgaaagacattcaaaccataattctctcaagttaaaaaaattaatattttgtaaagtaaccattgtccctcttctcaatataatccaagtgctaacacctttgaacacaccaacaatggtctcttgattaaaaagaaaccacattaggaaagtcctttgaataacataaattgtctcctataataaaggaagacattggaggtaaaaaaaaaaaaaaaaaaaaaggtttcagcaccaatcttcaatctctctctcacaccacagaagattcagagctggagttgggaaatgcagtggacttgggtaaactgaggttttcagtcttcatactagtcagaggtcataattgattgagtccagttgtgatataactttgggcagtaattttagtcaattgcttcctaccaaagttccgtgctctttgctggaggctccgtttctgaaaagctctccctctgcccttctttctttttctctgcacacacaaccctcacgcagctttcatgctgcctaaatcagcctgtggattaggtattttctcattatccagattaaaagacagctcagtctcacagagatgtaactgactatttgattgaaactgacttttttccccattggaggcacatcagaatcacctggaaactttaaaaattctaataccagaccatagccttccaattctgattgcgtggatctgaatggggtagttccctggtcttactcttcacaagctccccatgtgatgttaacatcagccagcagaggctgcgaacacccataaaaacaaatccagatatgttaatagatgttagggaaagtgggagaagagggggtggtggatttgcaaatgttaaacttgttacccaaataacctctccaagtaaaacttttggaaggatagttttgatcaagagaacctgcccctttttggatctctttcacctgcaaggagaaaaaaagtgagaaaaggaatcagctttttataataaaaaaaatgcagatggagattccgaagtggctcttcagcgtgaggatcgaatttttacagggaaattccctctgaaatccttctagaaattcctgctatatcatctcccacttacataatcattgccccttatccactaagcaccccccacccccccatctgacagtcttgtcaacctcatgtgtctggattctcagtcttagtacagtccctctttcgggggagggagagctttggagtttggaggagaaggaggaaaagtgtgtgtctggcctgaaggtgatgatctaaaagaagtttccactgaagaaacacatctgggtgtttcacaatgtggctccttgtatcatctacatcacttggaaacttgttagtaatgcagattctcagacctcaccctggacttacaaaatcagcaatgaggggctccggctgagcagtctgtccgagcaagtcctccaggtgattctggtgaattccagtgcaggctaaagtttgagaactactggctatctcatgttttctcttgagcttctcttaccaaccttgggttgctttgttcctgtttgttttatagagcttttctttatagagcacccttggcataagtagctccatcttagaaaaagactccatcttacattttaaaagccatcatgccaacagggaccaggtgttcggctaaccaatagagactgcacccaaccagataaggacataatcattcacaccctttcactattagtcctcgctagaggactctgtggccataaaaaagagcaggatttcaccaattggaaactgctgtcttagcagacaccatctttctgtcccttgtgataagtacccagcatcccctgccgaagactctgcccacattaaaatctcttccttgcaagaccctgatggaccacctggatcaggacgaggcattgtttggtccacattgctctctctgaactggtttgttaacccttttttcctatctcctttatcttgatgttaaatgttactttgttgtggaatgtttagtcaaaacagataggtaggtaggtaggtaggtaggtaggttatgtgtggtttgcaatattgtctgacctgtggagtgacttgagcttgtgtgcctatggctctgccaagtgaatgggtagcactaaagagaattacctcctctggagcttcaggtagctcatggctttgatgattgaaatagcattggtgaaagtctgacattatggaaagacacaaatatttgtggacttggtcatgtctgactgtgcactgctcatgataccttcctattacttcgcctagagcctgaatgggaaagggagaggcaagcaactgaccaactagcaaacaaataaaatgaacctactgtgaacagaaaaactatttctgcccatagtagtggcttattgcagatacttatcttcagtttaaagttatctttgagtctctatgtttgtagctggaaagatgcagatgttttaaatcaagaaagttggacaagtttgttcctaatattccttccaagtttaattcaatggatatatgagtttggggattaataaaaaaaaacagcaaggagtaagaatctttgggaatataggaaaaagtgctgtattcaactgggaaatatctacatatttaaagacaacttctcagagaagatgattataagcccacattatgttttatttcaaacgtgctgttggatgaaaagttgctgaataagctgaattcaagattctcccctaggtagaaacatttgggtgaggggtggtggggagaggtcatacaatgaagaattgtctggttaaagattaggctacttgtaagatggattaaagatgtaggcaagtttcaaaactgatagtcagctgagtggatcttcccagaaaggatctttaagtatcatgagagtttatcagaaaattgctcaagtgttttattaggaattctaattattttcaggaagggctgtgaattacatcttgcaaaaaagctctgtctcccaacaggtttggtgacatttattttttctcagtttctagtctcatctcttctcacattttatcttttgttcacttttagtaagtaattttaacttcctggatttcaattgcttcctctataaagcagggataataatttcataccataatgaaataataaggctagaaaaataatttttcttttagactgttccaagttttgtaactgactaatctaaattatgcattggggggaaggtgatatgagatgtgcttttcagtccttggattcgatactaattataataccaaactcatggtagattgatttattctgtcacatatctatcaaacatttgcagtttctgctgttatgtatgctttatgcattttacaaaaaatcatcccaattacacaattactctatgatgtaggtacaagaattatccccattttatagatgataaacctgagacactgaaagtttaaatagctagcttacactcaacagtgtggtatgtggtttgtggcagaggctggatctgaactcaggaagcctgcctcttgtgttcaacaaacaattcactagttgatatcctgtcattccacttgattctccaaaaataaggttgggccttgtcaaggatcaaatgaagactggtaatcctaaagaagttgaacttcagagagcctcagtgggagagaataacatgcctagtccaggtcgttaaaacttagattattttcttacatagtattggctactgcccgttctgatgcttgtacatttctgttacggtcctcggtctctggattgaaccttatccactagattggagcataggcactgtgattcaccatgttattctggaatctaatatagaaaatgacccagaagcaccatttttaacaaacctgggttccctagccacgtagaagcatcagccagatccagctggagccaatcctgctgattagcttaacaggttctctgttttttttttttttttttttagaaaaagataaaatgttacaagatagaacatcgtcttattgcttcttttgttttattgcccctgccattttcttagagcattaaaaagaaatcactttctcagatggtatgaggatgaaaggatccacattgggaacaggaaaccaaagatctctgaagattttgaaagcagagaaagaataaccaggtgtacataatgataactaggaaatacaaaaccgctgtgagcaaaactgtttcttccagtttgggaggctccaaagtgaatcccgtgatcttagacacagagatcaggttaaaagagcctttcttccaggcagcctgctgctgcatgatgctcatcattccacatcctgaacaatcctcaggcttcaggctggacgagtggtctctaggtaccactgtgtacttaagagtgccattttctgagtgcatcttctgtgccaagcactgtgctgacatagtatcttattggcaactcttaatcttctatggcatcagtcttattcctattttagtgacaagggccctcttttgtaagtaacttcctccagccccacagtaagtgcgaaaaatgggattcattcctctgactctttgaatccaacccagtgcttgggtgtcttcaagtatctctgaattcctgacctctgggattcagtgatttttatggcattcatgtgatttctgtggtgagttccctccacccccaactccacagggcctgtctgtgaaaatgaaagataccagtcagggtgcaagacacagtctgttctcatggagtcagtgaaaacttcattgtatttgaaagaccctctgatcaccagaaggtcattcttgctcgccttttccttgactataaggttctataagttttttcgtaatgccacttacaataatacagtatttacaattacatcagaatgacaaaaacacagtttacaggagttagcacctccaaagcatgacaataataggaaaaatgtatcaccaagtactagtataaaaataaaattctctataaccaataatgttgaatcagagagccattttgaactaaagaagtttttgattcccttgtgttaactttaaacaaacttttttggttgattttttttttctattcattccttctgtataagaaataatggagaaatgtgttaaacttttagttaaatgtgtgtcaaagtttaatataaccatatggtttttcctagttttggttatatatgggaaataacatttgattcactcgaataactttacagttgaccgggcttgcttatgttggtgaatgtatttaagctcattcaaaacatacagcttgacatcttagaatctgaggaatgactttaggcaacagttaagccaatttttaaaattctcattgggggcactgaattgaaacgctgtaatcttctctagaactatcttctatttcgtgtttcagcaaagacttaattgttctttgaagaatttcttactctaaaaatcgtagcaatttatattccaaagaaatacaattatcttgctcagaaaagagaagaaatgtagaattgcctttatttctaagttataattgcaatcatgtattggcagcacatgtgaacaacttagatataaaattatgatggggaaaaaacctgcagcaagaagcaaagtgtgcatagataatgatcctctgccaagtaaaatgagttctatttatgtatttgtttaggcatattaagtgtctagagcagcagtaatgtgaactttacctttttggttgtttacctttttcaacacctatcaatgctgtattggtaaatattacatacacacacacacacaaacacacacagtcttgctctatccccaaggctgaagtgcagtagtggaatctcaactcactgcaacctccacctccagggttcaagcaaacttcccacctcagcctcccaattagatgggactacaggtgcatgccactacggctgactaatttctgtatttttggtagagacagggtttcaccatgttgaccaggctggtctcgaactcctgacctcgagtgatctgcccgccttggcctcccaaagtgctgggattacaggtgtgagccaccatgcccggccaaatattatatgttgtacgcattgggtactatgtattttaaagtcaattatgtttaactttgctcttattctataattttgcacctctggaggtaaagttaccatgccatataaaaaaaatggagataaaagtaatacattttacgataaaaccactcttccttttgtttttatataaataataggtagaggtctctgtacatattttatttctatgtttgtttgtttatttgtttatttattgagccttcgtcacccaggctggagtacagtagtgcaatctccagctcactgcaacctctgctttctgggttcaagggattctcattcctcagccaccagaatagctaagattacaggtgcacaccaccctgcccagctaactttttttgtatttttagtagagacaggatttcactacattggccaggctggtctcgaactcctcacctcaaggaatccccctgccttggcctcctgaagtgctgggattacaggtgtaagccaccacagctagcccatattttagtaaggaaaatgatgggtggcatgggactttgaaaactaagacgatatacttagtgttttaaaataagattttgttactgatataaaccacattgaagtgaggaagactgggtcatagtccagcaaagattgcaccttattttcttaacacgctaaagtgacaggccctatggttggtggggaagaaaggccttgtgacctagagggagaaaatgagatctttcgattcccagagtgagagagaaagatggacactgtctttagattataaaattcaaaaagcctaccgaaggggtgttgagagctacacttgaagggggctctgtattcatttagggacatttaacattacagctttctgtcatgttagcataggtcactaggtgtaaaaatggcatgataagcaatatgcgggtgttaaatgtaggagcagtatgcaagagtatacaggatagaaaaagccccttgagtccagaaagcaggcttgagtcaagagtgatagcctggactaagtggtattaaagagaataaagaggtagaacaatagaaaatagctcccaaagaaaaactaggcatacttcataaaattacagaagcagggaacaggatgacaaatgtgatctacatttgaaacctgaggactaacatgtgaagttgcctctgaagagatggtaagggaacctgtctgtgtgaggggagtggtggggaacaggacagttaatggacgcattgaacttggtgtcatctgcgtaattcaaagaaaacatgtagtggtgggtggaggaagatttggatataataagttgagtcacaggactgacgttgagtgaaggctccaggaaaaaaaaaatactaggactgacattttactgataatttacaattcttaagggggaaaaagagaaaaaaaatcaagcatagaaacaaaggaataataataggtattaggagaaaaaagaaacacgtggactaagtgagagaattttatgaaagaagggatgctgataggtttttgacaaaacgcttgggcatcaagagaatgaaaaggctttggtttgggggaaaaagtctcattggtggcttttgagaattcagttttagtagagagatggagttgttttaagaggaagtaaatggctaattgtagaagtgagctagggcaatgcccatcaggcagtctcttgaggtccagtgaaacattgaggtttagaaggcaattattgatcacattcagaatcagcttacacagaagtctgttgaacaggaagcaagtctgccaagcagggcaacatcgagtaattcctttcaaagggaatccttgcagcggcccactcagcaatctaatcagataacctaggagcactcctttggggctccaggtaacagctcaggtgcaaggagacgaaatgcacagtgggtgtgtgcaggaccttctgccataatagcctccttctaacaaggggtattcctctcataaacattccttaggcacaaaacacaccaagttacaatacttaccacatgtatggaactccaaaactacggtaccgccatcaggcattcataatttactggtatttctccaattcaagtacaatttattttttaaaatgacgctaggaaattgggagtccacagatcagcatgagcatgaataagggaccctctgtgtgaaggaagttaaggatcttttcacatggagggtgataatgaaaactttaagtgagatgactcactatagaatccaggcttcatgaaaaatatggaacttgggaaaatgtaataggttgagtgactagatcgatagtggaggttcagaggcagatggagagaggcaacagaacagattgcatcgtttcagtattgaacaaagtcttaagtacataatgagtgcaaatatttgtttgattaaaatgagtgcaaatgggagcaccaagttcaacatcttagtgtttagatgggtgacatacaaggatgatgatggtttgctaaagaagtaaataagtacaaataaaaacaatatagagacagagacgttcaaagtaatagatggcaagaaaccacaggaaatgcaaccctgttggtgaaatcactcaatcatcatggaacagtcttgagtaaaaatgaaattggttattaagtgaatttgtttttttattttatttttaaattattttttaattgatgcatagtggtacatattcatagagtacatggtgatatttcaacacatataatgtttggtgatcagatcagagtaattagcatatccagcatctgaaacatttattatttctttgcattaggagcattcaatatcttccttctagcaacttgaaactatataacaataaatatatattaactggactatctccattaatgctctatgtagccatatcagaagtccttagattttttccttcacatttttttttgcttatttacagcacaagcacgtatgattgcagcaccccctaactgttctcccgtacttgaagaaatgtccagtcccctgaatgaactcacctataactgtatgataccctctaaatccagctataaactataataatcagcttataggtgaaaaagagtcgaagatcaggggtgcaaatgaacatcgagatgatccaatgtaaactctgttttgttgatgcggaaactgaggcctggagagttaagtgacctcctaaacttgcagttcttggtaacagttgtgaacatgaattccacgtctagtgctctagactaacccatgctgtcttcaataattccagtgaaaaagcatagcagtttagtcctcccaacaccaatgcatgttcccacattcccttttctcaatctggattgttttttcctggatgagtcatatgtttctttatcaaattctaaagcttcagagtgaaagcagaggcacagccatcctatatgaataaagcagatggaagtatgggatggtttcatatggaagtctacaggtacaagtcacataactatattttaagtcagcatcttgtaatagcttccttccagtgtgcgttatgggttgtagcatgttgtggtcagaagacatgtatttaagtctgttctctctagtttatcaggtacctggctgtaggcatattcacttaacttctctgggtatcagttgaaagatcattatatctaactgtcagaatagttttgaggatgacataaggttaaaatgtataaaatcatgagacattttcctcagtacatttgttttctctttttacttttcctccaattctgctatcaaagctctggaatgtattaccaatacatctgtcatctgttaatattaatgggtcttctgtttccttaaaatacctcgataatgtataaataggaaaaatattactttatatgacaatgacatcaagaaaaagggagaaaaataagatctgagttttctaaaagaaaaatattaaataaacaatatttttaagatatatgaattcttcagagaagacaatgtttacacagggtgaaattcaaacgtaattttctgctgaacaactgtatatggaggacatttatggcaaatacaaagcagtgtttatatcatttgcatgtgtgtgtttctttgttcttaaaaaggtttcagtgaaagacaagagcatcgtcttaaaagtgaatctcaaaggttgaggctgttttgttcaaaggagtagacttcctgaggtttatgacaaatcaatgcgagggtcaaatttaaaacacctagagaagtagagaatgctgtattctttatattatccaaactattcaattaggtttttggaaaaagattgataacataaattctaggttatataggttatctccctaaatctgaataaaattctgagagtgtttagtgcttatagctgtaactgagtacattttccactatccctccctccccacaaaaggatagattggtcattgggtcagtcttgttggagacgactggcaagtcaaatggttttggaaagtaaagtggatttccgaacagaaaatgtttttccgcggaaactatggaagagatcaaggacgaaggcaaactaaaccttgaagatgaggaacggtagtgagccatatctaacaaaagctttactattcatggcttcctagtttgcaacttaacgtgaagtttgttcacatagatctgagaaaataatacctaattattgtgaaagaggacttaagagggattctttagcatggttcaggtggggctttaataagtaaaggcaaaaatatttttgtttcaggtctctaagatacatttcatgtaaaagtccataatataaaatgcaagcctatacctctgagtcaaagattcaaaagcacttttaatattatggggaaaaatttttttaaaaagccttgtagattatcttcaagggtttgaaattaattccaagcattcattagaggacaggaaaagtctgaaaatattatagtatgcatgagatgacaaatggaaattaaatgtgtactatccacactataatatttcagagaatatgaaaattaatagtgataccacagaacctgtataatttttttcctccgtgattttgtagggaatatggaattctgtgagaagaccttgtagttctcatattgtacaatgttctttgaaagcaggtgcgtatgccttgagttgtggtctcctaattatttagttgagaggtgtaaccaatggactcacctgtgtgaaaggatattggctctttatggacgcggaaattcaatgatagtgattctcaaaatgtggttcctggaccagctgcatcagtattactttacaacttgccaaaaggtaaatacttggcactcactccagaacaactgaattagaagctccaacaatcagcgttataatatgttttccagagaattccattgcagctaagttttaaaaactgtagtctctggcaaaatccgaggcacaaccagacacatctctgtccacattttacagtctctggcaattcatactgaaccacttgtaataaacatgttattcggggttcatcctaatattatgcttctagcttttgaatgatttattaaaaatatagctagtaatgcccttctaatttatcagcaatgtatccttttggtcacccattaaatcacatgagaaatgtttaaattcctgttactctggcagtggattgaaatccaggcaccgccaggttaaaggttccttgggtgattccaatgtgcagctacattttgggactacttccttactaagcaaatttctcagcttgattatgcataaaaattaccagttcaccttctgaaaacacaccctctacccccagagattctgatcagaaggtctaagatagttctaggttgttgcatttctaaatagctccacatacaattctatgttgttcagccagtgctggtaccaatatttggaagctctagagagaaaacctctcggtacttgttcttgtcaagtggtaagggatactttaaaaaaaaaaaaacctaccatgaagaacaactcacctattgcaagtttttgatctgtaggtcagagaagtgaccttttaacacaaatattatttgaatggcgttgtcaggttactttcactggggaaaaaaataaaaaatccatgaatattcagtgatacaaatggttagcagaagacaatgctaaaaatgaagggtattatgacagccaactgttttaaaacttcaagtttggagatctttgttacttagaattttgtaatctgaacaattattctgaaagattttgatggatcattagataggcaagcatctgttcaagtaaaactggttatttgctgacaaagcagaagataattaagaatcataattaactataagctagacataagtcaggattataacacttattataaccatgtataatgataaaatttctcattatattcatctaaagatttttgggtgcttaccgtgagccaggcactgtgttaggaggcaagcaaaagttacaaagaatggatgataatcttttgttataaaatgtagactgttgttcttaggaccacaattcaaagaggaagtgtaagacaaaagttcaagaagggcagtggaagtgaatgtggaacatactgaaggattttacaacacactttgaaacgtttaaaaaacctgcaatgattttacttgaatgcggaaagacagaatgctaaagctcaagcattgaaagagaactaaatacatagggtgtgttacgggctgaactgtgttcccccacaaatcatatgttgaagtcttaacccctggtaccctagaatgtgactgtatttggagacagaggctttaaataagtatctaaaacagggttgttacggtgttctctagttcggtctcactggcatccttaagaggagattaggacacagacacacacagagggaggggtatgaaaggacgcagggaggccgggcctggcgcggtggctcacgcctgtaatctcagcactttgggaggccgaggtgggcggatcacgggttcaggagatcgagaccatcctggctaacacggtgaaaccccgtctccactaaaaatacaaaaaaaattagctgggcgtggtggcgagcgcctgtagtcccagctactcaggaggctgaggcaggagaatggcatgaacccgggaggcggagcttgcagtgagccgagatcgcgccactgcactccagcctgggcgacagacagagcgagactccgtctcaaaaaaagacacagggagaaggtacccaagtacaaggaaagacgactcagaagaacccaaatgtactgacaacttggtcttggacttccagcctccagagttatggggaaataaatatctattgcttaagcacccagtctgtgtattttgctatgacagccccagaaaactaatacagatagtaacttgctgtagacactgtctacagagtaacaaacataggcaattaactgaacatgggaacaagacttagttggccaaaggtggtggtgcttgcctccaatcccagcactttgggaaactgaggcaggtggattgctttggcccaggagtttaagaccagcctgggcaatatggcaaaacctcatctctacaaaaagtgcaaaaggttagccaggcatggtagtgtggtgatacatgcctgtggtcccagctactctaccctgaaggctgaagtgggaggatagcttcagcccgggaagcagaggttgcagtgagctgtgatcatgccgctgtcctccagcctgggtgacagagggagaccctgcctgggagaaaaataaaaattaaaaaaaaaaagtcacttctgactatagggattatctgggagtctgcaaggtcttctaaaaggtgatattttaaatttaaaaagttacctatttttaactcctggtagaagtaaacattgttcttccttgaaaacataaacaaaacaacacgaacatctcagtattgatttgtcatctccttttggaccagatcaaagatctgcctgagataatttgacttatacataatattaaatggtattagagtgaggttacagtatatgatttcagtgtcttttatctcttacatactgtgttctctacccggaaggagtgaagcagactgaggggtcacgtggtcctatagtatagaaatcatatgtagaaattgattcagctctgatgcatacatatggatggataccttgatatttaaatgggacctctgtctcatttctccatctccctaaataattaaaaatcagttcactcttccgggaatcattttgaatgaattgaagagtaatttgcaaagcaagacgtataggggaaagagcatgcatgtgtgtttgagtctatggggacatcgcatttggcatgaggtgctcaggattcagaggactgtcttgcattttcctagcagtcagtggaggccttagcattccaacctaggaagctctatagatgtaagcaatgtgtttgctttatttgactgctatttatatgacagtgacaaacagatatggggtaaacttactgttttgaaaaggtcagacaaaggcaaggaaaatagaagcaaatgaagtgaacgcatgaaaaatgattactcaaagaaagatacaattatgcagagcctgaaatcaactcttggtttaatgttgtgatatgagtctctcaagagaggacagcaatccaaaaccatttccccagagaagcatggaattttacagttagatatttatttattgtgggaagtatttttaaacatctttcaaaatgcaaatacttagtgtcaatgtgtttttagaccctcctctgtgaaagagatacgtagaatggtagaacaaggtaagagtctaaggggaagtgggataaaatttcaggaagtgaggggttgtgaatagtctgaaatggagtatctgagctgcaggaggagcagcagccacttactggtccctgcgggcctgtgcccactagggcatatcaaaccctctgatggagctgctccaggctagcctcgtcaagccatctcccagcctcaggccgaggagatgcctgacggggccagcctggagcagctgcatcagaaccctacagctgttaagaacctttataccagcagccacaataacaccaaggtcacacaagatttcaagcaatggaggatgcagcaagacaggtgatagcatcagtgaaaactttaaatgagctacaaatgttaacagtgttcccctgcttaatttactgttttcctaaacagctatgaactatttgaggtgaagctcaaaaggacatactgaggtccaggaaattgaggtcaagctgcattttccagacagaggtttcaaatcctacatgaggaggaaggttatttacatattaagccttctgcgaagttcaataggtagactcttgagaaggcaagtcttgatttgtagaaagggctccatctcttaggcacctgagacccaggtcacccttagcgttgctcaggttgtacttcagaaggactcccaggtaagggaggagtgagagttaaattctagctcctgacaagcagggctgtgggtacccagaagatggatcactacttctttatatgcacaaagattttttttaattttattgtattttaagttctcggatacatgtgcaggacgtgcaggtttgttacacagataaacgtgtgccatggggcagcagccatcactgtagctccaggccaccattttttcctctgctggtgctggggagactggatggcttggtcccaagaggtagttcctacatttcagcacaccagctgtggaagatcgtggcccaactgcctctttaggacagactctgacccatccctcctcactgagtgggccctccctgcaggaactccagcaactccagccaggggcttagggaccaaactctgatcttcctgggcctgagcccctagtgggaggggcagctgtgatctccgtggatcagtagatttagtctcttctcctgctagctctgaggaatccggacagctcagacgagtgggtttcccccgagcacagcacactccctccaccaaaggacagtcaaagtgctttgttaaatgggtcctggatcccgtgccgccctgactgggtgagacttcccaacagaggtcaccagacaccttatccaggagcattcctactggcatccggtcggtgccccttgaggacagagatcccagaggaaggagcaggaagccatctttgcctccttaggtgacatctccaagtgtgggagggacccaggtgaatagtctgaagtgaacccccagcaaaccacagcacccctacagaggagggacctgactattgaaagaaaaacaaaacaacagcatcaacaaaaaagtccccacaaaaacctcatccaaaggtcagcaacctcaaagatctgaaccagacaaactcatgaagatgagaaagaatcaaccaaaaaaatgctgaacactcaaaaggccagagtgcctcttctccaaacaatcacaatacctctccagcaaggacacagaactgggtggatgatgagatggatgaattaacagatgtaggcttcagaaggtgagtaataactgttgagctaaagaagcatgttctaacccaataccaaaaagctaaggaccacgataaaaggctacaggagctgctaactagaataaccagttgagagagaaacataaaagaccggatggagctgaaaaacatagcacaaagatattttaaatgtaccaagtcatacagccattgagaccacatctttttaagtttttaatttgcaaaaagttgtagaggcagcccctatctccctttgtggtgtatcagcctcagggatcttggcaggtggaccagcattgggatctttcacagcataatttatctccatgcttctggtgctctgagtatctggatggtctgagactattactatgaagaacaaagtcatgataaggtatttctgcagcctaagaaaactgcagcattctgttcactgagaaatttgtgcttccataaaaaatgattttaaaaccctatctattattgcagtgaataaaatgagattttgagcctattgttggatttaatcattatttttatggcagaactggggttgtgggagtagttataaccagttgtgttcttttaatctcttttattaagtcatttatcataagtaaaattcagtttctgaccttggtgctttatttaagtttccaacttatctgtttcttagcatgttttgtgttcccattttaagtctgtaagggttatagaatacttatttcattttctctataagaaactgtttagcaatctaggatagtgttatgattaaatggcaaaaagaagagataatgtcaaaattaaagctacttaacagtaaggggcatggaaggctacatatcaaacccatctacactcaagcttcattttcaataggggattttctatggcctcttggctttcttgcttagcttaatccaagatttctgattatcaggacaagagaagagacaaagggtgaacacaaaaagtcatttagaataaatgtatgtcatatgatagtccaaattaaatgcttttggtattgctgtatccatattcctttaggttacatccattgattctttttacatctatctgcattgcatagccctgtaatacttaaaaaatttcaaacagagtaatgaaaagcatggaaattcaaaagacaacagtgaaagtaatggaaaacagtattaataatgtccagtggttgaatggcaatgagtgatactcaacgattgaggagtgaataagattaattaatttaactttgatggtgatgtcctctcctagaatcttgtttcctttcatgtttttggtacgcatccttcctctctctgatgttctgtttcaaaatttaccctcactattaagcttttcctattatgccaaccaaggttaacacatttttttttttctgaattcctataatagtgctgctatccacgcaactatggacttggtgagggcaggaataagatcagtttgcatcccatcagacccctagcactgttagcatagaattgggattcacttgtttgttgaataaataaatgtctggataaataattgccataaaatttgtacttaattttcatagtactctcataaaactgatatgtgttgagtgtgttttcgattataaaaatcttgaagagaggatcagtgactttcagctcttcattttcctaccctgacaatcctcagttctaactattgagattaacctcatgaagtagagtacaaggtacccaagggaagtctggagtagtccctgtgacatttctggtcttcacagaatggtgtttgtggttgtggtgagaagcagtggaaggttcctcccacacacatggtctttcacttttccctgaaatctggcacccttgacctgcttgtaacctactttgtgctgacccattcaccttaataagaaaggtaaatatataagcattacagtccaaatattttttgaatttttataaatggtgtttaatgctatgagattagaatgaatctaccatttgtagacatttattaaatgtctactatctaaaaatttaaatgtatgtacatcctcttttttgacactcattcgacactcattcacttcaatgtttttaaatatacatacagataatgaccaaatttatatcttgctgcactgacttctaaactctatgcagccatgaaaaaggatgagttcatgtcctttgcaggaacatggatgaagctggaaaccatcattttcagcaaactaacacaggaaggaaacaccacgtgttctcacgcataagtgggagttgaataatgagaacacatggacacagggaggggaacatcatacaccggggcctgttgcagggtgtggggtaggggagggatcgcgtaaggagaaatacctaatgtagatgacagattgatggctgcagcaaaccaccatggcacatgtatacctatgtaacaaagctgcatgttctgcacatgtatcctagaactgacagcattataatgataataaaaaaaataatggagatagcattagggatgtcagaaggagagcaagtttgatttcagatacactgagtttttaatgtcataagagatttaaactatacagtccaaatttttggagaaggattgagattttgttttcctattacacagaagaatcgaaaatgaaagattttattttctcagcatggatgcatccaggttttgtgtagctgaaagctttatacaaattggaggtaggggacctcttgatacaaaactacaaataaagtactaaatggagtctttatttaatgaaaaaacccataacaaatatttggagccttggatgctcgagtctctaattttttaagatgtcaagtgctttactagaaatacttacaatgttatgatgaaatgcttcctgagtgtaacctggcttcccttccttagacgagaactcctagaactcacgggtcctgaatctaaagcttaattcaccttgcagtaaattctcctctgtttggtccttgaggattgataaagacttattttgtgtgtgtatatgaccataagatatttcaaaatgcacttttatttcttctttttatgtatctagggtaacttttaggttaagaaaatgttttatttaggcttttctaattgcaaaaaacaaagattctctcaagctatttcagcagagggaaggctcagttcaggagctgagaaagtgttcacccactcaacataaccatgttggatatataatgcaatccagaccctgtaacatacagacacagcaccttctatcaaggagaaggagtgacttagaatcatcatcacataaatacatgtgcaaccgactgcaatagtgctatgagagacacaatatgccgagcacatatgacaaggaaacaaaccaggtcccctgggttttgtttacatgtttgctatattcctcttgtttttgatgatattgctggaggagacagaagggccaggacaatcaagattttcccgagcaaggattatttgagctgagatttatgtatggataggtatttgctaggcaaaagtagtagagatgagggatatgaggtttcaggccatggagttaagagacaagactagcttgttacaatggctcatacctgtaatcctagctacttggaggctgaggcaggaggattccaggaggccatgagttccagaccagcctggatattatggtaagaccactgtctctaaaaaatatttttaaattaaaaaatgagttgggtttcgtggcgtgctcctatagtcccagctattcaggaggctgagatggaagaatagcttgagcctaggattctgaggctgcagtgagctatgattgtgccactgcactccagcctgggcaacagagtgataccttatcacttaaaaaaaaattaaaaagaagaatgaaaacacaatacgcaacataacatggtgactcaaacctaaggttgatttagaattcgcaatagtttcaatgaaagcaaaaagtcatgagtcatgtctcttctttctatatctattctgtctagttcatgagtactggccacaggtgcctatgaacccttgaaacacagcattccagattgagatgagcttccattgtgaaatactcagtatgtatttgtatgtacatagtttgtaaaaggctttgtatgacaaaaaaggatgcaggatatctcattacaaactttcatattgcttgcatgttacaataataatactttggatattgggtaaaatagatacgaaaattaagtcgctggttactttatccttttattaaatgtggctactagaaaatttaaaattacacatgtggcttacctctgtggctcccattatatttctattggacattgctatttgagcaatgactcttagccctggctgtatgtacatcgccacccaccaggccacacaatagacctagggtagtagaatctcttagggcatctgcattttagacaaatgacctcatttgttactaatgattgtcacacaggtgttccacaggctgttcctgtaaatgccatggctcagatgtgtgtattatacattgtttctgcttctttcagcccttaagcctctggtaagctgtctctttgaatctagtcagagtccaggaatcttttcctgctagcatagcctcatgtgcgaaataagttgtgttgattcatttgccattaggacgactgtggtggcagcctccactctggatttactctgtagggattcgtaagtcatttttagtccatgactcttctcttccccctaggaagcccccaccagagacaaaactagagccgctttttatacctgatttttcggaagtcagcttcagaatggatttgtagaaaatcttgtatctctaccagctcattacactttgggtaacgttattgaacgtagaatttaagtttttaaaacagaaatgtaagtagtttcacgaaagaacaacttgtatagatcatgataacacctcgttaaattgaatagatccttgtcttagctgctaagtaagttgatattcctttaaaataccattcatttgagaagcagcaggaataagtgtagttttttcctctctccattgaactccagcttcatgagattatttattttattaaataaattcaagcaacctctaaaatgttctcaatttttgcagcatgatgtctaatgtctttatatggagtgtaaaaactctcacagtctggtccaagtccagtcttgttccccagttctccctctgctccagacaccctgaatgccagccaaactgcactacacattatccctaatgcatgctctgtgtattagtctgttttcacactgctggtaaaaacgtacctgagactgggtaatttataaagaaaaagaggcttaatggacttatagttctatgtggctggggaggcctcacaatcctgatggaaggcgaaaagcatgtctgacatggtggcagggaaagagggaatgagagctaagtgaaaagagaaaccccttataaaaccatcagatctcatgagacttattcacttccacaagaacagtataggggaaccacccccatgattcagcgatctcctaccgggtgcctcctataacacttggaattttgggagctacagttcaaaatgacatttgggtggggacatagccaaatgatatcactctgcttcttcaaatctctagtaatttgaaattattatcattattactacttttgagatggagtttcactcttgttgcccaggctggagtgctatggcgcagtcttggctcactgcaacctccacctcctgggttcaagcaattctcatgcctcagcctcccaagtagctaggattactggtgcccaccaccaaacccagttaatttttatatttttagtagagatggggtctcaccatgttggccaggctgctctcgaactcctgacttcaggtaatctgcctgccttggcctcccaaagtgctagaattacaggcatagccactgcacctggccttgtaatatgaaattagattgctcatcctagaatcttgtaacccttctccataacaaacttctactcatcctctcttctgacaccttccttcccgactcccttacataatgttagtttgccaaactctacttcagtactaaactctaaaggaatttatttgcatgtatacgtatttttcacaagtaagcactagagcacaaggttgaagttcattacatacctgtctttgatgggtagaaagagcagattatttgaagacgttactgtatctctaccttcagcctatgcttttctcttgccatgtattccagtttctattttttcgagacagagtccggctctgtcgcccaggctggagtgcagtggcgccatctcggctcactgcaagctccgcctcccgggttcacgccattctcctgcctcagcctctcgagtagctgggactacaggcgccgccaccacgcccggctaattttttttttttttttgtatttgtagtggagatggggtttcaccgtgttagccaggatgctctcgatctcctgacatcatgatccacccgccttggcctcctaaagtgctgggattacaggcgtgagccactgcgcctggccatgtattccagtttctttaagcttcctatatacagtgtgatttaaatctacttatcatctggatgatttgtcttttaatatacttccatttgcttatgttgagtgaagttatctgaggttagaataacgtacataaaatgatatgtgaattgtaggccttggagagaagtcttaaggacactcctgtttttagctattcttcttttccatttgctgctgtggactgtggtttattttagactaaggaagggcatggtgcggggtttccactgctgcttaaactggagttgaaatcctatgttctgcttcctggcccactcccagcctgcagaagcccccagcactgaggacaatctaaacgggcgggattgaattcaccttatcaccacttcgcgccgaaatttacagtctacgttgaggggttctgggttttgtttgtgttgtttaaattgttgtggtattgatattactgttttaaaattaataattatggtagcatgctttggttttgaagcttcaggttgtatatactgaagagcaacatctttaatttttattatttttattttagattcagagggtacatgtgcaggcttgttacctggatatatttatgtaatggtgaaatttgggctactagggcacccatcacccgaatagtgatcattgtatccaacagtaatttttcaaccttcacccgctctgacccaccccactttggagtccccggtatctataatttccatctatatgttcatgtgtgtctattgttgaactctcacttataagtaagaacatgaagtatttgattttctatttctgagttatttgtcttaggataatggcctccagctcaatccatgttgcaaaatacattatttaatccttttttatggctacatagtatttcatcattttatatatgtaatatatattttatatatgtaatatatattttatacatatatatttatatctattttatatatatttttatatctatacatatatattttatgtataaaaatgtaatatttaaacatatataaatatatatgtaatatatgtatattatatatttatatgtgtaattatatattacgtattttatatatttcatatatatgtaatatctattttatgtaatatattacataacatatattacatgtatgttatgtagtatatattacatattacatatatacacacatatatataatatatacacacacagacacacacacaaacacagagacacaaacatcttcttttcctagtcatctgttgatacacacttaggttgactccatgactttgctattgcaaatagtgctgtgatcaacatatgagtgttgggtagatacacagtagtgggatggctggatcgaatggtagttttacatctttgagaggtctccgtattgttttccatagaagttgtactaatttaatttcccaccaatgttatataagcattcccttttctccgcatccttaccaatatctgatgtttttgactttttagtaatagccattctgacttgtataagatgatcatcattgattttgatcatctcattgaggcttcaatttgcatttctctgatgaatactgatgttgagcacatttttatatgtttattggccacttgtatgacttttgataaatgtctgttcatgtcctttgcccactttttaatttttttgttgttgttgttgtttaatgaagttgttctttgagttctttgtagattctggacgttagtcctttgtcagatgcataatttgcaaatattttcttccattctgtaggttgtctgtttattctgttgtttatttcttttggtgtgcagaaactttttagtttaattgcatgttatttgtctatttttgggtttgttgcattttctttgaggttttcatcataaattctttccctagaccaatgttcagaagaatttttcctaggatatttcatgtttttttaatagtttcaggtcttacattcaagtttttaatctatcttgtgataatttttgtatatagtgagaggtatgagtccagtttttttaggcatatggctctccaattttctcaacaccatttattgaataggatgtccttttcccattgtttatttatgttgattttgtcacagatctcttggttgtgtgtggctttatttctgaatcctgttctattgatctgtgtgtctatttttataccaataccatgctgttttggttattatagccttacagtataatttgaaatcagataatgtgatgctccttgcttcgttccttgtgcttaggattactttggctcttcgagctcttttttggttccatatgaaatttagaatttttttttcttattgtgtgaaaaatgacattagcaatttgataggaattgcattaaatctgtagattgctttggggcagtatagtcattttaacaatattgattcttccaatccatgagcatgggatgtttttttcttttgtttgtcttctatggtttctttcagcagtgctttgtagttcttgtaaagatctttcacctccttggctaaacatattcctagatagtgtgcttgtgtatgtttgtgtgtgtgtgtgtgtgtgtggctattgtaagtgaaattgagttcttgatttggttctcagctcgaatgctattggtgtatagaaatgatactgatttttatacattgattttgtatcctgaaaccttactgaagtcatttaccaaggctagggatcttttgaagggacctttaagatcatgtcatcagtgaacagagataatttaacaattccttttcctgtttggatgccttttacttatttctcttgcctaagtgccctggcaaggacttctagtactatcttggaaagtcgtattgagggtgggcatccttgtcttgctctagtttcttaggggaaatgctttcaacttttcctcattcagtgtgatgttggctgtgagtttgtcatttatcactcttactattttgaggtatgttccttcaatccgtagtttgttgagagttgttatcataaaggcatgttggattttgagtgctttttctgcacctattgagttgatcatatgggtttttttttaattgtttatgtggtgaatcacatttactggtttgcataggttgaaccatcctttgattactggaataaaacccccttgattgtgatggatcatctttgtatatgctcttggatttggcttgctagtcttttgttgaggatttttgcatgtgtgtttttgcatgcaatatcccagcatcagggatgttgacttgtatttttctttttttgttgtgcccttgcctggttttggtatcagagtgatactagtttcatagaattagttaggaaagaatgcctcctccttaattttttttttttggaatagtttcaataggatcgataccagctcatcttcattcatctggtaaaattcagctgtgagtccatctggtcctgggctttttgttgttcttggaagattttttgttactgatttaatttcaagcaaaatcttttaagaaagaattgtaaaatatacatatctaagcccaattaagaccaataaaatgtttgtaagttgaattaaatagtttctctttattcctggtacagtttaaattgccacttgtcttgaagtaaccattgtctcagctatgttacagataccatagcttgtaaaaataaacaaatgaatttgatgccaaacttgaagctcatattggaatgtaatggttttaatgcagacacaatttctttctgtatcctgattagattgaagcattgttttctactgtaacagcataatatttcatcaaaacatacctgtgtttgagagctcataaggtcttcttgtatattgggaacagatatggcaatattaatgactatgttaggttttttatactagcacactttcatatatgtatttgtatttataagaaatttttctttcaaatgctgcgttcaattgacaaaaaaaaaactgcaaatgaagcacagatgctgtgaattggaatacaatgtgcaatgcaatttagccctgtaggctttctggaaagaacccacttcccctatgatgagtagagttgtcagtagtgacaataatgctgttagacgtgaaaaccaagtgtgctcacctatgattgactgacaaagccacggtgcctccatgaataaaatccaagtgctgcgttacaattcatctcatgatttttgtggttcagtaatttatctttataaaacaccaatgacagctagtattccgttgttcctgtgagtgaaatatgatatgcttgcaatatggtttgaggattcactaactatggctatgtacacataatttgtaatcaagttcatgcatgagtagctgaaatataaataggaacatttaagactgtctcaaaactagattgaattctccatttacgtagtcatagcaggatggttcaggtacatgtcataatgagcctttgatgaatgtttgagacattcagaaaaggagtagaagccaaatgagaaccaaaaagaaaagaaaaacagaagaaccatagcattacaaagctaaagactagataaacttaatttttcagaagcaaatcacataatgaaacaccaaaatgagaattaaaaagtcagaatttactactatttgaactcctgagtttagccattttttctctgattttccaatgttgaatggagataattcaggttgctaagtataatattgaatatatatttaccttagaaatttgcacatatacattataagcatatttgtggggatgctgtacactagaaagtaccatgatttactcgtattatagtctatagctgctatattcatcctcccaagaaatctgttattatgccatttcttccgtctataaagttcttactagattaagttcaaacttctttttttttttacttttcataaactttattgatagtggccacaataatttttccttttctttctttttaagtaaacaacatttaaaagataatagtaaatgaattcaaacttcttaatttgaaattcgaagtccttcatcatctggtttcaactggtacctctggtcttatcactcattccataccatgaaatgcatgcaaattgctcttgctgaattatacataatccacttgctcattcagcaaacatatattgagtatgaacaactctgtgggtttaaagatagaaatatgctgctaatggatattcatttatatattctaggagctcaggaaggggtggaaaccatgcaaaaaaaaaaaaaaaaatagcctcctacacttccatcccttaattcttgacaatctcttcatttcaggtagcttttccatcaatttccataaatagaaacttttccatgaagtcttccctatatcctcaaaagaaagtaatccatccattccatagttcatagtgatttcttttaatattaagcaatgttcactgacttttatagttacttctctacatatgtcttccataaatcagtaagtacctcagaagttgaggaccatgtttcaaatattttctctatcatccacagtcttcagaatttgtaactacagaacaatctgttgaatgagtaaaatcatggaagtatagttggggacaaaattattcttatttctttcttaatttacctccttaaagatgtaaaagaaaaaagtctaatttctctcatctatgactgcagtgggtgtaaaatcaaaccatttaattattaaaatgaaaaatagcacatttttaaaagattcacagtacattttgtgaagttttatactgaataaagttttttataaggaaaaataaagcataattattggaaataaataaaagcgtgataattgtctccattatatagctataaaattttatgtctatcattaatcccttataattatttaaaattatttcagtcttttcgtataatgttaagtaataaaacttgcataattatttttaaaagtctaaaaattataaataacatttataattctgcatctgtgataggattttataactgtacttgtaacaaaatggagcttacatttttaaatgtaaaattgaatgaatacaaattactttctatcctgaatacagagcattatacatagcttgctagacatagccaaaaatacatacttgaaatcattataatgaagatgattaaataactataatcattctgaaccctatctttatgatattatgccaaatgtgttagtaatacttacctacattttgacatgttataatctacataaatttactagtgatagatatacttggatttcagataatgcactaaaattttctgcatataataaatatttttataaatgtattatttcttccagttaaaaataatcatctctaaagaaaaagtaaaatataatgctataatttcttgatcaggctaatggtgagacgattattcattcttaaagctttgactcagagataataaatcttgctgagaaagacgtttgaattcattatttctcataataaatgctcagtaaatatttgatgaacttaggcgatgggtccccatagttttattgtcagtactcttcatgtttatgccaataggacctaataatcatataaactacattttcatctagcatctgatttccataaaatgataactttgtcttcttcagtatcatctcattgtcttgacatagtaagagctaaattataatattgattattattaagtgcctagttaaagaaggaaggaaatcatcctagtcagtttccttatgttgcttcataaacctatccctagatgatccaccagcttactatacaccaggcattgttagaattctcgtcagctctcaatggctcccttttgtcacaaagtcaacattgacttgaaccaatgtaaacgctaaatactttaagaatgaaataactatatgattcctgtcttgaggtaacttcatcgatcacagtagaaaatggtaagtttacaagatgctaagtagggatttattaggatgtttacacggtggtagacagagatctgtcagataggtggacggcctaaataaaagcatgagatttgttcttaaattctgtctgcagagcacagtgaacaattcaagtctacatgtaaagtgatcttacagtgacttacaatggactctttctgccttttgtatagtacaaatgatgtttgttttccaaatgtatacagctaattgtaaactctttcttgtgtaaccataacttttgtttgagccaagacattaccagagtgggaaagccgctgtttaaacaaagaagaaaatcaacagtgaaaagaggtgtctagtgaccaatttctgtttgcttgagttccctttgagaacgggctgggaataaataaattaaacaactgaggcttttacaggaaaacaataacaaaagcccttttctgtctttgcacagttcagagacaaaaacagaggtcacacatcctccagcaagtctgcttcatattcaggcgtctcttacagggacgaaaaaatctctcgtagaagtcatgctcaataaaatgcaaactcgtttacgaaaatgccaacattttcattttcttttgatgactttctcagagaataatgatgttcagcttagggttttttattttatttttatttgtagtgccctttgggaaagaacattttctcttttaaaagccacacaaagtttaactcaagcagtctcattgttctttctcccacaaagctagcaagaaagactaatgtattacttaatgaagctattcattgcttaataaaaataagaattagtaacaataactgttatattcacattaaccttacttttatgctttaacatagaaattgttctgatgtactatatttctaccataatttgctttaaaaaataaagcgagtgggaagtataaatcccatgatatgaaaagtaagatatccttttcattgttattgtagaaatctgagttaataacctgtgctaaacccagctaacaaaatctcaagttttggaaagtgcagagttgtaatactgatgataagtggcagctctgaaaagtgaaaaaaaatctttgacttgaatttcacaaacttgggtcttactaccaggttttcaacttactagtttatatgggcaagtctcttaaattttttgaatctcgatttaatcatctgttcattttcaaaatgggaagtaactctggctgttacacagaatggtcacttattaaatttttgatgttcacatataacttaaaagaaagttcatatgtaactttaaagaaggctatatgtgaacattacaaataatgataaggaccaatataataaacctctggtgcaagatttttataacgaatcatcagcattcaatataggaaggctgcaacattgctcatagatatctcccttgaaataggtaaattcaccagatttacaaaatggattagccaaaagcttatattaaatattatttttaaaagacaatatgtatattaagaattgatgctctgtgaggtcagtaactttatttttgatgtagtcatattgtctagggtattgtctgacatagtattgaataattgaatgaaagaattccctgaatatactttcctttagtatattcacaggctgatttagttcataactacaatcctcatgaatatgttcttcatgaatatatttattaaaagactaaacctatgacccttagcttttgataaattaaataatccctacaatactactaatatattcacatttattggatatatttaagagaaatatattcatgaatatattcataagatgaatacattcatattcatagaatatattcaagaagaatatttcttaacacaattacctaataaattggtaaaattgatgaatttggtgagttagtcatcacctgattctttagataattgtttttggccaatccactcttagagaattggttttcactgaattgatctagagacccttcccttgactatgacctgtgtgatcatcagcaggtagctactagctactggagtttaccaccctctacacctgtgagctgagatcaccttctgtgaaactgctgttgggggatagacaggacctccatcttccaaaaggagggaggttagaagccaatgtcttcttcagaccaagagtgacttaattcgctcatccggcttactgtttcaaattcttctccctaaattctgtgccttcttagtcctccttgttcttcagaggctacggctttaccttggggagatttgatagtgggcatgaaaccttagtacaacttgttaaaggctgagctagacacaaaggggacactctaatttagctattagtctaagtgtgtaatccatataaatcaggtgtgaccagccacatgaaactcctttctcaaataatgtatatttagtttttcaaacttgacttatatccccagctaccaaagaacttagcttctccaggaaagtcactgtcattgtgagccatggtttggatgacatcatcatctctcaaatatgtgagagcagagtgaagattgagaatcttcaagctaatttaagccatgacagtggtgagatttcaagagttaaacattaggctatttgaaccatctggttatactttttagtctaaggcatacagagatggtgaatttaagaagaatgaagatgaggaaagcctgagaaaatttaaatacagggaagatgatggactctctacagtttaaagggaaagcaaaacaaaatggtgcttaattttatattatgtatctgtgtgtcataaaagagccttaatcatggttgataattaatcaaaggaaagccctttatttttattattaatttattactattactattatttatatgtagagaaagatgggggtctcactctgttgtccaagctggtcttgaactcctagtctcaagcaactttcctgctttggcctcccaaaatgctgggattacagatatgaaccacttcacccagccaccattaagtttacaaatgaaattagacataatttgaaagtgatatcaacttgaaaacccttaaaagtgtcctgaagtcaccttcaaaaattttatgaagacattgtctactatgccatagtccaccaataatttcttcttatacactgcagttcacatgacattaatggcattgatagctatcagttttgctaaattataatatattaatatcctacaactatatgcatatttcatgagttttttgacacatctatacccccatctaatgagttttaaagataacagtgactccaatattttccacattttaaggtatttttatgttgtacattaaatatattcttgccctgatttattattttattttgttgacatatacatatggaaaaagtccatattatgattgtatagttcaaaggcttttttttaaaaaaaactgaacatacctatgtaactagtgtctatatcaagaaatagaatgttaccaaccctccagattgcttttagtttcaataattcattttaactagagggatgctcatctagcaaccaactttaagcaatacgcagcaagtagctaccaaaaacaatataattgtgctatataataaaaaaagattatctgtggatctagctaatgttgtctttagataggacatgttctataaataagaaaatgataattactcatttgtatcatagaagtttaacattatatgtcatctaacctaccagaaattctctcacataattgcctttgtggggtattgctggatgacatcttcatcctaatattagtattccagagaatttctgaaatagagaacaaatgcttttcccaaaaatcttacttctatcttcaatttcccagtactttctgggactctacaacttggcgttaaatcacagaagtggctatgaattccctttcagattttacctggtaaaagatcttagttctttctatggtcctggtttcatcttccatattggtatgtcatttatttattcccaagattctatgacgttaccaggacttcccatcttccctttactaagatacaatattcaagtgacgagtcctacattttccacatgtaattttcttttttcatctcggtgaaatctctttcatctctgtaggtgttccatggccattgtgtttaatgtttagagtcatccagaacggcaagtacaaatgtgaagccaaaagttttcaacttcaattatataagtatttattttaatgtgccctaaataacgtgtttttttccccccaaatcaatacatcatcattggtctttctattcctctctatggcacatgaatgtattctagtcttttttttaagtagttagcatgaaaaggaatcttgtaattcagctggaatgaagcgttcattttagtgataaaaatttggaggacagagagagaaagcaacttcttcacataatattacagtacatgctgcccaaattctaacccaactctattttagtatatcacacggctctcctgtcttacgtagcatgtaatgaatatcacatatgtgtgcatacacatatacaagcacacatacctgacttatgcacatgatgccaacccatgaaaccatattaataacaaatcaatatttttaaaatttatgctaggataaaaatattacattttaaaatatttttatttttaaccattaatcaaatgcctatcacatttagtttataatccacaaaaagacttggtaacatacatttatatcctaatatgtgttacttcactcacataaatactgttttaacgtactcacctatggcatttttccacacaagttttgccactaggagtaagaaaaactaccaaaagggcagttgacactcaaaaaagattattgttgaattgaagatttctgaagagacatagttaatgaataccttgagaggtacctttcaaggttcagtcctcattaatggtttaattggaggaaatgacattgagctgaaacatacagaagctgctaggagtcatgtagaagaataagtagtagagaggttggcaggaaaaacctacctgtaaaaggtaagcactgagtttttgcctatatctgcagcctgggtgcatcctttgaataaaagttaaagattatctggtggcatgtataaaaacagagttttataaaaaaaggattaatgcagaattatctgaaataagaaactctattcttattatgcaatttataaagcaatttaagaataattgtttctattcaaatcataaaggattgtacctggatgtaatattttaagatgtcttttccttgtcaggattctgatcatgatgatttcctgaacttgggaatttctgagcccctgagtgactggataacctctctaacttaaaaacaattatctcactcgtgttacccagtaaacacaggtataaaaaggctctattttaatgaaagccactaaaattcaagttctttatgattattatggaaccaaaattttgaaatatttcaaagaatagaattaatcatacatactattttaaaggaagccattaaattacatttctgacaatttttcattttaagcttttgttataaacatttagaaaaaatgagaaaattgattcaagaattaaccttgtctaaattgtcattattttcatttttgatattcctattattcctttttaaaaatactttttgcattgcatctataatactaatatgacagaatttaaaaagtcattgaccaatagcattacataatttcttccttaatacataagaggacaggaactatgtgcctttgggacatggagaagaggcaaggtgctctgtaatcattctagtgttcatttctctaacaggataacaccagccttgaagacgggaccaatagagttttaatggcatattacaattaggatatggaaaacaagagaatgcctatatttgggatgacttcttgtcagattcccagttggataccaaactaatctcagctacactctgtcttccccatttatttttatttattcttccaaagctatgtaactctgatttgtaaaatatagagaagcgttttctagaaattataaatatgtacataaagctatttacatatcattagaccatacagttgggcaaactccataaagtctggaatcatcagatttatttttatattgtctacaatgtgtcaaatagatatatcctcagaaaaagtcagaggaattgatttgaatgtccttgccgtttacatagtgtcaattttctataaaccaaggatgattttgtgcctttatagaaaactaagatattacatttatctgaaacatatatgggacaaaaataaaggtctaaaaataacttagtcaatttagatttaagaaattgtaataataataatgaaaacttatattcctaaaatgatacaataacaatcttatcactacaaatctctgcttagaacagaacaaaacagtgactgtaaacaaatactaatatttaatttaaaaaattaacttggatatttattttaaaaagctaaggaacaggaaatataacctataaatgtttaaatagaaaaaacggaacgtaagaaaaataatctgaaaagcataaatgaaatgataatatatgcattacccaataaagtcaaatggtgcaattaaagaatgatgaattatataaaccagggttctgaacctgagagaagacctaaaccactgaaagtgcatacaaatttggggtatatatgaatgagtttttcttggatcaggattcatagttttcattagcttctcaatatacaccactattcaaagttcttctcctttatagctaaactactcgagggtcatatcttccctttccattcacctaccatattctcccctttccactccaatcaacattctccttcacattctcaaatctaatgttcacttctcctccttgttttacttgatgtctcagatgcacttataagagttgactagtccctgcttcttcaaatagtttccttcttcacatcacattctcctattcttttactggccactctctcagtaatctttctttgttaaagaaaaaaaaatattcagtgacacttgttacggcatggtgagaaatattttattcagtgccatctcaatgggtatggggaccacagcaatgggattttgcagtggcggagactacgctcaacttcaaatatagcacgggcaagtgggaatttatatagccaaagaatagagtggggtcagtggatgcaacattactaagaagaaacatcaggtgcaaacaggattctggttaaactgtcctaacaggattctcactgaaaacaagctggggtgatccaccatcccccgggagatggcgaaggatgaggaacctgatcagatatcatcggggtaattagatatggaaaatcagagcagggggagtaggaatgggggtgtgtcttgctaaactgacttagcagggttctttgctaagctgaattgtataaggaattgcacagatgggccttggagaaacttcaggagcttaactaaagtttagtcaagcaaagaatctctgctacctggcctctcatccatttcctcaactttgaaaatttagagtactccaaggttcagcctaaactctcttttctgtgtcaagtctctccccaggtaacttcatcttgccccgtgacttacactcatgacatacgatttgtatctccagactacatttttttcttgagctccagacccaaatatataactgcctacctgatatctctacttggtgatctaacagattcgcccaacctcgactccctcccccagtctctcattacagttaaatggcatcaatttccactcagttgcttaagttacagatctatttctcaaactttcgacagccagtcaatgacccaccagttgtgcttccaaaacgtgaaaaatctggccacatttctccagtgctaacctccgtccaaacttccatcgtctcttgccctaatgacggtaagagcatcctaatagatgtccttaccttcactcttgccttctacttatcaggcctttacctatatattttctcttatttcctcagtccttcccccttaccttttgcactctggtccctttggtctggcactccaatacaccaagcatattttctctcagggcctttgcatcaaatcatcatgtggctgacctcttgttgtccttcaggcttcagatttactgtcacctcctcagagcattacccttttgtcaatcattcttatctctctattacaatctctgttttagttattttatagcagttatcactgtctgaaattgtacctgtaaacccattgtctgtctttgcacacaagaatataagctccctgagggcaggggccttgtgtgtcttctttactcttatacccctggcacctcaaactatgccagttgcattgtaagagatgaattaatgagtgaataaatgagtgaaagaatgagcttgactctttgaaggagaactgtaaaagggcttaagctggtgggagcaaatttacacgttcctctctttagagaacagctgaaaagttaagatgaaaagcaaagactgtcaaatcaccccagtcataagaaatcagagaaagcagacgatgatcatcacgtgcttcttcctgttttttaacctttcttcagttatcaaagtaacgagagtagtttgcagttactcatggccaaagccagatgaaatacaacagatattaagtgtgacatctcttcatgatatgaatattttctctgttatacttttttgggttttccaagttttttccaataaatgtcactttatggatgaagaattgtattctttaaaagtctgtatttaaaacctgaaacccatctcaaatgccactctataatgtctttgtcttgtgacctcacacactacatacaaaatgtgatgtgttccttttctaaaacctccaaagtgccttccctttatacatacatgtactttgtctttatacatacatgacaaaataataatgataaaagctgctactgtctctcaatagtatcaggtacctcatatacattatgactcatgaatcatgatttcctctataaggaaaccaagttacaaagaaatgtaaaaacttattcaaattaaaatagctaaatatttctagaccagaaaccagttatgacttactgtatctctagtgctaaaatagtacttaggaaatagtaggtattcaatacatatttacaaataaacagaggattgatattgtcatttgaaaccctggtataaatgacatcctggtatgatacccagacttaacggctttaccacaccccatcttagatcttacctacattttttcattaatcaatagtcagatgaattagaaccctccttgaagccaacaatagcttcctattcatgacaacttgtattgtgttttatattcaacagagaatcaaatactaaaaaaaaaacaggagagacaattggggagagtgagaaataaagaggaaagaaagataaaggaaaggagggaaggaaggaagaaagaaaggaaagaaggaaggaaggcaggcatctgccaaaagtgataagattaatgaaaatggctccttgtataaacatattcctactaaagttacctggtctgtaagattatgtcaagaaaagaaattaatcattggcagaataataaagtttcaaataagagtttttgaagtatagtgatgtttgtcttttggctaggaatcagtaatggttgaaaaagctaccaaaatttttttcatgaacatttagtcttggggtagttatttaatttttaatatgctaaaatattgatctctgtaagttcaacattttaagagtctaattgttttctcctgtttaagagcaaataatttcatatatattgggtttcccattgtttgatgacgtagaaaacacagcataaagtagacattgaatgaaatttagttgaattttaaaatgaatagcaccactattactccatttgaaaacatttacatattattgaggtaaaaattacatacagtagattctcatcgttctcattagtcaatatatagttatgttctgtatagtcactgtgaaaattgaattggcaactattgaaccatttttcctacgggaaatacagggttaggttcctgccagcctctgatcacaatatttgcaccaactaatcaatacataaccttgttttgtgtgtgtttctgtttaaagttactgtatttaatatttatcattgattaaaactgaactcatgttcaacagcattataacttatgcctgaatcaaatttaacaaacacatattttttatgtaaggcacataacagctttaacttaggaacactaaagagcacttcagtactatgtcaggggaccgcttttaacagcaaagtcaacaaaagcaccaaagtataaaaaatatgacactggcagggtgcagtggctcactcctgtaatccagcactttgggaggccgaggcgggtggattgcctgagctcaggagttcaagaccagcctgggcaacccgctgaaaccctgtctctactaaaattacaaaaaaattagccgagcgtggtggcttgtgcctgtaatcccagctactcgggaggttgaggcaggagaattgcttgaacccgggaggtggaggttgcagtgggctgagattgcaccactgcactccagcctcagtgacagagtgagactccatctccaaaaaaaaaaaaaaaaaaaaaaggcactggatatacagtgaaaagaggcactggatatacagtgaaaagaatacctgtttgcaggttgagaccttaaacaagaaggcaaagcgttagctcagttggaaacttgtgccttaggaccactctgtacatgcatgagtctttaaatgaccatgggtattgattttgggtttataactaaattttagcaagtaggcaaattcacaaatgttgaatctgcaaataataaggaccaactgttcatgacatgcgcagatcttaaaagtacaattcaatggatttggatgagtatatacacttagacagcaaacatggaatcagcatatagaactttttctctccctcagaaagttcctcgtgccaccctacagtccattcccacttgtgcccaccttcccatagacagctgctgttctgatttctatcagcttgatttttttattctttttttaaattttattttacttgaagttctgggatacatgtgccgaacgtacaggtttgttatatagctatacatgtgccatggtggtttgccgcacctatcaacccatcatctaggttttaagccccacatgcatgaggtatttgtcctaatgctctccctcccctttcccctcactccacaacaggccccggtgtgtgatgttcccctccctgtatctattttataaactagttctatgaacatattcataaaatatgttatttttatgtccaggtttttcttacaaaacacaatattttaaaaattcattgatgctgttgcttgtatcactagttcattcctttttcttttttattatttagcaatatttccttgtttgaatatatactgtatgtacatgtgtttatttccaatttgcaactgtcatgaataaggctgtcaagcattcctgtatgagtatttttgcaacatacattctgatattggtagatatatacttaggagggggattgttgggtcataggattaatatatgtttaactttattaaaaattgtccagagttttccaaaaagattgtacaattttatactccaaccagcaatgcatgagggttcaaattgctctagatgctagttagcccttttaatttttggccaccgaaatgggtataaaattatatatcatggttttggtttccctgatgactaataatataaagcactttttaatgtgcttatgaataattaatagatctttatttgggatgtgacttctgcccattttttccagtgattattgatttacaggagctcttagtatattttagtatattctgttttaagatacatgcactgaaaataatttttcctagtctctttcttgccgtggattttattaaccatgtctgttgatgagaaaaagtttttaaatttgatggatctcaaattatcaagtgattttgatgtcctctaggaaacctctgttagcccccaggtcctgaaaatattctgttttcttaggtctcaaatcctttcagaactatttttttgtttgattgtataaagtagaagtcaaaaatacatcttctctgtatttatccagttgttctggcatcattttttgtaaaagacacttttcattcaccattaaattgtcttggtgcctttgttaaaaaacaattgactacctacatgtgagtctatttatgatctttctctgatgatatacatgtataatcttgaaatcaaatgataagttctctaacttggtttttcttttttgcttattttgaatatttaaggattttttttgcattttcttaaacatttttgaatcatctcatgcatttctacaaaaactatattgttgggtttcggttagaatcgcatggtatgtatctccatttgtttagtgccttaatttctctcactgatgatttggaggaatcagggtggaactttaaaagctcccccaaatgactctcatgtgcagacaagataaggaccactacctagatccttttttcttagaagaatttgggtgcctgtaagaaaagaattcatcccatccatccctaagattctacgtattaaataaatgaagtggtcatttctgtttgtttgtttatttgagacagggttttgctcttattgaccaggctggagtgcaataccacaatcttggttcactgcaacctctgcctccctagttcaggtgattctcctgcctcagcctctggagtagctgggattacaggcatgcaccaccatgctggctaattttgtatttttagtagagacggggtttcaccatgttggtcaggctggtctcaaactccagaccttgggtgatatgcccgcttctgccttccaaagtgctgggattgcaggcataagccaccacacccagctatgaagtgatcatttctaataacacatccaaaaaatgtcatgacatacgatctccccaatgtatttgttttacttaaagtttctattcaagtgatttttccaaaataaccacacattccaaagtgactctttgtaactttacaataaggcatttggcagtttctttatcataaaaaacaaaagtaccttgtacctgcccaagcacctttttacatgttttatctgacaacaattgatcatatttataatgtggtttagattggcatgtgaaaatgagaaaggtcaaaatggatccattttcttatgatatggaatttttatagataagaaatagtgcatggcatatttatatgaaaatttatatacctttttaaagttttattgcataaaaggataattgattattaataagatatattagtaacacatcatagaaccctgtaactgcctaaagatgaattcatattctaggaaattttgctctcaagattgaatattgatcacaagactgaaaactccagtcactgtaattttacttgaagcattttctaacagatgttacatcttggtttgccattatattttaaatacgttctttttcttttttcaacattcattaaaccagtcttttcttcttgtctctaataagagcaacatctgtttcttcttgttcaatcaaagcaacttcctcaagagtcttactttaaaaatgataacattagaaagcacggatagaaaacttttcattaatattttacatttgcatacaaaacaagtgtttctaacaattataagttagggaggtgttagagaaaatattataaaacaatttagttataaaaatataaaatgagaaggtgctgtaatatggtttcaaagatgttcgttttaggttaaattttctttatatgaatatcagtttccttttagaaggtacagttgaaacacttttatcattacgaattataacaatggtacataccacactgtatgtggtacagaattataacagtggtacataccacaccgggttccaattcaatctcagcctcttatggggcaagctccacgtgtgcctgaatatattatgaccccaaatataaggcaattctccattttccctggattattttatatttttactaacttgcacataaactgtcaaggcctaagtgaagatgtcaataatatttatgtgtttttcagattacatacataaatcatttagaaagttcattttttcattctcactttttagaaataattttgttctaatgtctgcacaggcaactttaatgtcagtgtctttgccctaactttgtgaatcatctacacatttctgtagaacaaatcatcttcacctttgtcttagttgtttaagatataggataagtttcccatatcactgtatatgttttcccaagcctcaaattcccattaacaaaggactggctaagatgcattttttagttgtcctgtaggtgaaatttatgatctccacattgtaaagacttactgcattgctttcttgtttagaaagcttatcactacattaatatttgtaattatgagatagtaaactccaaagacaatttttttttttgttttgagatgaagttttgctcttgttgcccattctggagtgcagtgacacgatctcagcttgctgcaacctccacatcccgggttcaagcaattctcctgcctcagcctcccaagtagctgggattacaagtgcccaccaccacacccggctaattttttgtatttttagtagagactgggtttcatcatgttggccaggctggtctcaaactcctgacctcaggtaatccacccgcctcggcctcccatagtgctgggattgcaggtgtgagccacagcaccctgatgaaagacaaattattaaatgtgtctcagcttacttttctatgaaataaaatgaattaaagtgtccatgtttttgtcttaataatatagatacactgtctcctatctggcagccaccattctaatgctgtacaaatactaatagtaactagtatacaaatacttaatccacctactcaaagcctcattttatttccagacctgatgctgtatgagatatggctatccccagaaactgagcacttctccagatgtggtagcaaatggaagtgtgtgtgcgcatgcgtgtgtacccatgtgtgtgtgtgcatgcgtgtgtgtgtgtgtgcacgtgttgtgtgtgtgtgtttgcatagtataagaaaactctgatcatggatgcacagggtctatataaataatgtattttgttgtggttcttgtttatttgttcaagctctagaaccaactatgtctgagttcaaattctaacctttacctgttaccatctataggatgcttacagattggtagactcagtccttccctatatactggagataattgtttaaaaaaattttgtgaggtattacgaatcaaatgcaagcaaagtatcaccatggctagcacatagagcttagaactttatactatatatgctgacatataaaaagatcatgaaattctattcttctctggagacagccttcaggatactatttcttacaagatgtagacaaaatatgaaagaagcagcacatttttctataagaaattgggtcttccttgccacatttaagaataaacttcattacatttggggacccatttttatcatagattactgaggtattacctcttgataattaacattaaaatttcaaaataataattggaaatgaaatgaataggaatcaaagcttaagctttgatacagtagtggctgctatcagcaaggatcctttaatctgggttctaatttctctagtaattaagttcctggaagaaaataaaataaccttttaattttaatctgattagaataatagaccttttgccatgaaaaattaaaaggaagatgttccatttctaaattaattttgtgatggagaaattgtcgtggaattctctgaaaggctttcttgttcttccacttagagtaaccgaagatattttataagggtctatctctggacatgtgattatttaggattggatttggggactgaacaaatatcacgttgatatctttgagatccatgtcctaaaactgtatttcatagcagggtttgtcaaattataaagacaaaaatcaaaaaaccatgcagtcctatagttaatcaacaataaatcctactttgtactttaaagggaaatgctatggtgaagatagggtcttcagtgcatcaattccttgggaatacccaaagggacccacttgagatggaactatttcagtaaacactgctgcttgactgacagttaacttcaagaataagcctttacatgcatagagtaattttatagtacaagagattgtatctgtgttgttcttcagaatatttgaaagataagaaataacatttattgttttcccaatttttgtatggacaggaaaaataaaactctgggattaaatgacttaagatattcttgtcagaaacagaacttggacttaaatcatgcctttttctttttccagtgaggaactatcttacaaagtaacctatgagtaccaaaaagtagaccctgatatatgaatatgggtgcatattgtttatttgacattggtccaataaatgcaatctgggagaggggaggtgagacaagttggggtggaaagccacaaaaaggttctttaataaggagattgttactatgggcacctgagttctagcccactggagtctctctgagaggctgtagtaactacagtcccttgcacacctagtttctggactgttcctctttctacatcattggaagccattgaaatgtatgggagttttctgcaggtgacagccagagtgggatgaagagatatacttcatttaataacttgataacagagaaaggtcaattacaaatggacttaggatgatggggatttccaggaacatctattgacattaaattaaacttaacaaaaaaaattatatccacttaatccttacccttagaatgagtcatattgcacattaccgtgtagagctgagaagccatagtcagcaactccaatgctatttttattgcttttttatgtttcatcatttacttggccatctatgaaacctagagtgccagattcctggtcatgatcactccctcagattcattcagttattcattcacacccactatgtaccagacatggttttaactttagggtttttttagtagagaagaaaacagacaaaagagagcttataatcaagtgatagaagacagaaaattagtaagtatgctagtaaatgaacatataataaatttagtaatgagaaactataaggaaaaataaagctcagaaaagaaggaatgttgggagagagaggaaaatgatatgttatttagaatagctaggaaagaccacctctctcttaagatgacatttgcacagagatctgatgtgagggagcaaaaccatgcagataattcacacgaggcattccagatggttcacatgacacatcttagttcaccaaaaggactttagtcagtacttttcgtgagttcaaaaagaacagaaagctgttatagggaatagtgtgatctcagttatacatttataaagataataccactttgtggggagattagactgttagtgcaaagagtgaaatcagaggaacaattggggggtaatgaaatactctgtattcatctgttgatggacactttggttgcttccaaatcttagctatcgtaaacagtgctgcaacaaacataggagtgcagatatctcttccgtgtacgtattttcttccttttgggtatatacgtagtagttggattgctggatcatatggtagaccagagatgatagtgggctcacatagctgtttgccttattacattatttatattatgcatactatttatacatatattcacttgtatgctaaattttataatttggaaagtcttttgcattaattcctttagagcagggattttatactgttttcttgattgaaacaaaatgtgctcagtggccaggcgcagtggctcaggcctgtaatcccagcactttgggaggccaaggtgggtggatcacttgaggtcaggagttcaggaccagcctgacatggtgaaaccatgtctctactaaaaatacaaaattagccagctgtggtgatgcacgcctataatccccgctacttgggaggctgaggtgggagaatcacttgaacccaggaggcggaggttgcagtgagccgagatcccgtcattgcactccagcctaggaaacaagagtgaaactccatcacaaaaaaaaaagaggggctcagtaagtattactaaattaaaatttgaaaatcctaaaaaaaacccacaaaaccctgaggggtgattatgtgtaataatacttactatgagtaactactacaaacatgtgactatcttctaagctccaacagcccttaagttctttaaaatagtttttctatttcttagtataaaccaactagtaatgtatgattttcctataaaggagcacatgtagtaaatagcctaggctttatgaactacatagtttccagtgcagctgactcttgatgtagggcatgtggtatgtaaataaatgtacttggctacattccaataacatttatatggacactaacatttgaattgtatataattttcacatgtcactaaacattattcttcttttgatttctttccaaccatttagaaaagtaaaaaccattcttagctcacaggttatagaaaagcaggtggcagcaagccagatttcagccacaaactgtggtttttcagattcctggtataaattatcaggagcttggagccttgatctgtgtgtcattgatttgctctcattctatttttggacacctttattcgttagagttctctttcttttgtgaaactgaagcacgtcctcatgtaacttctacctgtggattctacattgtgccgtctgaagaagaatagcacaaaataccccccacccaccaccttgtcatagcacaggccttcacagggtcgaagaaagcccctctggccctcttggttttctctgctacccagtgttaaactttgtccagatgcttatgtttcctggctgctctcctatttttgctttttaattttctgactattcttcataaaatgaacacaaactaaacaaaagctttaagctactgtccagctaatggacaattcaatctaatttttgtttccaaagatcgttgtatcaagcaacaatgaagtgccattgttggggatatgcattcttgatttattttgctgttttttttttttaataccatgtactccattataaagataacttatttgtaaatgttcagataatcctatcattattttccatgactattagtggtcagttcgtacttataactacacatgcacagttattatttagtacttaatttctataaactatacttaccaaatgtgtttattgagagaaaacaagctatacagaaaaataaagattttaaaaacaaagacagactttagataaaagccataaattcattttcttgtctgagaataagatctagcaaagctaaccagaaaataaattactaagttaaagtagttcataattcactaagttaaaatagcacataatcataaaatgtgctcagtggctggatgcagtggctcacgcctgtaatcccagcactttgggaggccgaggtcatctaaatgactttttttcaatccatttctttccctaagtacacagcggtattaatactgcttctctacttgattgggttatattatgccttattcagttaggtggagtatagaaccacttatgatgatgttaaagagacatgagacgtcagtttgaattgtaagcagcactgtattttccaagagaaaaatacttttatttgtaaaatcgtgatttgttgattttggaaattgtgttcagctgggtaattttaagataaaaatgacttttatcttgtacttaccaggttctgggttgaatgatggacagtggcacgaggttcgcttcctagccaaggaaaattttgctattctcaccatcgatggagatgaagcatcagcagttcgaactaatagtccccttcaagttaaaactggcgagaagtacttttttggaggtaagaatgccattcctttttggttactaatccattgcaaaaaatgaggtttcaaaatgaagtttgattatgaagtatttatatttgactcaactgactcagtagatctcatgacaaaacaaactgtaattccactgagcaaaacaaaaaaagaaaaggaaaaattttatttctttctgatgaagatattaagatgatgtcaccatattcttctggcctaatttaaatcattgaagtataaaaaaggagattctaaattcatcctcataatcctcaaaagtcaggtccttggaatatttgctgttcacctagtgctttgtaactaattattcaaaccttagtgtcttcaaacaaacatttattatctcgcagtttctctggatcaggaattcagtagtaatttgctgagcgagtctttcatgaggttgacgtcaaactgttacttgtggctgcatcattggaagcctcgtctgcttccggtaggtctcacttacctggctgacagttggtgctggctgggatgcctcagttctctgtggcctctgattctgtaatacctttcttcttcaagtagcctctcccgggggtcactgggcagagaaatagagagggaaaaggaaagaaagagaggaggggaggggaaagccagtaagtcaggaagttctccagataaaaactatgagtattttttaaaatataatccaatttagcagtgatatcccatcactactattattttcaacctgtgggaagtgagtcactaaatcccgtccacagttaaaggaaggggatttcacaagggcatgattataaagagccattgattcctgggtgccattttaaaggtgcctaccacagtctaccttacagaagaagacatgttgtcacaaacatcttggttcttaagtaacgaaaagattagtaagaagaagattatcttaatgataaactctatgtgtgaaaaagtgttgtagcaaagacctgtcacattttctaattgaaaaaatgtgtcctgtcagaaaatgatctttttcataactaatacattatgaggacatattttattaaagtgctgggtactttgtttagatcaatacatcttttattagattattgtgtttcctgtcctaaatcacgcaatgtgagatgtaaaaaataaatcacatgcttagaaaaggcttttatttaagctttaaaatctgtatgttacatgtttgcctctgaaaatgtttctatttgtatttacatatctactttgtttaattaaatatatagttatatagctctctctctctctctctctgtgtgtgtgtgtgtgtgtgtgtgtgtgtgtgtgtgtgtgtgtgtgtgtgtgttctagtttttagagtaaggtgacatgagagcagccaccttgtttatctcataccctgctatattcctcaaggtcctagaaaaaatcctggaatgttgtagatgaacaataaatatttatgaaagacttagtaaattctacaaattaagcaagacgtcactttattatgaattgtctagagaggaaacagaggaggccctaggcaatttactgacttgccactgagtttgcagctagcaccttaagttttctgagtcctataccagggcatttctccccatctaattagtgacaagttagagacaaaaatcatgaactagggctctgcttctttaatcttccataatatttgttggaagttaagactacatgatttttaaaagactctcaataaatatttgatgagtagacgaaagtcaaacaagctgtcttatgagtgaatgaactggacatactgatgtgagaaaaaacaactcaatagccaaactggttaccgtccaaaaaaatattcaatatgattggcttatggccaacagttttcattgctatgatcacaaatagatcacagttgtcagtgggaaagctactgataatctctgctgatcccttgactggaatatttttggccatacatgagctccctgaatgcctaaggccagtttttatcgatttcaatctagaggggcgagcacatagctgtaaccacacattcatggcatagagtttataggatatgaggtctttatggtgtgctatttacatcagtttacagattctggtttttgagcccaggagtcaggagaatattgatttcctcttgggtctatggtctgcctttaggatatactgtcagctaatgatcacgatgcttgttttgttatatcgtcattagctgaatcctaagtgtgtaagaatcatgagaagaactcattgccattctggctctcaggccccacctctggaactttgaaattcaagagaatgagaaattgaatacttaaaaacttcaagtgattctgataaacacagtctgagaaacagaattatagattgaccttagccaatttgcacacatgccttttagattctttttgtaaaacatcgtcagtcactgaaaagtttgggatgcatgagaattagctactctcctatagctttgcccccagagggcaaaagaagggaagtcacaggacaagttatgatgcccataaacatatttattaaatgaacaattattaccaagaaagcacagcactgttcataaacattcttctgcaagctcagtgaggtcccagctctctaacttgctgcaccttgaatcaaatgttctcccgaagcagcgacgctgaatggtgggattcagctacacccagagctggtgccaggtgacagaaagcctcctcagcgaatgactggcacaggatcactaagtgatgctaactccagaagcatttctaagaactcaggttacaggcctcgccagaatcttttaccatcttcacacaaggctgggtgtgtctctaaaaggtgttgtggcaaaccacagacccttaatgcctttaagttcactactgatatctcctttctaacatttctttaacatttatgctatctaacagaccactgatttcaccaaagaaaacccagtttggcattcagttcattagaggacttgttgattcagtgaattaagttgatatgggaataaatagtaaaaatctaagagtcaccccctctggtgtgggtgtaccgtttctgcactaaaactcttgacacctcttacttgtggattcctgatcagaagaggaactgcctctggatcgcaactttaactaaaacacaaatgcacacaactctataccatctgtgctgaaaattttaaagtaggattcaaatgttaaaataaacacatcttaagaaatactagtatagtggaaaggagaattgactttgttctaaaacacgagctttggaatcctgcatacctgattttgaatatggctttatcacttaattagtggatcctttaatactgtatcttactttcttcatctattaaatggcaatagaatctgttttctgaacactgtgtggcataaacttaaacctgggatctgaccctaggaaatgctaaatgctgactgactttccaatgcatcttgagcctttcttttaactctgtaagagacagcctcacaaggaacactggagacttcagaccattatttatttaatggcctctcatcaacttctgcaccactcaaagtatttcttccccacactcactgaagaaaagtatttttcctgctcactgaaagcctcaagtaaaggctttcctgccgtcctacactctgttttgtttccaaacccttaaatacgtccacattttgtttcttttgaagttaagtcccggttgtgtagctttctttgcagcccaggctgggccgtttcactccagtgtgcaattttatctctctgtgcttgctccctgctaatgccggcaaagtcttagtcctcctttgtaacatccatgatcagatgatgtttaatcaccaagaattcttttaattttttttttcttggggataagcagacaaagagatccgttatttggcatgtttcttcagtaaagtgtgttttagctgctttaacatgttttattttcctccaactagaatttttttagataacactccattaatgttaataatcaaaagaatgttaaacacaataattaaatttacctattgactgtttacgtggtaataagctttctgatacaggccggaatccatggctatgagacagcagtatgatttttaaatttctaaattttctttgttgtggtcatttttatttcctcttttgttatcattaaaagaaaaaggagctgtgggctgaagaggagagataagaagcttctagagccagtcttactggaagaggagttctaaagaactcaatggggaagcaggcaggtcttaggaaggtaccaaagcaagtggtgaaggcaagagaaaaagaaagcagtggagctggcctgagtttgataggataggatttgtgttaatgaagtttaataagagggcacatctctttccagctcaccagtacataactgtgttggtcagttttggctgctataagagaatactataggttgagtggtctaaacaacataaatatgtttttcatggttcttgaggttgggaagtctaagaccaaggtatcaaaatgcgggcagattccacgtctgctgagggcacataatgagaagctgcagacaaccattttgttattgtatgttctcatcgaagaaaaatagagacagagagagaaagacagagagcacacactcttaagtctcttcttatgagtgcaccagtcccatcataggggctccaccctcatgacctaattagcccccaaaggccccactcctaataccacccacaggggctcggggtttcaatatgtgaattttgagggacacaaacatatagtctataataatggcctctcaatcctcattgaaatagaccatggattttaaatattaggttgtgcaaaaccagttggggtttttgctattgaaagtaaaggcaaaaacgagctaaccagataggtatgtaaatatagatttttatcaagtagttatgttttaaaataattaggggatgtggttatcaggctccttagctatttattataggaaaataccaacactccttcaagcatttggctgcctgaaaatttcttagtgatggaatacactccatgaaaagcctcccagatagtttcccagaaatccttggtttggctcatccatcaaagaatacgaacttgcagcatcccattcagaatccacttgtcagcactgtgaagtatcagctgccttgcttttgtaccaacaggaaatctattgtttagaagtttgttttctagctctttttcattgttctcccaaaaagaaaaataatggaatgagacacattttatcaaatgatataagttagacaatgtgtcatttcaggagtgtgcaaattgaatcctaaacaaactttttgaaggtacgtattgattttctagggatgccgtatcaaagtaccacaaacacggtggcttaaaacaacatagttctattctgtcaatgttctggaggctggaagtctaaaatggaggttcaacaggatcctgaggtgtctgaaggccccaggggaggatccttcaactcctctggcttctggtggttaccagtaatcctcgttattctctggcttatagatacctccctccagtctctgcctccatcttcacatagtctcctcccctttgtgtttccgcatctgaatttccttcctctgataaggacaccactcatgggattaggtatcatcctaatcattatcacctcatcttaacctgattgtatctgtaagaaccctatttcccaataaggccacattcataggtttcacagttaggacttcagtgtatctttttggaggatacaatttagcacatagtaaggtataaatgctttattttacaaccccctctaatgaaaaattagcagacttcctaaaggagattcatacttctaattttatattatctattctcaaagatggctcttatgaagttaaaagtcaaacacatactttgagaaatgtggataactaaaagttagaggcattcaaacaaacaaaaacaaaaagtatcgtgcatagtggataaaaatgtgctggtcataagaatttgatggtcaaatttctgaatgtgattttgtaacctctgcgtaggaccacgtatagaattgcaaggaaaccaattttaaaattctccaagggaatttcatgtccatatgcataagagagagaacttatctctgataaatattggaaagctttgtgtaaaaaaacaaagtgtaaatgataagaaaatgtatcattggtttgaaagcacattctacgtggaactaaccgaatgttgtatcgttacatttgggtccttacacatgtaatgtagagagaagagaacacccagctaagacttggggttagcaaccctcggagcaggattatacttagggacaaggggaaagaatctggcttcattgctttggttgacccgaaaaattttcaggaacaaaggaatttgtaacttgaccttgatatgcagcaccatgggaacctcccactaccaaataaatgaaatcattaaagactttacttgtagatagtaataatactggaaataaaacaaccacacacacacaaagagtgcaattaaaagaagaaaaaaatcttaaatttgctttcatttttccttagaatgtagttccctttccaaaattacatgtatttaagaataaattaagtcatctttttgtcatactgtacttgtcttggaattttgtacgatgggcatctactaaacagtgaagcataagcttaaaaccatagaaatattacaaagtgttcccagagagttgtttacgctaaaacaacatgaaaagttgaagagaacaccactggcaccccatcgatatacattaaatcccttagcagcagtaagaaatgtcctcacatttaacatataaatgctgggcaagtcagctgtcttatatctaaaatcttctcataagaaatgccttcaggccaggcatggtggctcaagcctgtaatcccagcactttgggaggccgaggcgggcagatcacctgaggtcaggccccagcctggccaatatgatgaaaccctatctctactaaaaaaaaccacaaaaattagccaggcatggtggcacacgtgcctgtagtcccagctacttgggaggctgaggcatgagaattgcttgaacccaggaggcagaggttgcagtgagacaggatcacaccactgcactccagcctgggtgacagagcaaaactccataccccacctgcccccccaaaaaaggaaatgccatcaattaaatatggttatttccttcaaaatataagtccttaaactcaaactgtaattagattaatgtttgatttttctctacactggctgaaatagtaaatctttttatcttttttctaggcctgcttttgcaaatgtttttgaattcgctttgatgttttcattcatactgtctgttatagaactaaggcctacattcattcatttatatccaaagagattatgggcaactaacaagtagtagagcttggattaataaatattttctgaaaacctggcattattgttcatgttgaggtagtgaacaaatcaggggaaaaagtgcttgctcttggaagattacattctaggccagatagtaaaccaataacattggttaaatgagtgtatttgggggaaaattaatcagggaggggacaggaagttcttgggaggggattgaggattatctttaaatggccagagaaacctttgattaagaagatagcatttgagcaaacccctcaaaggagtgagaacacacacaccatgagaagatgggagagaagaacactcttggtagaggggaaagcaagtggaacccgatatccagctggtgtgtgcagggagcgattaggaaagggagtcagtgtggctgagaaaaggtgaggttggattgtgaagggtctttaacaatgactgagaaggttggaccgagtgaatctagtttattttaaaacagtctctcaggctgctgttttggtaaaaggctgtagttggatgagggagaacagtggcaactattgcagtaatccagatgaaagaaaatcgactagattgtagcagtggagccagtaggtaatgatcaattctgcatacacatttggaggtccagccagcaggacttgcagacaggtgagatatggggtgtgaaagccaaagggtcaaggatgacaccggtcttcctgacgaaaaggctcatacctcccctttccactgttttacactttctccttcccctttcacaatttgaggtccacttcactgtgtttccctgaaaatgacttttgacctatacatcctaaaactaaggaatttgttctgtatgtggtcatagttccaccaaaattaacggaaccatggacagctccctcccaaacaaaattcccagcgtcctgtctcttctagtttcttttgatgggttctcagtcagttccgaaattcctcagatcaagtcttggctgaatgctctttctgctgcatctagggtcaagaatctactcatctaaaacctgctatggtaaattaaaattccaatcagtctctaatttggggaccttgccatttagaaataagcaaatggagaaccctgacttaaagctaagaagctgttatactaaaaatagcctttaaaaatattgattcacaaataacctcctcaagcatatacttccaccttgaaaataccacctaactgtaatcttttccttttggcctttgttccatcagtgttccaacaatactactggggttggaggggggtagaaagtaaactatttatcgcctcttaaaatctaaactggaaattagctctcatccacatttacatagtgctgaatatccttcattaatgctaaagtacttggttaccctatctcacttttgtgtaatatgcctctctttgaaatgctaatttagtattaaaagcaaaagccaactttttctaaccaaatgactaacaatttattaaattttagagtgagatgaggaaatcacaacttagaaccttagcaatttctgtaagttgttaatggttaatttaatttggcttggctaatattatataattggaaattatttttatttactgcttccaaaccttttagttaacattttgttttatatttttcttagtatttttaatattttccctctggtccattattattatgtgattattttttccacttttttcgtagaggagtttgtcctcccctaattgtagtgagtcacctagaaactctgtgtcaattaacattttaagcagtacctgattatgcaaaaacaactccttgtccttgaaaatattcaaatcaatatttgctattttatgcaatgttcctcattttaaaaaacactttttttaacttttatttttggttcaggggtacatgtatagggttttctatataggtaaattatgtctcatgggggtttgatgtacagattatttcatcacccaggtgtaataagcatagtaccatataagtagtagcttttaatacaaaaaaatttttaagccatcactttctattatgagaatatcaatgagaaaaaaattttcaatctaattcccaaagaactttcaggctttttttatttgtttaccaattatatgcataaaagaaaagagcacaaaaaaaggaattacacattgaaattgaacatattaacctcatcagaaactgtttttccacttggagattggaaagtatttattatgtagcccaagattcccaagacttttttttatagctcccacaagtaaaatttgattagagctatgttttaaactaattatcattacaattattgtgatattctacatgcctttgcctttttctggctcttacaactggcttgcattggaaatactcagatttaaggaatgattacaagaagttttcaaagaaaaatatcataaaatttcaaaaactctttgactttcaagaattggcttaaccctgcggccatttaccattgacatgttctgctttcttttttcttgatactgattttgctcttttaaaatgattagcctaaaagaacatcaagatctgactgtgaaaataatacggataacactaaagataagtaaattaaatattattttgtatgtgaattttttagcaaatatcttctatatctaaaatgctcttaagtagagaaactactggccaaatttttaaaactgtaatgccttgtatatctggtgcaaatatgtgataggtgtcaagtgattacttgggaagcataaataagtctacagtttatcctatgaagttgattttattgtgctttaacaaaaagaaaaagaaatctttaatgtatccttcatgtttcatgaataatcagtgttaaaaaaaattcaaagagacatgttaaaagcatagtaaggaaggctttattcagaaccattgcaatagatacagggaccactgcaatataattttgcagcgaggaagagagattgggctcaactccaagtataggaaggacaagcgggaatttatagcaaaaagcagggttgggtcagtggatagaaaattactacaaagaaacaatccaggagtataggggtttctaaccaaagccacctaaccagaattcttgccaaaaacaggctagagtgatcagacatcatctgtggggtggtgcaggaggaacgtggtcaggtatcaaggatgatgagatactgagaacgatcagctctcaagggcggggagttctggctaaactgacttcgcagggttcttttgctaaaactggattttacaagagagtaaacagatgggcctaggagaaagttcagagcctgattaaaatttggtaaagaaaagaatcttcatcatgggttagttcaggtactctaagaagcagaggttaagacagaatcagacaatcaaaagatttattgggcaagtacttctaaaggaaaaagaggttaaagaggagctctgacattcaagaatggtgaaagggaaggatgagtgagtgggtagggccccagatggttgcacagctgaggcagtattggccagtctctagcaaaaattgtctgttagaatcctgtgtcagaaagaaatggcctggctctcttactcctgctgtgttcagactgagggcagtccaggcagcgtggcctcagctggtaagcatctgtggaccctatttagagcagccaactctgacctcaggtaggaagggaaatgtcaccagggcccttccttagtagccacaagtcatttggtaatgacacaaaaatgcaatacataaaggtagttacaggaagttattttaaagcacttcttgacaaaccagaaagaagtttgtgtttttttttccccaacaaagttgatatttttgtttgcatatctaatactctatgacagaacaagtaggtagaggagatgaatttagcatacttacttttttgaactgctggaaattcaagtaatattcttatatgtacagaaacaaacagaatgggatcccgtgcctataactgtgatggtctgttattgcttattttgtctgcttgcctgttttgtttctcctttaggcaatcaattatttgtatgtaaatttaattattaaatttattattatttacatgtctctcttttaactaaaaagttaagttctttctggttctgtggcttgttttccattgttgagtttttaaaaagatcagattttaaaataagttagtttttctagtttggtttactcacgtagtaattaaatagagcttttgctgaactcacccctccttttatttttaatttctctttctactttgggttccctttgtccatcccagcaaccagatgtttctcaagtaatgaaaaatattttctactcctcctgggaattttattttattttattttttattattattatacttcaagttttagggtacatgtgcacaatgtgcacgttagttacatatgtatacatgtgccatgctggtgtgctgcacccattaactcgtcatttagcattaggtatatctcctaatgctaaccgtcccccctcccccgaccccacaacagtccccagagtgtgatattccccttcctgtgtccatgtgttctcattgttcaattcccacctatgagtgagaacgtgtggtgttcagttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaatagtgctgcaataaacatacgtgtatttgtgtctttataacagcatgatttatagtcctttgggtatctacccagtaataggatggctgggtcaaattgtatttctagttctagatccctgaggaatcgccacactgacttccacaatggttgaactagtttacagtcccaccaacagtgtaaaagtgtttctatttctccacatcctctccagcacctgttgtttcctgagtttttaatgatcgccattctaactggtgtgagatggtatctcattgtggttttgatttgcatttctctgatagccagtgatgatgagcattttttcatgtgtcttttggctgcataaatgtcttcttttgagaagtgtctgttcatgtccttcgcccactttttgatggggttgtttgtttttttcttgtaaatttgtttgagttcattgtagattctggattttagccctttgtcagatgagcaggttgcaaaacttttctcccactttgtaggttcccatcccactctgctggtagtttcttttgctgtgcagaagctctttagtttaattagatcccatttatcaattttggcttttgttgccattgcttttggtgttttagacatgaagtccttgcccatgcctatgtcctgaatggtaatgcctaggttttcttctagggtttttatggttttaggtctaacatttaagtctttaatccatcttgaattaatttttgtgtaaggtgtaaggaagggatccagtttcagctttctacatatggctagccagttttcccagcaccatttattaaatagggaatcctttccccattgcttgtttttctcaggtttgtcaaagatcagatagttgtagatatgcagcgttatttctgagggctctgttctgttccattgatctatatctctgttttggtaccattaccatgctgttttggttactgtagccttgtagtatagcttgaagtcaggtagcgtgatgcctccagctttgttcttttggcttaggactgacttggcgatgcgggctcttttttggttccatatgaactttaaagtagttttttcccattctgtgaagaaagtcattggtagcttgatggggatggcattgaatctataaattaccttgggcagtatggccattttcacgatattgattcttcctacccatgagtatggaatgttcttccatttgtttgtatcctcttttatttcattgagcaggggtttgtagttctccttgaagaggtccttcacgtcccttgtaagttggattcctaagtattttattctgtttgaagcaattgtgaatgggagttcactcatgatttgactctctgtttgtctgttattggtgtataagaatgcatgtgatttttgtacattgattttgtatcctgaaactttgctgagataagaaattttgtaagactttttggctttcaagaccctaaaaatggttgaatatctaatgggaaaatttgaagtgtttttggggaaatttgaagtgtttttaggtataatgtgtgggattgagggtccgggaatttaggccaaagactttcctagtaacatataattcagcctacttcaaaagttagccttaaacttacattgtctttaatacttttccaatcaaaaaaatccccaagcctctctgacatctagatctttctatctcattcactgaagttaaatacaattagtgccaaagttactatggcatcattcctctgtagaacttaatctataataaccagtaagttcactacctcacaattgggaagagagaccttctctgtttttagacacccttattagatcagtatgcaaatataaaatttgagtaaagatattctctgccagcattggactatatggtattatttccaggagaagctacatgcttcaaaaagtcagcaataaaaaaaaaaatcctttaatatctttggaacttttcctattatctatgggctattgaacaaagagatggactcaaggattccatatgtatacatgattttaggtttaatatttaaaataaaagaatatttgaagggcagaaaatacatgtaaagggggaattgcccctagtaaatatatagtcaatgttatatgtagaaaaaaatgttggaagatcaaaagaaggaaaaaattcaattgggctttagggtggaaatgcaagctatcaggctgaatgaagcagacgggtaataaccactatgtaaaagcttagaagaaatagaaatagttctactatttgctagcctagtgcaaaagttgattcgaagagcagtgggcagagattttgtgtgtttgctaagataatacatgtttcataccaggctttcacactttaatgtccttaagaaccttctagggtactttacaaaaaaaaaaaaaaaaaagtctttggctgccttcttagtaaaattctgattcagtaggtatgaggttgggcccagaaatatgcattttaaacagattttctttttttcttatcattttattggccaagaaatcatatgctataaaattcaccatttaaagtgaataacttggtgtgatactccgaatattcacagagtcttgtaactatcaccacaatctaattttcggccattttcatgaccccaaatagaaccccaaaactattagaaatcactctgaattcttccacaaaaccccaaatcgtaggcaaccacggcaaccacgaatctactacttcctgtctctatggatttgtttattctggactttttttttttttttttttttgagacagagtcttgctctgtcccccaggctggagtgcagtggcatgatctcggctcactgcaagctccgcctcccgggttcacgccattctcctgcctcagcctcctgagtagctgggactacaggagcccgccacacgcccggctaattttttgtatttttagtagagatggcgtttaactgtgtcagccatgatggtctcgatctcctgacctctgatccacccgcctcagcctcccaaagtgctgggattacaggcgtgagccaccacacctggccttattctggacattttatataaattgaattgcttaaaaaattatcttttatgactggcttctttcatttagcatgttttcaacctttattcaactgtagtttattcaattcatgtaacagtactttatccctatttattgccaaatatttttacatatatgtatatacatatatgtgtgtatatatatgtgtgtatacatatatatgagacacttattcattcacaagtgatggagttttgggtctttccaccttttggctattatatataatgctgatatgaacattaatttacctatttttgattgcacatatgtttttctttctcttgggtatatacctaggagtggaattgctgtgtcatatgataagtctatgtttattgttttgaaaaattactaaattacttcctgggtgatctcaatgcttgtcattctctctccatactttgagaaacactaatgtaggcaaagatttggggataaaaatgtaggaaaaaaacaaatgtctgttattatcagacatttgttgcactctgataataaaaaccttagatttcatgaaatggagaggaggattagaagagaggcaaagaaagcatcagaaaaataagacactggataatgatgtgaggttagcatcatcaagggacaagttagaaatccacattttaaaaaattaaaacaaaattatagctaagtgattaagtagtataagaaagtttataatgtgtgtttattaaaaggagtgttaagattttatttatgtggagatgatacaataaggttagccctcaatcacttattaaaatcaatttattaagatttaaatacatatagtaaaatttagttacacgaattttgattcatatacttttgaaagaatataaataatggtaacggatcccattgtatgattacagaataaagtagttatatacaagaatgtttattgcaacaacatagtcatcaataactagaaaatgcctaaatgagcaacagcagaaagatgctaaaagatactgtggcaagtctataaaatggagtattatgcagccacccaaagtcgtgattttgaataatattaaatggtatacaaaaaggttaatgacatagtcttattgcaatggggataaaatattttaatacaatacaaatttataattgcattctcctagacctgtctaatattttccatatcagtgaatgtgccattgccctccatccaggataaagaatgactttagtcttagttttatcttaatgcaacaaatccagtccttcacccaatcctatttaagtatttatttattatccataactattcatctcataaatgattttataatccatctgcctctcagctgtttcactgccactgtgataaaccagactaccatattctctctgcaggactgcttaacagttccctgatttatccactgacggtttcagtccattctagttagtcctctttcaatctatcttccactgactttgtcttgccaatttcccctaccctttccaccctcactgacttcctgtttctcttgtgattgcaatacttatttatttgtttagcaatgcaaatttataacctgaattacaaggaccttgcatcgtatggttcctttctgtgttacacacatcattcatcctcacccagccttctgcttctgtgcaccagcatcatgttggccttccttgagctaatagagtgttatgctgcctttgtcacagggatcctacacattctactatttcctctgtctggaatgttcttcagcctaagatgactacttctttctcaaatctcactttaatcaacacttcttcagggaagccttccctttgtctcagcccctggctaaggtcaggttctttagttttgagtatatataatagattataaagatatatgaattagggagattatttgtttaatgtctgcctacctcactgtcgcttaaacttcaaaaaaaggatatatatatatatatgtgtgtgtgtgtgtgtgtgtgtatatgtatatatatgtgtgtgtgtgtgtgcgtgtatatatgtatctcttttttttccttggcttctcttttcctggttttcccttctcttaactttctgctttctacggtttgtctctttcttcttacctagttttgtacccacccattcctcactgtaaaagaaagtaaaacagaattttagcaatactatctctgattcgaagaatgaataattttaatgttctcctttcttttttcgttaaaattttctacagtagccatttgtaggtataaaaccaacatgacaagcacttttatagtactaaaaaataataagtgaaaactacttgaatatatttccatataaaaatgtaaagttcgctgggcgttgtggctcacacctataatcccagcactttgagaagctgaggtaggagaatcacttgagcccaggagttcatgaccagcctgagcaatgtggtgaaaccccatctttgcaaaaaatacaaaaattagctgggcatgggtacgcgcacctgaagtcccagctacttgggaggctgaggcaggagggtctcttgagccttggagtgcagtgatccaagatcgtgccactgcactccagcctggagaacagagcaaccctcttttgtttgtttgtttgtttttttaaagacaaaaattataagacaaaaatttaaagacactgttatactatgcagccataagaaagaatgagctcatgtcctttgcagggacacagatgaagctggaaaacacaggaacagaaaaccaacaccacatgttctcactcataagtgggagttgaacaataagaacacatggacacagggaggggaacatcacacactggggcctatcgggaggtggggggcaaggggagggagagcaataggacaaatacctaaagcatgtggggcttaaaacctagatggcgggttgattggtgcagcaaaccaccatggcacatgtacagctatgtaataaacctgcacgttctgcacatgtatcccagaacttaaagtaaaattaaaaatatatacgtatatatttaaattttcaaaacaggagaaaaatgtttactttagaaaagcatgtctttaattttttctaattttacatagacaagagtttcatgtggtaggaaacaaactagataagataaagggaggtgaaatttgtcaggattatttttaaaaatataagtggataaaagtaatcttctgacatagcacttgtgtttaaatgtacatttgttacttacagttactaataatttattcatgtaacaaaaattgttgaggtttcttcttttttgtcattggtgagtggattttactttccagtatagaatgtccataaacgcaatgtgtccagtaagtttaattttaaaaggctttatattgcatcaataatttcagaattctttaccatacttcttaattctttaaaaacattaagtatatatacatttttattagggaagttaatctcttgtgttatgtcaaagtatataatggtaaatatcaactaaatacattgtttcttttatttttcctttgcacttatatataagtaatgttattttgttttaagacaacagtctcactctgttgcccaggctggagtgcagtggcatgatctcagctcactgcaacctctgcctcccaggttcaagtgatcctcccacctcagcctccctagtagctgggactataggcgtgcaccaccatgcccagttaatttttgtaattttagtagagatgaggtttcaccatgtcggccaggcttgtttagaactcctgagcttaggtaatttgcccacctcggcctcccaaattgctgggattacaggcatgagccgtgacacccagaaatgagtaatgttaaatataggatttctatattgaaaatattatagatataataatattaacttttaagatagagggaaaaaatccaaattattaggatagtcttcagctatataattatagaaatccaacttagtaacgatttaaactggatgaaggggctggtatggcattttgtggtttcacgaagtatgaattctatttcaagcatcagcaaactcttttatatagggtcatatagtaaatattttaagctttttgggccatgtgttctttctcacaactactcaactttgctttgtagcagagaaacagccataggcaatacaaaaataaatgggtatgtttgtattccagtaaaacatttacaaaaacaagtggtggattgcatctagcatgcaacctctaatttaacaagttctaatctatctagattttccaccatctttagtacattgtttctcactcttggtcaagatgtcttccatccccattccatacagcaggaagaaagaagtgaaaagagtcatggagcccctttctttaaggacacttcctgaaagatgctgaagatatttctacacatatcctgtcagccagagcttagtcctgtggctacaactagttgcaaagcaagctgggaaataaaattcttccagacattcatgaatccagtgccccctcccctcaaataaaaggtgcagggagattttttactgaaaagatcatgaaaacagattgtagggaaaactgacagtatgtaccaatattagtacacagaaatacctatattaaccctttttccaatacataggacatttttatgttccttcaagtgagaccttcccaaaatctcataagttattgcatccatctcaaatccatctctgatgatgtacagaactctacgtcaggtcaaggtttcatttcttgtggtagagtagtatataaattaaaaacctgtttactgtgaaatacactcctcttatgaaaataaaagcatgagagacacatagccattgctggtccatagcaattttaaaatcttgctaggcaggaatagcaaagaggctatttttccagtgccttttgtgacccaaagtttcactctcgcagaggtccctatgagaagccatatcgtgatcctatctgagaagggcattctgctttttcctgtctagtgggctgcatgctttcataactgacctcctgctgatacaaattagtgattaaggactgctgaagtcattgaaagggcacaaaactttgcaggccatgcttatggtttccttggcaatgtaagtttctcaaaaatgttatagtcttctaatctattttctttcaggcagttctatgtgcaaataaccacacctaaacatctgttcttgacatagtttaaaacctgttgactattctttttcatacttacctctgtgttctgccaattcccagtggaggtgagccctctaatctgccttcaagagaacttgcacctccctccttttcttctctctgcctttcagctaatgtcaaactaccttgaggtcctgaaaaagaataaacctttagtggacgatgatatcctcaatctgatcactgcaacagtgctgtgccccagtgtctggtagataacccttacctgaaggttatgaaagacatcctggggccacaggcttacttccttctaaagctgcctcttggcagctgtggtttagacttacaccataatgcagtttaggatacagagttattttttatttttttcatttttatttttttaaccctttcaagcttctgaattagggattttccatcattttagactgtcaacataagaagaaagcaccttctacttcacagtagctttactctcatctcagcctttaggctggtgagttctagactaacttcatctctctcctggagactttgctaaacacagcaagaaggagccagtgccagtgcgcaagagcacttgagtctttccaagcatttctcttaacatggaaagtctcagttggcacctaatttgccttccaaagacagcagttgacaatataaccaaatatttagctacggtataacaaagatctcagctttccacagctagagtatcccagtcttcaaggcctggtgtccaccacaggcaattccatatgctttttaggctttgtcacacatagcaccctatttttatgtatagtacaaactatggtatgagtttggattaggttcagcttgagtaacagagactgaaattaacaagatgaagatttcttcctttgttatatgagagaatatagaattagactgttcaaggctaatgcagtgttccatggagtcaggaagctaggctttttccatatttctgctttatatttagtacaagcaaatatcccaaatggcaatttgagtgccagatattacatccaagttctagataggaggaaaaaagcatcaaaagatatggggtgattctcacccttcaaggccactcccctgaaatctcatacaatgtttacgcatgtatcacctcattggctggaacatattaatgtggccacatatagttgcaagggatattggataaccaaatatccaggtaaagatctaagtctatgcaaggggggaaagtaattattgaaggctaattagcatctttgtaatactcctatatttgatattaaacagtttatattatctgtgaatttgattatagtttgtgtgctcaattgtatttaataaagtggcattcaatatttattccctccgtgagcaaatcttgaaaatttgtatacggctgtttaacctaaggatatttttgcatcagtgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtcctggactctttttggttggtaaactattgattattgccacaatttcagctcctgttattggtctattcagagattcaacttcttcctggattagtcttgggagggtgtatgtgtccaggaatgtatccatttcttctagattttctagtttatttgcgtagaggtgtttgtagtattctctgacggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgcgtcccagagattctggtatgttgtgtctttgttctcgttggtttcaaagaacatctgtatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccgactatgtggtcaattttggaataggtgtggtgtggtgctgaaaaaaaatgtatattctgttgatttggggtggagagttctgtagatgtctattaggtccgcttggtgcagagctgagttcaattcctgggtatccttgttgactttctgtctcgttgatctgtctaatgttgacagtggggtgtgagtttggaaaattcatttaaaggagttcatttctttttcaagttttcaattatccatcatcctagcctgaagctttttataacaaattatttagagtagtaaaattagttttttaagcaatagaatattttttaattacgcatttatatctctgttattcccaatcatatttctgttctccacaaacagctttattcaataaatttcttgcctttaatttgagagaaaaatggaccatttcccaaaacattaggatctattaaaaataatgtggatggttatctaagagcttttttttctttagcttagaaagcaaaggattatacatttcttagtttccgtatggcagaactattaggaaaaaaaaaagaaataagatcatgaaggtatagtgtgtagaataggaaattaagaggccagagaaagtatctttggaattaggaagctgtctaagacattgatggcttgaaaagaagtaaggtgtattaggtgaacaactagatcacaaggttcaggagagcaggagctactcttgattttgtttatcccagtacactaaaatataacacagtgtctgatgcatgcaaagcactcattatacatcttttcaatgaattcataaggataattaaccatattttaaaaactattagaaatgtttatattattgtgtcctagaagacaacagtgtgcatgatttaagcatttttattttttgcaatcacgttattaaagaactctaagttgcatcatgccacatcagatatgtaatccattcagccttatgttttcatctctggctgtagcattaaagcttaatttatagaaaggtgtgttctttccctagatatcaacttaaaggttaaagacatactttagaacactttagtctttcctcaataaacatctccagtttttcctcataacaatttcatcaaatctttcttcaacttatttgtatattttaaatttatatggtcccttaaaaaatcacatgctgattttatttttactttttttttctagtttatcatttgtttttcaaagaaaaatatcttttaaactacttgtttaatgttaaacaatgagctgggggggcattttgtttttgtttttgttttaagtactctattaattttcattgccagtgaagacctaactggctaaacaaagatacacctcagcagtattcttgtttgaaacaacatatgtaccaactaggaaaaatgcattgttaaaattcactgcatgcctgtaggtaatggcagaagtgtggaaaggcagcctctgactttttaaaacatccatgtttcaaaataattttaggaaaataaatgtataggcctggcacagtggctcatgcctgtaatcccagcactttggaggctgagacaggtgaatcacttgaggtcaggagttcaagaccagcctggccaatatggtgaaactctgtactaaaaatacaaaaaattagctgggcatggtggcacacgcctgcaatcccagctactcaggaggctgaggcaggagaatcacttgaacccaggaggtggaggttgcagtgagccgagatcgcgccactacactccagtctgggatgggagacagggcaagactccatctcaacaacaacaacaacaacaaaaattagagtatttaaaactaactaaacacaacttatttatagtggtataatatatccatttaatgttttggaatgccatgtctgcctctgtgaaactagactgttgggtttaattatgcggttcttgcttttctgaagaggtgaaagaataaaatatcttggtgggaggaaagtcctagactgagggaaggcatggaaatagtttgctttatttacaaagaactgaaaatgaagcgtaactcctattattgctgtataattattgatttggcttttctttttagccagtcaaatgacagctaagattccctaaataatagtgggaaaaaatatgttagtcacagcttccatctatgtgttgaatacacagaatgtaatgttttcttattgtgattaaacacataaagcataaaagttaccattttaactatatttaagtgtacagtttggtgacattaggtacatttaccttgttatatgaccatcatcactattggtgtcttcaggacttttcgtcatcacaaatgaaaactgctcattaaaaactaactccctatttcttcctcctccagcctccagcctccactaaccagcattctattttcctttttttttgagacagagtcttgctctgtagccctggctggagtgcagtggcacaatctcggctcactgcaagctccacctcctgggttcatgccattctcctgcctcagcctccccagtagctgggacgacaagcgcacgccaccacacccggctaattgcttttgtatttttagtagagatggggtttcaccgtgttagccaggatggtctcgatctcctgacctggtgatccgcccgccttggcctcccaaagtgctgggattacaggcgttagccactgcgcctggacaccagcattctacttgctatctttatgaatttgaatattctaggtaccttatatgagtggaaacatataatgtttgttcttttgtgcctggcttatttcacatcacgtttctttaggatccatatatgttgcagcatatgtcagaattttgattcttttcatggttgaatcgtatttcattgtatgtgtctatcacatcttgtttattcattcatgcatcaatgaacatttgcggtgtttctgctgtttcactattgtgaatgtactaatgatatacaaatatttgtttgagcctctgcttccacttcttttagatatatacccaggagtggaattgctggattacatgttaattctattttaaattttagagggactgcttcactgtttccacagcaatgacacgattttacatcccactagcagtgtacaaaggttctgattgttccacatccttgccaacacttgttattttcaaggttttactttgttttgcttttgtggtaacagctcttctagtgggtgtgaaatggttttctttcacaaatgaggtgaaacgtatagaagtgaatgtttcctgtcctcacttacccttggcttttatacttagcccatttcacatttcacaatgagaccactagactataagttctttgagggtaggaagtatgtctgtcttatttaccagtgcttttcaacttctaatataatgggtacttaatacatgctgaatgggtacatgcataaatacaagaatgtatgacaaaagtaaatgaataaacaaacaaatgagtacatcttagaatccaatagaaagtattgctaatttttcttttgttggtcaggcaagctgaggaaatttctaagcatcataaaaccccaaagctgatatgaaggggcttgttaggtttttctacttaaaaagcatacatgcccacaacagaaatattcattggcttcttactagttctaggaactcttctgagcattttgctgaacttatctcactaatcctcatgatagccctagctgctggctctaccttatgatgtccattgaagagcctccagtgatgtgatttgctaagaatcctcagctcttaagagtccaagtggagattggaatctaggtgtgtctgactctagacactaatctcttttagccagcataatatattgttcaccagaatgcctgcatttcattggcattttcttaattactgaaaagtaattaagaaaaggttaaattgcaatcactgcttttgatattccacaaacatcttacgttaaaatttaatgaaatcaaatagatcagaataaaaaagcaaaatgtcagattagctacattttagaaacctctaaaatgtgggaaagctgttctgcattccttttgtagctgtctgaattttgcaattatgaatgtgcattattttttctcatgttgactttcctcatgttatttataagaacaagagacttacatatagttgagcactttaaaatatctgttctgagcttagtgggacttaagaaaagctctcttccttccacaagtttttccttattgtctccacaagaatacttgaaattctcatatcatgtggtcttttggggtaaggatttaaaagcaggagtgaaaatgcaaatgtcatcccaaagagttgatccattaagccgttatcagccaccaataccttagcaggaattagttgattagaaaccaaagaatctagagagaattaactgtgtaaaaaaaaaatcacatactctagtaggccagaataagctggcacttatacaaacaaaatctagagacaaatttttggaaaaaaaataaaaatagaggtaagttgggacaaaaataacgagcaagtgtcaggttggccgcgaatgacaggaaagaagcaaggtgggctacttcagtcatatttttcttccacatcttcccacaaagaaaatgagtttccaactggaaatgggagaacttggcaagtatcagaaaaaagaaactggaatccacgataaagagggagagagcctctaattgcctgtgaaaggagctctcagcaaaggatgtagatcagtgatacaaattttaacagttaaaaactaaatcatacattctgtgaattcaacaactaatatagctggaggttgtgaccagtacatttgtttgagtgtccaggtcatccagggtcaataaaagtacacagcttctccactactgtagtcacaatggacggttcctcagccacatgtgtgcaaggactgggacgactgaatcgactatttagagggccgaggccagaaactacaggcaagaataagccttccatctctggaaatattataaaattaattcttaaactgataatttatcagcacagtcattaatgaagcaaacgggttgcactaagaataattccagaactaatttcttttaatagaattggtagttggcaagatcaagaggctttcactgacaagtaaaaatcattggagaggaagcccccacccttatacatgcatataccatttgaaataactactataataaaccagcctgcaggcgggtgccatattactcagctctcttggtgcagcagtggttgggaactggagagacacagtaactttaccatgatttttcagcaaggtctttggcaaaatctgtagttgaaccttaaaactctagttaagttaactagcttttccttcagtatgcatttgtaacctcaaattaaatagacacagaccaagaggaaaggtgaaggaatctgctgcttttacaaagcgaaggcacctctcctcatctgtctctaccttgaaactgcaatgaaaaataagacagaaatgggatgagaaaacatgataggatttccagtgactgttgtctggtgattaagggattgagcacccccccacacacacacacacccacgcatatacacacacaggtatgtataccacattctctactaccaccatggataatagagtgaatctgagttcattgaggtgaaggtgggtgaaccatcttttataattcttacacattataaaaatgtataacattcttataagttatacattcttataatttatatatacagtattaaaattgatatacacagtattataatttataattatacattcttgtaatttatatatacattcttataatttataagaatgataaaagatccagttttttatagaataatggtagaagttgtctccaaggctgctttattttaagaagacttactgaatgttgtaagcagctagttggtgtatttgtaacataagatacgattgccagaatcctggcctcatggtgcaggtgtaagcatgtaagtgtgtaagcatctctgcccagggaggaaagtatggaggagggcagagggcatggctctccttcccactcatgaggccttctgacatatcttctccaaactctggaccctagtcttgatatatggttcttacttagtatatctcaattttttttttctttaggcactagttcagatcgccatttatagttcttaatttatgctttacatcttcctctactcttttgttaggtcctttgtcacggtgcacttatgacatagaaatggtcaaccaagaaaagtcttcaagaggcaaccctaagccattactatgattcccttcttatgtaatgtttttaatcagtgattcttctggcataataaatatatttggcctttggctctgactcctggcacagagcccctaagacccttggagcttcctgagtggcaggaatgtcttttattggtcacaaagagtttcttttgatcacatccaacttagggcgaaacccctagaaagcctcaaaatgaggctggtcaccagaaagaccaaatgatgagagggttggaatcttttaccccacctaccaacctcctagaagggaagcagggctggagattaggctctatgaaaattcctgaatgacaagagttgataagcttctgagttgatgaacacacagaggtgctaggttagtggcatccccagagaaggtatagaaactgtgtgcaactactcccccggtgcctcccatcatgccttttcctatgcatttcctccttttacctgttcctgaatgtgtccgttgtgataaaccactagatacaaataaagtaccatcttgagttccctgagatactctagcaaattattgaaccctaggagaggtttgtgagaacccaagatttaaagctggttggtctgaagcattgatgggttggacttatgattggcatctgaattatgattttggaactgagtccttcacctgaagggttttcactaactctgggtagttagtatccaaattgtattgaattgttggataaccagttggtgtgtagaaagttgtagagttgctttactcccaaacttataacatccttctttttgccatcctaattggtatgaacagttttactagttgtacaagtcagtgatcctgttcatcatccttggcttcaccctgaactcctcatcaggtaaaaacctgaacatttggtgtcagaaatgctgtgattagagggatcgttattttccctactctgattataacatcaaactacgcttatcaaatttacagatgacacaaacttggaaggaatatctaaggacattatggaaaggttaaaaaggatttgaagagaaatgaaactatctgtattcaagcttcctttctaccactaactagtgggactcagttttcttataaaagagtaatgtttggccctgggagttgagtaaactgctcatacaactagggactagtgagtgactgaagcataatcagagcctaggtatatttgccttagcttttaaccagaatatcagagtggtccaagcaggaaattatgcacctgaaataaggcaatggcagtgatcatggaaagggatgacacagaaaaagactcaaaggactttgaggtacaatgttccctggtaaaagctaaagagaagggcctgaagaattcaggttgaagccaaggatgataaccaggatcgctggcttggacgactagtagaacggttctatcacttagaatggcaaaaagaaggatgcaaacatttggaagtaaagataaattctattataaatgtcaaaaaggagatttcaacattccttatgtaaacaccttgtatataattgggtaaataggtctaaacttcagaagagataatttgggagcaccaatacagcattagccgtggcaacaatagtcaaaactgtacatatgaatgagagtgcacagaatgaggaaccagcagtaccaaccaagcagtgagggacagcagcattaaggagtggacagaggagacagagacacaaatgagacttagaaaaagcaggtagagggatcggcagagaagcacagggcacggagtctatagaagccaccagaggagagagagagggtcaagcagttgcagaatttggcaaaggaggatataaagactcatcgagattactagaagtgttctccttttggccactggccagaccttgttcacttcttgccccttgttcatctcattgcccatggaactaaccaatgatcagttctcaagacttttccaccagtatcctcactcaggagtgatctcaccagctgcttcagtatctcagaaagttcccctatggtcagctggctttactgttcacaacatgtttcaaaacatgagattgacatgttttaaaaaagctgttctcagctgccctctccttattaaggtataccatgacatggctttggcaatagttaatgcagaaatactaataagaaatgagaacattgttatttgcttcaaggtaaataagagttggcagagtaataaagctgctcaaatacaatgttcggatgatcttacctcacattaatgaagaagggccaagaacacgggaaataatagccgtattttcttctacactggttcaactatatgtactatgatgcgctctattctgggtaccaaacttcaagaaaaataattcatttgaagatacagaaaagagggcaaaacggaaaacattctataagtgtttttgtgtatttgtttttaatgatgaagttatccattatagcaacaagttggacacattttcagaaaggaaggctcctttctgctttcttcatcatttctaaaaatgcggatatttttacttaccactcagaaaatgcctgattaacacctggagaggttcagtactggcaatccaaactgtttagcagggcctcctgggaagagcagagaaaatagctgaaaaaaaagagaaaataattctaatacagtaattatcaggtcgagcatggtggctcatgcctgtaatcccagcactttgggagaccaagacaggataatcacaaactctgaagttcgagaccagcctgaccaacatggtgaaaccccgtctctactaatagtacaagaattagccggctgtggtagtgcacacctgtaatcccagctactcgggaggctgaggcaggggaatcacttgaacctgggaggcagaagctgtagtgagccgaaatcatgccactgcgctccatcctggatgacagaatgagactccacctcaaaaaataataatcatcataattatcaatgtgggttggtttctatttatttatataggtggatttttcataaacagatttggaaaacactggcttaaaaacatgcaattttcatgaagcagggcctcctgcacagtctttaatatacaagggatacattaaatgtgaatgtgcaagggacacagtttctcaaatttatttgaccctttttggactgtcttgaggccatagtgctccccagaacacacattgggaaactgatctaggaagtgaaaagagaagaaggaagtggtagcacaagccaagacagatggaacttgttgactgactgccacataaagttcctgttccagagaaaacagaaggcatagtgatgactacagagagaatactgataaaaggcaaaacttgatggtgagaactctcggcgttctgattcttatctaacacattcacatttttatatttatttccattgatccatggtaaggctaaatgaaaggcactttaggcataataagtaagcattaaaatcataaaatagacaaaaataaaataaaaacttagtatattgtcattgaatgctaacagctacagaatctgaatttgcttgagagctgcatacagaaaatgaatccttttaaacaactttctataataaaagaaccaaaccactattgaagatagtagtaaattttacttaaatttttgaaatatcatacttgttcactttggagagatgactaagtaaatataattgacctagaaataagtacattgggaagttttcatatttttaataatcctatatattttttcaaaacaattggttaatagatttatcctagttcttctttattacctacttagagacctctgtacaaatatgtgcttgttaatcacataaataatgccataagtaatggaaaatgctggtgatttttagcaaatagaaaatagtaaaaatacaggcagtcatggactagagtataggcataactgttaggcacaggtaacaatatttaggacccaagtcatcggtccagggatgtgtggctaagatggaagaggtaaaacagggcccttcacatcaaagcagacttggatccatgatgagacacaattgttttctgtatgccaaagccatgaaaatctttcaagggctcatgtgcttgaattccttgaactcagtttcctgctagaatctctgcatttttcagtcctactcccatcttgactgccatcccaaaggaagatgtgtctaactctggtcctctcaaagctaatgtcttaatccaacacttctattctcccctttggtacatcaatccatcttttgtagttattctatctgcctcctccttcctcttcaacttttaatgggctctgatttccttaacttcacaaatatgcaaataccaaataaaaccccaatcatcccttgactttgccttttcttcacaggaattgcttgtctctttcttcacttagtgggtgaaattattggaaaaataaccaataactgttgactgtagttcttcccttgccatttatttcttagggaagcattctggctcttattatcatctctaataacaacaataatggagtaacaggcacttataaccataaatgcattccatagaagatagaaattgttatacagttggccttttcttctgaaaaatctcagtgggtttggttatgttcttttggagacaagactagaagtgaactgatctgcacaatttggagatcaagaaggtaattctagaggaaaggaatagcagagcacggaagctgagaaggagccagtgagattgagagtagataaccctctctgcagtgtgactcccttactgtcacccctagctgtctagcaaatctaactgaataacatgcataccatgaataagcatgttcgtgtgtgaaaacgagggaagggctagtttttctctcccaggttagtgttggtaaacaaagatacatatagggatattctcattacatatgtctacctcccttactgtgggtcttatttaataaaagaatgtttcttcagcgtttgttatccaaacactcattttattttcacaataatctcacagagtaccacatgctattatccctattctgcagatgaggaaattgaagctcagagagtttaagtggcttgccaaggcctacagaaccagtaagtggcaggaattcatattaccttgtacttagtaggtattcagtttatattaaatttacctagtttgagaggcagcatgcattttagtgaattggattgtgagtatattcatcaactcttgttctatggtaggatactgtcttaaatctaatatacaagcaaggactcatgctgagttaatgcttctaatagaataacctagaaatttattattttactgtggtgctgtcagcactagaaaaactttatttggtttctgtttttctcatttttgctgcaaataaagagaatagcctcaggaaggtgatttgcctgtcatttgatctttatgaagaaattacacataattaacttatttcatttttagtaagctactaattaggtgcttcgttgagattgcaaaggtttaattttctggcttccagcatggaagtaaaaaagaatccactatcatagagaaaacaaaatcatcaggagttcttgagcccccaaagaaaataaatgattgaacaaaagaatagcaatgggaggctttaatctgagcatttaaagagaaacagagacggaggaaatcttgcgatcaaagccaccaaatgaaaagagaaataaattatttatttagcagagggtaacatttttcttcgtgatacttatttttcttagaaatcaaacccatcctctctattgtgtcataatattttagatttcacagcatggattactgtactcttttatttttaaatttagccttattattcccaacaggcaacttaacatttaatatctgaaggtcattgctgtacaaatgtgatgtgaaaaaaaataaaatttagcagctgtatcatattatactaatcagaaaggaaggaaataaagaacaaacagcagtgtaagatggctgcagtgtggatgagtgagatggactaagcaattaagtattttgttgcagagagaatctgactgtgtattgtttttctcaaattttcagcttgtattaggtagagtcaaagagaatatagaagtgttgagaattaggacaaaattcagtttatcttatatgaccttcatttgtggagtaaaaagaacatatttcagaagacagatatgctagctcttgaatactaggtgattttaatagtattatgataattttattagagattatttacaatcaagaacctgagaggtttgctgttgttgttgccattgttgtttttaggaatgttcacagaggtcacattttccaaccttagagttttgctgcttgatttcttttgtatttgtagcttacgtggaagcagcaccatgctcagcacaagaaaagcctttcaacaggagtttaagcacagctatatgcaagtgaaattaaacagaaaacaatcccaatagtcctattcttcataagaccttaagacacttggggtttggtttaatttattgaagtctctcactcttttagcatatgggtgataatagtcaagagaaattatttaccatcatctactgatgaaaatcgtaggtggaagagatcttggaatccttctaggattggtaagaacatgaaggtttggggagatgaaatcttgctaaaattatagaactagttagtggcagagatatgattagagtccaggacattaaatatctagttcagtcctctttccactgttcacctctgagtctctgctccctcaatgctaggacccaactattgattatctcttgatttttaaagtgtaagaccatggtactgtttttcatagccacctacaattctctagaactctatggaaaatttcactggcattttatgataccaaccatggaaattccctctcaattccaaagggacattggcagaattttataattaagggccatgtctagtgttatcagccaagttatgtcccccaccagcttaaatttttttaaccaaaatgtcctctatatactgcaggagatagggaagattatcaattagggaaatggtaagaaaatattaaaacttttatttttataaaatttaccaatatcatgcacccacatcagtccacttgcataagtcaagagtgataaaatatttacacaacaatttcagtgaagcaattttattactcacagataggtagcaaaagacaagggaaggttaggatgtatggtgagccagcccccactaaggcacaggaaaactgccaagggcagatgaagtctcatctgtgcatattctgtgttgcactgcagctgagggccccccaaagcacatactgccctgggttttatacccaggggcaatggaattgctgagctaaagcatttcaggacaccctgttctgggaacaatgggaacagagttccagcctgttccttcatgtcttcaatgttgcatttccaatgtattctacagttactctgagaactacaagtgagaaaggggccatatggggacctgtcctgcagtgctgtgtgtcttctaagttagggtatgcaatataaaaaaaagtttgaacaacaatatcttaaaaccccttttagaaagtcagctgtagtcatgaaaaggagtgattctaaggtctctacaaattgttatcacaaaataccacatagtctccatcacaactccttaggtctctgtaagttgtcatcacaaaacaacaaaaacaaatcctatttgaaccctctgccatttctaggatgagcttgctcattatctctgaagatttacatggagtattcaaagcctgcagggtggctccaattagtatccattttgagcattggaatagaagaaaaataactctagtcatcagtaaaatgtccttaaatagttgacccctgaccttactgataaaatttttaaatctgcatgtcaagagaactgaccttgaccttgacatttgatggggcactgcatctgagtggttagaatttgatttgtggttttatatttagtctggaaaagatgaataggctactgtgttagttagttctcacattgttataaggaaatacctgagactgggtaatttataaagaaaagaggtttaattgactcacagttctgcatggctggggaggcctcaggaaacttacaatcatggtggaagggcaactcttcacagagtggaaggagagagagaatgaatgccagcaggggaaatgccaggtgcttataaccatcagatctcatgagaactcactatcacgagaacagcatgggataaaccacctctatgattcagctaccttgaaattttaaaaacttgaaatttttagcctaagtatttcttttcctcatgtaaaaaattcacagaatcaaataaaattacagtgattgtcttaatcacctttgaagagcaagggcagtctacactgatttttttaaaccaaatatagaacataagaagaaagagtgctctttattttattgtgaagtaaatgccctggtgattgttaataagtcaaagagaagtggttttgtcacagaactgttagaatttaagtagtatattattaaagcctattagatcaccatactccttttcaaatttttaatagtaaggtttcaagtctaatttaaactgaaaacgttacagagaataactaaaacattttaggagacttttttccatactaattagcattttaaatcagcctttcagagtacaggaaaaaaaactccataaaattttatttttattaagtgaaaactaaatattctgccaacacaaatatttgctaatatgtatacacatgtgtatgtagatatataaaaagtttggaaggacaggggccaaacagaaaatgggggtcttgaagagggctgggggtagggggagctcatatttatcatgcttctgtattatttgaatactttttcatgtaccatttacttaattaaaaattaataaaatcatcttaaggtacttgtatctgtattttaaatatatttattcaaatgtattttaaatgctgccttacaagaaatacaaacagcttcatataaacaattctatcatcattgaaatgtctactttgacaaattttgaattcacattcattgtttttaaataagttatattatttgttatttataaacaataactattgctattgctgtggtttggatgtgatttgcttccaaaaaaaatgatattaaaatttaatcccctatacatcagtgttgtgaggtggggcatagtggaagatttttggatccatgggggcagttttctcatgactaggtcaccctcctgtgggggtgtgtggattctgttttgcaggaatggattagttcccataacagtaggtcattataaagaatatgacttcttctttcattatgtgaactctttgtgtatgtcagctcctcttctgctttccaccatgagtggaagcagcacaaggccctcaccagacacagctgcccagtcttgaactttgcagccaccagactccatgagccaaataaacttttccctcataaattactcagcctcaggtattctgttattgcagcactaaacaaactaagacgagtactaaaaataaaatattcataggtgaatattgtaaaaattataaaagaaaaaattaaatattctgtgtatacagaaatctgagtttaatcaaagcaagaattttttttccttcagaatgtaataataatcatttaatgggcttatttccaagttttacttctctaaaatcaaacagtaggtccaatgaatgtaatgtgcttggcatatcctcaaaataaatttgcccatttgagaacatcatagagataatccagtaaattggccaaagaggtcatagtaagtgaaaaggcctaaatttgaactgagtcagcttagcttggaagctcttgctgtctctctcagataaaagctcctgcactgcagtaagcagctgcatctacataagtgccggacttttcatgtccagctaatctaccacattcactctgtcaccaatggcattggacacattctgattccaccctttctgtttcgctttggctaatagatccttttctagcctgcatttacataagagataaagatactatccagtagtaactttaacctgaaggtacagaaaacaattctgtgtgtccattatgtttgaatatcatgtataccctgtcaaagggcagcttcccttactcctaagtttaagggaatctgctcactggtcccctcacatgcaacaaggttgttctcttaatgtatgctagaaaggaaccatattttagcacaaatatgtgtcctttatgtaaaatgtcacacttttaaatcacaaaatacatacccccaagcaactccaatcataggaagctcttctatagatgattttctgtgctttttatttttatattctgtaggaatactctttaaccagataatctcattggttcagccagtacccaggcttctagatgctacatttgcacatactaagcaatttatcttggtcgtggacatgttcaactcatctcctcatagtatcttttgcacttggagaagtaggagctccttgtcaacctctagccattaaagagtcttctgaagtttatcttatatgtcctaaaaacacttatatgtcctaaaaacagtgacatattctgtcattgtaacaaataatggtaattattcattttctttcatatatttaaattgggataaagtttaaactaccatttcacactattttttcaacactctctccacattattgacagttcagctatgatacagtatacaatcactatctttttgactattgtctaaatactgcttgctctgtcagaaatgacctcctatctatctcctgaggttcagtttcaatgcctcacttcctatgaccttactctccccagctctcatcagctgccaccgctagatgctcctccctctaggattccataagaatttgttcatatttctattaacacatttattatactacttgagactagttatagacatgcctgcctcttccagcattgtgtgtttgtgtgtgtgtgtgtgtgtgtatatatatacatatatttatattataaatatagctctagtttctggggagaatatctgctccattgcagccatgtaaaaattgtatgtagacaagaacagaaaaccaaacactgcatgttctcactcataagtgagagtcgaacaatgagaacacatggacacagggaggagaacatcacataccggggcctgtcggtcggtggagggctgggggaggaatagcgttaggagaaatacctaatgtagatgatgggttgatggatgcagcaaaccaacatggcatgtgcatatctatgtaacaaacctgcatgttctacacatgtatcccagaaattaaagtataaaaaaaaaatttaaaaaataataaaaagggaaaaactgtatgtagagtgaataaatagattaaaaatggaattgtctgagaagttggttgaacttcttatgaacttttttcacaacttatttaggttgatacaacatggacttcaagagcctgaggttttagaatcagaaaatatctgatatgagctgagacttttattagcattgagaaattggctaagacttgttaggatgatcttgatcagtatcatctgatgattttttttttaatatacaactcctaccccaaacccaacaaggttctaatctaggctatcacacacacacatacacatacacacacacacacacacacacacacacacacaaatgctacaacacatctaaatataagaaaccatttattcatcttaaaagttgacttacattaatagtaatgcattaagtatatacattaagaactgtcttaatcagtttaggttgctatacattgccatagaccatgaggcttaaacatcaaacatttatttctcacagttgtggaggctataacttcaaaatcagagcaccagcatggtggagttcttgatgagggtactcttcccggtttacagatggccagcttctcactgtgttttcacatgactgagagagactggaagcttgctggcatctcttctactagggacactaaacctgccatgaaggctacactctcataacctaattatatcccaaaggtcccatctccaaatcccatcacatttgggatttcaacatatgaattcagttcatagcaggagcagaatgtaaataatgataatggaacatgcaatatttgctaacttataaggcttctaatgtatctaatttaaagacatatatttgagttttctttgatcaaagaaaaaatatgtctataaatgaatgtcagctataaaaacatttgcttatgatctgtcatttccacttaatgataataatgttacattgcatccatgctgctttttattttcaaggcaatttcacatacattatctgatttttcaactggtggccagtttaatgtcagaaatgtttccaagcttctatttatatttggttgtttaaagaagattctatacttatatgtggttacacatgaaacatacatttacttcagcacaccaaatcagtgaaacccgtagcaatttcagttgtgctcatccaaggacaaaattaggttttaggatttaacccaggtggcataataaaatttaaataacttgtttacctgagagcagcagcaacaaaaagagacaatcagaaatacaagccacaacagaacagtaatgaaatgtgatcctaaaaatattaataagtgttgaccctctgaaataaaataactaagaaaaggaaaaacaaaactaagggtgctcccaaagttgataaacaatgcatgaataaatgagcccctccactgtattccttcctttatatatataatacatatatgtaaaagtgatgtatatatcacttttttcacgggtcataaaatttgtatgttaataatttgcttgtttaccattctaatgtgttaaaaccttatacacctttgattttcccattgattactcttaagcagattaggcaatcaatacatgtttgttgaattgcactgaacttttaagcaagggtaaaatgatgccagctagaagcctatatattgtttcctgaatggtaagcagttcaaccaagaaaaaaaggtgaagcagatcgctttctttgctgctgttattcgtaacagtcgaatacaggttaccgtgtttttttcaatataaaatatggttgtcctagccataatcttggtctcgtgctaaatatattattcatgacatataatgagtagcttactttgtaaagaagatgtagtgatgttagcagtaagagtgaaattggccatttccccctcgtaaagctgtgtcttccccaagcaataaaatatggcttggttaagtggaacatgtggataaaaagatgaattgcccactatcttggagcctcattttaatatttaattttactttgggcacatcctgatacactagagaaagcctttatttacttttattttccagcattcattttgttgctctgaaatataccaagtactttactaagtgttaaattagttttaatattgtgaatataaagttttaattttatgaataagtttatagtactgaaatcactcagtgcggcaatgataatactgatcttggacctgattctcgattctcccttttttggcaaaatatggtgcatgggtgacatgacatttcattaatttccattcaccaggttaattctctattgcttatcttcatgtgagtgtgtgtctctgtgtcactaggaccacataaatgggggcatcaaaactacagaccacaatttcaaactgtccttctaaagtgaccagatttaaagatcaagaccagtcatttggagatgaaatgaagaatgctgataattatttattacctattacctgccaggcatcctatcaaacatatcacatgttctctcatttactcttcaaatcaacactggtgttcatattttgtagatgatttgctgaggctaagggaggttaagcgactctgaaaagataccatagctaaaaaatgtcagagatgagactgagtcccaagactttgtgattttaaagcccatgtcttttccactgactccaaagaatgagcagttgccagtagcgctgatttagaatcatcaagcagtcatgttgtctcaccattttctcccatcacccaaaattctacccacgcagctctgttattttagcaaaagactctaaatgctattaaaatgcagacaagatacagtgaatgataacatttaaagatatttagggtcagtccttttcttcttaggctgaccaaaagctaagaggataaattgaactggctgattaggcagaggtaacactaggaaaaaaaaatgtttagaaaactcgaaagacagattttaactgcttcataatttttctctgggctattgttattgctagtcttcagagaagcttgtgtggcacaaggaatactaagtgaactgaatgatctgaaaggtatatatcaaatgtgctgttaaagggtctttatacatagatggtaaaaccccatgataaaacttttgtagatacttcagcattatgcaaatgattgatcactttatgagacaattttgaataatatgtgtgaaattagttttctcctacttgtcttagttctttaaaggattaacagcatccattattctttgatgttattactgttaatatttttgaaaattagggactttttttaataaacgtacattaggatcaaaatatttcacatatcatctgattcttctgttgacctctaagtgatgatgatgtagttgacagatggtaaccctgcatatccaaatcaacatctctttgttttgtatgtgtcatgtagctttttattttgttactataattaaagtaacaaaattaaagatccaggttattatataaaattttcaggaaactatatgtctttttctagtttgacatgtttgtgtttttatccatttcttggtgtacacataaaatttaagtatgtgccatgggtttatgagccagtactcataatgcatcctgaaattttccagtggcagatataaatacagagctgtcatatttacgctgaattataaaacaactgaaaacaatgaaaactggtatattctgagtgggtggcatgttaaacccacacaattttgtcatgtttacttttatttgtactcgtttgacagcagggagaaagtactctgcttaaatctatttcgataagatagttttaaaactttataactttatgtaaaagcttacataaattccctttgctgttagttgattgaaaatggaattctttagtcacacataggtaattataaaatgaatgtccttccatcaacatatgcttccttgtttggatcaaatatatgtcttcgcatttgtagacattttcccttacttttttgttgaacttgtgaagtgaatgttaagtttatgtattcaattatgtggcgtgttacatacagaagttttctcccaactgcaagactttattttgctgggttaaaacacttggctaacatatggttgccaaagataaggtgcctatttaaaaactgatgttcaaaaaagctggtcagtgatagtttttttctgtttcattaaagacaatacatgctttctactgttttctttttttccttcagcagagttactatagaggaactatattcagattatttgtaatactttggaattacatttaaatttatcactgtatttccatgtttgaatgtcagtgagcatgtaggagcatcacatagttattttgtagcaaggaactagaatctaaccctcaaagagatggcaattttaagcatcctgtgtattcctatatgcttaagctcaagcttaattaattaataggccgcaaacagttaataggttaattttctacccattaattttacgaaatttgaaagaaatatttttgatagctgcaaaacgtattacatttctacaaaggaaaactaaatatgacattgtaaatagtgttccagacttatttttggctgtgtcccataatcgaagattttattttattttattttattttattttttttttttgagacagagtctcgctctgtcgtccaggccggactgcggactgcagtggcgcaatctcggctcactgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcccataatcgaagattttaaagcattaaagtttattcatccctattgtcaatcctattctttctggctatattcatcagtcattgccttttcagtaaaacatattaaacatattaaagggatctgaaaacttacatgcaaatgagttgtgtgaatgtggtgaagagagagttgcaggatgttcagatacaattttttcatgttaattttatctcagaaacttcagggactaccacaatttacacagcaaattttaaaatttatagactgacattttgtttcttctttttatttatttatttaattttcaaccttcaaagagtggatctagactgacctttcaaactttgcgtagtctttttcaaatttatctttcaaactttattttccacttgctccactgctccattgctgtaccattgcttttatcacttttttctcaaacatgttactcttagtcctgtttttacttggttgtagtcactgttattctcctaaaaatcatgcattcattcattatcctattatgaacaaaaaatacacactagtcattgaggatataaaaatgaagaaaacatgaattcctacatggaggagcctattgtttagtggaagagatataattacagaggcaaggcactagggtaaaattatcttatctgttttcagattttgatgatcaacaaatcattggtccttccctataagaataaaggtagctattccacattaaaaaataaatatgagccatttgtggaagtcatcttcccttgatggtgagtgaatgaggagggtagttgtaggtcaatcttggtcagtggacttgtttgcaaccctaaaagagagcttgtgttaggacaaaacacactgaagataatgagtgaagagttgtgaagaatttgaattctatatgatgctgatgggcaccagagactaccttacctctgtatttcctcttatgtgaaaagattatatatatatatatatatgcatatatatatatatgcatatatatatatatatatgcatatatatatatatgcatatatatgtgtgtgtgtgtgtagcgtttattccaatttgtcaaagtattcttttgcttggatccaaaagtttcctaacttacctaagtaccattaaaataatcagatactaccagaagcaacctacagattcaatgcaatctctatcaaaataggaattacattcttcacagaaactgaaaaaaattctaaaatgtgtgtgggatcacaaaaatcccagagtagccaaagcaatcctgagcaaaaagaaaaatgccagaggctttgcgttacctgacctcaaaatataccacaaagctttagtaaccaaaccagcataatactggccttaaaacagatacatggactaataaaacagaatagaaaactcagaaattaatctacatgtctatacagccagctggtttatgacaaacatgccgagaacactcatggggaaagggtagtctcttcaataaatggtgttgggaaaactggatatccatatgcaaaagaatgaaactagacccccacctcacacataatcaactctaaatggatcaaaaacctaaatgtaagacctgaaataataaaactgctagaagaagacatagcggaaatgcttcaggatgtcaatctgggaaaagattttatgaataaggcctcaaacacacagataaataaggaaaatgagattatatcacagcacaaatcttctgcacaacaaaggacataatcaacagagtaaaagcctacagaatggaagaaatattttccatctactcattagaagattaatatccagaatatacaaggaactaaagcatctcaacaacaaaaatatattttaaaatgggcaaatgatctgaatagacatttctcaaaagaagacatacaaatagcaaaaaaaaaaatgaaaaaaaattctcaacattactaattatcaggcaaatacaaatcaaaaatcacaataagttatcgcaccgtcagtaggaggctattatcaaaaagatgaaaaataacaaatgctcacaagtatgaagagaaaagggaactcttatatgctattggtaggaatgtaagctagtacagccactccagaaaaaagtatggaggtcctcaaaaaactacaaatagcactaccatatgatccagcaatcctactaatgggcgtttatccaaaggaaaagaaatcattatagcaaagagatatctacacccccatgtttattgcagcactattcacagtaaccaagacatggaatcaacccaggtatccaacaacagatgaatgagctaaaaaatgcggtatatatacacaatggaatactattcacctattaaaaagaatgaaatcctatcatttgtggcaagatgtatggaactggaagacactgtgtaagtgtcaggaatagaaagttcaccaccacatgttctcactcataagtgcaagcttaaaaatgttgatctcatagaagtgaaaagtaaagcacaggatactagaggctgaaagagtaaaggcaagggaagatagagaaaaatttgctaaaggatacaaaactatagctaggtaggacgagtaaattctggtgttgtataccactgtaggataacaatatttaacaataatacatagtttcaaatagctaaaaagaggatattcaacatttcgacattctcaacacaaaagatgagtttgagaggatgaatacgctaattatcctaatctgaccgttatacattatatgtattgaaacatcactgtgcatttcatgaataggtacacttatttgtcaattaaaagtaaaattttaaaaaaatcagaaatattaaaacaaaagatactattagcagcttaaatatgaagggacctgaattctcaaaaagcaaaagtagataaaactgtgagaatttcaactctaaaaatatacttttcataagttaaacaatatttttccttgtgaatttttaagttcaaataatagtgacataggtgcctgctattttgtagggtgaatttcattaattttatgacacttggattccataataacctgtcaagatagatagaaaaaaatatataacattccaaattaaatgagaaaattgataatcctagaaatgtatgttatttgtaaaaatcaacattatagtgcagatatcccgcatttgattataagaactcttctcatttgtctatctgccatacttcttattggaactcagagctgatataataattctgatggttttaaaactatctgtgaacatatgtactaccctaccatttggtgagtttaaagtttggaaatcattaataaatgatattcccattaacaaaataaacatcactgaagatatatgttgagagatgggaaggagttggtgggtcaagagagacactcttttgtcctttgtccctgtctacaacaccattttgtggtctggctattatttcatagttaccactaccatctggaaagaaagattatcccacatgcctgggctcttaaattattgcaatattttttgcatgaataatgaacaaatttataaattataacatcattcctgttatgtttctaatatgaatgatattcacttgcaagtgtagggcctttgccctgattatagatgttagaaaagaatatgtgagaggtgttatagaaataactgaagtaagaatttacacgtttgttatttagtaaaagtcaatatatttctaaagacttgaataaaacaaatgcaattttgtacagaattcttcagtgcattttctaatttctcctctctgatgtgaaaataacacaagatttagaaatcacctgcaataaaacatgtttatttacaaagtgaaatagtttatgttgtattaacttaaattttcctatttccgatgcccaagtaatacccctctaagcgaatcatgattattgacaagtttacttttatacactttatagtactcatttcccataaataatgtatgattctttaataaaattgataaatattcaactctcaataaggcaaaatcctatgtattcaaaataaaatttaattgaacattaaaattcttgtctagttcccattttgtgtgtgtgtgcacgtgtgacttaggctgtttttcctgacatttgtgaagtcaatgagtttttctgctgtacattagtttctccccttcagtgctgccttacagtaccctattgtataaaatatgcattcagtagagaaaacaatatactgcagacatcagacttaaacaaaacactttttattgttgctttaaaaaccagactttacacccctgcactgaaaataggaactatttgttcctagtccatgtgcctggaccaaagcattttaaagtacctaaaaaaatttaaatttataaattcaggtttataaattgaccttattgaccaatacctataagtccttttaactttagaaaaccctccacaaataacaaatatgatcattttcatttggctatttttaatataaattaattttttcttacagaaaggaatgaaaagttttattaattagagcacttacttaaaccaatgctttcaagcaatctttctttggagtcagtgattatctttggctctataccaaaaacttcaggtattttttcttctttgcagtgttttaaaatgtatttggttgggtaaaagtcactgtttttaggtttcaaaatgtttctacaatatattaagccctgatatatactaatttacctctttatgatttgagtgctagattagttttacacctaataatgtagaaaaaaaatttaagcttataaatttgtatatattatactaatttctgaatataagcacaggtgatagcttattatatttgttcatatgcagctcctggaataatcctagaacaacgcatagtttataaaaaaaatagaaggggagtaggaaggaatgaaaggagagaaaaatagcatctgagcagtctgagaatttcacaataatagctgttctaaagtttagatgactataaattattcttaaacagttatgttttgcctatgtttaatatatataaaacagtagtatttgtatttctgtaattaacatttctctagaaaacagtgttaaatatatatttgttatagtctaaatttgtgttcataacatgtaaattgcaagcatgagtttagaaactcatgattttgccccctcctttaaaaatcagttaatcaataatttgtattgatgcactagaactccaagcaagcgtctcagagtgttctatcacaaagaattattaaaaggaaagcttcaaagctaaatcttcaatggtagctaaagagcagataaagactatatgaatctgattccccaagacaagaagttcttataaattaaaggcaaataggcaagtgattaggtaatatgaacatgtgatttaaggtgaaaatcttctttcaatggccgtgaataaatctcctttaaagacattatattgtgttcactaaattaaaatgtgccaattcttcaatgatcaatggcaatttgttttgctttaattagctgataaaacaaatgaataaatagcatcagctaaggtcatctgttctacctgttgctttaggttaatgtgtatttcatcctcagattccttagctctcagaaatttgactgacatgactcaaggaaataaaaatatttgaaatatgtatataatttataacataatgttagttttatgtaaaagcaattcagcaagtctgaaattacttttctgcaatgactataatgtaacaaatagaaataatttgtaacactgtgttctatgtcaattgtacttaaacacttttgagatatggcagaggatcttgcttccctcaggactaataatgtacacttcatctaagtccaaattttaattaacagttcttgttaagatagttttttctacctctaaacctaatcatacttggtatttaaatggcatattcaataaaagttgtcccatttcacctgttttgaagtcaaaggtttttgctttaaaacatttttgaactagctctacagtttttagaagctgtttagggacttcacatactatatgcaggagtaagtaactaattggtgctatactttatggtattgacacattcaaagaacttcattgattcagtacactttctctttcttaaaaacatgagacccttaaccatggtagaattctcattgttaatttattttggctgctctattgcctgttactaagttattctgtttcaagggcaaaagtatattttttccacatggaaaaaaattcaaaaccaggcagtagatagataaaattattctttgccattagcatgctaaataatagtattgcaaacagcagttcactatgcacagcttgatacgatagatgaaaatattagtttatgaatctgatacttaaactttactaagtaaagttagtaaagtaaacagtctttactaagtaaagactgggttctttaaagcccaacctttggtcttttgaatcgttctctatagcaattagtcactcatataaagtgagatattataaaccgcaactctgtttcagcatgtagaattctttatatatatatatagacacacacacacatgtatatgtatatatacatacatatacgtatatgtacatatatatatgtatatgtatactttaagttctgggatacatgttcagaacgtgcagttttgttacataggtatacacgtgccatggtcgtttgctgcaccaatcaacctgtcacctacattaggtatttctcccaatgttatccctcccctttcccctactccccgacaggccccagtatgtgatgttcccctccctgtgtccatgtgttctcattgttcaactctcacttatgagtgagaacatgtggtgttggttttctgttcctgtgttagtttgctgagaatgatggtttccagcttcatccatgtccctgcaaaggacatgaacccatccttttctatggctgcatagtattccgtggtgtatatgtgccacattttctttatccagtctatcattgatgggcatttgggttggttccaagtctttgctattatgaacagtgctgcagtaaacatatgtgtgtatgcgtctttagagtagaacgatttataatcctttgggtatatacccagtcatgggattgctgggtcaaatggtatttctgggtctagatccttgaggaatggccacaccgtcttccacaatggttgaactaatttacactcccaccaacactgtaaaagcgtttatatttctccacatcttctccagcatctgttgtttcctgacttaatgatcgccattctaactggtgtgagatggtatcttattgtggtttttatttgcatttctctgatgaccagtgatgatgagcttttttcatgtttgttggtcgcaaaaatgtcttcctttgaaaagtgtctgttcatatccttcgcccactttttgatgtttttttttttcttgtaaatttgtttaagttccttgtagattctggatattagctctttatcatatggatagattgcaaaaattttctcccattctgtaggttgcctagtcactctgatgatagtttcttttgctgtgcagaagctttttagtttaattagatcccatttgtcaatgttggcttttgttgccattgctgttggtgttttggtcatgaagtccttgcccatgcctatgtactaaatggtatttcctaggttttcgtctagggtttttatggttttaggtcttatgtttaagtctttaatccatcttgagttaatttttgtataaggtgtaaggaagaggtccagtttcagttttccgcatatggctagccagttttcccaacactatttattaaatagggaatcctttccccattgcttgtttttgtcaggtttgtcaaagatcagattgttctagatgtgtggtgtcatttctgaggcctctgttctgttctattggtctatatctctgttttggtaccagtaccatgctgttttgattactgtagccttgtagtgtagtttgaagccaggtagtgtgatggttacggctttgctctttttgcttagaattgtcttggctacatgggctcttttttggttccatatgaaatttaaagtagttttttctaattctgtgaagaaaatcaatggtagcttgatggggatagcattgaatctgtaaattactttgggcagtatggccatttccacaatattgattcttcctgtgcatgagcatggactgtttttccatttgtttgtttcctctcttatttccttgagcagtggtttgtagctctccttgaagaggtccttcacatcccatgtaagttgtattcctaagtattttattctctttgtagcaattgtgaatgggagtttgctcatgatttggctctctgattgtctattattggtatatagaaatgcttgtgattttgcacactgattttgtaccctgacacttttctgaagttgcttatcatttcaagaagtttttgggctgagacgatggggttttctaatataaaatcatgtcttctgcaaacagagacaacttgacatctggcttgaggagctttaagtgaccagatcatggccattgtttcgagtaaagtggaacccgtatacttgagggacgtggtaagaccaatgactactgggtaaataatgaaactaaggcagaaataaataagttatttgaaaccaatgggaacaaaaacacaatgtaccagaatctctgggacacagctaaagcactgttgagagggaaatttatagcactaagtgcccacaggagaaagcaggaaacatctagaatcggtatcctaacgttacaatttaaggaactagagaagcaagagtaaacaaattcaaaagccagcagaagacaagaaataactaagatcatagcagaactgaaggagatacagatacaaaaaacctttcaaaaaagcacggaatctaggagctgtatttttgaaaagattaacaaaatagatagactgctagtcagattaataaagaagaaaagagagaatcatatagacacaataaaaatgataaaggggatctcaccactgatcccacagaaatacaaactaccatcagagaatactgtaaacacctctatgcaaataaactagaaaatctagaagaaatggataaattcctggacacatacacccacccaagactaaaccaggaagaagtcaaatccctgaatagaccaataacaagttctgaaattgaggcagtaattaatctaccaaccaagaaaagccaaggaccacacgaattcacaaccgaattctaccagaggtacaaagaggagctggtaccattccttctgaaactatcctgaacaatggaaaaagagagactcctccctaactcattttatgaggccagcatcatcctgataccaaaacctggcagagacacaataagaaaagaaaatttcagggcaataaccctgaggaacattgatgcaaaaatcctcaataaaatactagcaaactgaatccagcagcacatcaaaaagcttatccaccatgatcaagtcagcttcatccctgggatgcaaggttggttcaacatatgcaaatcaataaatgtaatccatcacataaacagaaccaaagacaaaaactacatgattatcttaatagatgcagaaaaggcctttgataaaattcaacaccccttcatgctgaaaactctcaataaagtaggtattgatggaaggtatctcaaaataatacctatttatgacaaacccacagccaatatcatattgaatgggcaaaaactggaagcatcccctttgaaaactggcacaagacagggatggcctctctcaccactcctattcaacatagtgttggaagttctggccagggcaatcaggcaagagaaagaaatagcaggtgttccagtaagggaggaagtcagattgtctgtgtttgcagatgacatgattatacatttagaaaaccccattgtcttagcccaaaatctcttaagctggtaagaattctttatttagtatttagtctagttttaagaaagtcttctctcacctaccactattgaagttttatgggaacacaaatgatattatagtctaagtgaaagacatgttcatagtaggcttacaagaaatatttcatgaaaaaacactttgtactgtaaaatttgtacataagccattgaccattttttcatgagggaaaatataatgtcataattcggattggtattttagtgaaatggaaggtcgctgtatggcctcttcctcattcaaagtttgtgaaactctcttctcttttctttgaggctgtgtcttgagcaaagttttactgcaagttggaaccaaactgagatcaaatggccaccagttagtagtgacatctggaaagtcatcttctgtattgggaactcacctaataccacttgaaattatatccttgtctttcattcaaactctgacctccatctttctgattgtaacatagtcatcaaaacctgctaattgctcatcttcttgtaagttatttatgtggatgacctcagcgaatcttctcaaacattctatgaggcaggtactattattattctttctgggtctacccctttgtcctctagctattttttggagagctgataagtgaacttgaaatctgactacagggacttttctaataaccagataactttatttctctcttcttgatatatttgttttctgtgctcctgcatctagactgggtcgtgataaagctgagtccagctgtagggccagacagagccttcctctccacacagcattcttagcattgtggagctcggcttcaggaagcattttccttacttaatagaagctgttgctcctcttcatgggaagtcttggcaatgccagtgatctaaggtgatggaatctgttgatcctacatgcagcagcagtcggtactgaaatgagtaatattttaataatttttttttgccctttcttcttccagttttgctattcaaggtgatgtttcttagtcttctgctccttaattagcacctgttgactaaatggatcaacaaacctatcccacgtgtgacttactctcctggacacgagtcttgttttatagtctagcttagcagacttcccactggtttctgtcatgatactgtccatctagtgaacactttttttgttataatttcctccctctaaacttcatactgttaagtagtttctggagtgcaggatttttttctaaagtcagaacagtgggaaatgagttaataaagcttctacgttccttggaaagacccctgagagatacttaaccagttgcctgctgtgtaaatgttattgagaatgaaaaacaaaaagtaaatttacagcttctgttgtgtccacatccattccaaactagatgcaccataacaaaaataacacttagaactttaattgtagtatctgtgaaaaggcaccagtgtgatttatgtaataaattggatactaaaaactttcttatgatatcatgcatttaaaaattaggaaatgacagccctgaaggtaaatgtaacttgaatgatagcattttcccaaaagaaagcattagttttcaaataagtgtacttttaccaatttaccagtaaacagatcttgtcacagaaatacatacttataaaaactttggacatatttgaaaaataagcagattttcttaaacctcagtttttgggtggtcttattttcctcttctctataagcaaacctttgcccatcaaatagatatgtactttttaatgaaaatatcatatggtaattatattacccataaatttctcctatggaattttctagtaagtaggtgttattgtcacagaaatacttatttgtaaaaacataaagtaaattaatcattatatgctcattgagtaaacatagctgagtaataggttgcagtcatttttaacacaatttaacaaatgtttgaacgatctataatttttattcatgtgtgatttatggcatccattttaactaatgtaaagggtagatgatgaatattagtatcagtcaattccagacttcaaccttaatacacataaaagtgactaccaagcattttctcctaattaaaaaaaaagcaaattttatttattttcaatgaaattttagcttctaatagtcttcaaaagctatgtagttattataataatgttgccattcctcaaaaacattctcaggctgctttggaatcaccttaagcatttatttctgaaaacctattcatgtactccctaagcatagatgaacacaatggcctcatttgttaaagctgtttactccttgtttggtaaagctgagctcacaagtcaaaaccggcctgcagacatacggttttgggcaccatagtgttttctaaagggattttaagaccattaggcacatctagctcaaaggtaattgtcttatacctggcacacttcattttaaacttgcttaatctctagaaacctatgctttagttatccctaaacaagctgaatatttagtttacttttctgcatctcatagtgatgtctaataggcatcaaaatcactcaaaactgtgctcttaatctttgttcataaacctgttctgtttcagttttctccacctctgtaaatggccgctctattccaattactcatactgtaaaacttggagttctctttgactcaatcatcagcaaatcctgttgcctttatcttaaaagtatgagcaaaatctgctacctgctgtcccgagcccctatagctgtcacctcgctttactggcttatcacagtgatctttgaattcatctcccttttccacccttctttgcctatagcctgctctcagcacaatgggcagaatcatccttttttaaaacacaggccagatcattttaccctctccttatgacctttcaatgctccccattttactactaaagaagtcacatccttgaatcagcctttaaagtcctatacaacaggtccttggaatgtttctgacccaccccatgctatttctccttcattgcctctgctttaactgtgctctttgtttagcacactgggaacagtgctgccccaggatctttgcacttcctgttccttctgcctggaatggtcttctcttacttgctcacatggccacttgtctcctcttcttcaaaatattgcccaaatgtcaccttcttgatgaagccttccctgaccgccctaaagtagaaacagcctgccacccacctctctactccctaaccctcttttctactaatttaattattttttcatccaaaactcttacctctcctaatatgatatgttctttattcatttgcttattgttttttataaacaacataaacttgaatataaacttgattataaacgtgaaagttcaaagaattttgtctgtttttttaactgccacatctttggacactgaatgagtacctggcatgcagacacaatcgtatattaaagataggtgtttctttccaaaactcctaacaatcctagaaaactaaaatatacaccactactagtattcaaaacatcttgtttatgcatggcttcaagctttgacctaatttgtttatatatgtccctatattcagttactgttttcataaactttatttataaccccttagctttcatcctgtgtcttcatccttgtggttcagcaatgatatctagtctatatcttggtatataaataatcattgaatttttatgatatttcagtatgttaaggtctcctaaagttgaatattgtaatcttaatcttttatttatcccgtgtctcctgtgattcatatatttgaaagtaaattttaattctttctccaaaagtgtgttgaccataccagtccctatctttaaagacatgagataatttttcaatatttattgtgcatctgtaattgataccattggcttattttcttgattaactcttactactttagatttctctatctaaggcattcatggtgcttttttcactctttatatatcctcagtgtaccacattcctttctaccataaatatttcttttgaaaaaaaaactctctgtaccctctgtagatgtcacactgtgttctttctgatgtctccatgacccctatgtgttcatggatatttattaattttatatagtgactggacactccagtgaattctcaccagccatttcgaccccccacctgccattccaactccccatccctaaatgaaatcagcagagagaagattaaggccaaggcaacaaaattatatgaaaaggtatgtaggtggtcgcagaaggggtcagagaaggtaagtggtttccttgaacattaccaatgggttggattcatccattagaaggattttcaactgaaggtcatgaagcccaaaacaacaaccaaaggttatattataccaatgaagggtgtaagagttcacagacataaaggctggagattgtagaaagccaagaaaagtcaaagtgctggaacttatcatttaaagaaaaaaacctaaaatatagaaaaccaaaaaagattaactaaataatctggaagtccaaggacaagagctacacagtgcaaatgaatttggaaagcaattatgaaaaactttcctttaggatgtatgatcttcttgagagctgtatactcttttacctattctgaaaagtaccttaagctagcagagtccatgattttctgacaacaatgaattttatacattcttgctatatgaacactaataatataatgttaggttattcagttttgtgtgcatgctttgcaattttcaacaagatgttccattattcgatctgtctatcttgttcttgcttactcagagatttctaggaatgcaatctataccctgtataatttaacttttaagtcacgttgtgttagacaagagttatgccttatcttctcactaataataaagtgtcctaggattaattttattatttagtgcatagttccctagttgtatatattacttcacaaaaaacaacctcaaacttattgagtaagatagtcttattgagtaagataaacttacttattgagtaagataaacttgaatataaacttgattataaatttgaaagttcaaagaattttgtctgttttttttaactgccacatcttgagtaagataaacttactcaataagataagatagtcttattgagtaagataaacttattgagtaagatagtcaccttttttatttttaacaatgacatattgatgagtcaggaatttagacccagaatattgaggatggctcttctctactgcatgatatcagatggctaagggggtaactcaaaattctcaagagctggagctggaatcacctgacagcttcttcacttctgtgtttgacactgagactgggaaaggtgaaggatgcattcggctggaacagtgggcctgagccctcacctgtggcccttccaactagagagtctcaggctggttaagtattttatataacagtgcagggctccaagattgagtgttttcagtaaaggagtaagctttgttatggtttgttttgagactaggtctcgctctgtcacccaggctggagtgcagtggtgcgatcacagctcactacagcctcaaattcctgaactcaaacaatctttccacctcagcctttcaagtagcggggattacagttgcatgccaccacaccagctaatttttctcttactcttagtagagacaagatctcactctgttgcccaggctggtctcagactcctgagcccaagagatcctcctgcctcggccacacaaagtgctcggattacaggcatgagccaccacttctggcctaagctgtattatcttttatgtcctagccttagacatcacataatgtcacttccaccatgatctgtcagtcacagtaatcataaacattctcagattccaggggaagagttgtagactgggatggatattgaggcatttgtagctataatttagaactgccacctcacctacaggcatactgactgaatgttctttactcctattccttatgttatctttaactattacagtagttgctgagtgttatggagtgcatatctgtgtcccttcaaaaacgtcataaaacgcatacccaaggtgaagccaactctaaaactgcctgtcctagatacagtttttggaaacatggcattggagaattgagcctaaatggataaagaattactggcataatttttgtatatttccctaaggccctataaatactataaaatgaaatacagaagttaataaaaaaaattaaaaaaatcaagagtcaattgagttggaaatgacttcaagacagagttgataacaatatatgctttatcaaagagtctattcagtgatgactgaatcagatttatactgatccatgaatttgaggtacaatcaagatgaaaccctcacctccaatgggtcagtgggtctgaaccttcacctgtggctcaggtgatagcatccaacgggatgctaatacgtggtgggacctttggaaggaaattagattcagatgatatcatgagagtgtggtcctcatgatgggattagcactcctataaaaagagaaggagactagagcttactctctgctgtgtgaggatatggtgagaagatactgtcaacaagccggaatgcaggccctctcctgacactggatctgccactgccttgatcttggattccccaactctgaactgtgaaaaaggaatgttattgtttaattcattaactctatggtatttcttcatagcagctcaaactaagacacctatttgtaaagagaatgtgactgttatttgtcaccccgtataaagacagttacacagtttaatgattatttccatatttttctaactgcacattagctgaggcataatttttcttgtacacattcttttttaaaaatgttctctttattctgatcatacctcaaattcatggatctgtataaatctgtatgattcagtcatcaccaaatagactctttgataaagcatatattgctatcaactcagtcttggagtcatttccaattcaattgcctcttgattttttgtatgttttctattaacttctcattttattgtatggcatttatagggccttagggaaatatacaaaaaaagtaattatgccagtaattctttatctatttaggctcaattctccaatgccatgttttcaaaaactacatctagcacatgcagttttagagttggtttcaccttggatatacctttcatgacattgaaattatataaatctttaaataagctttttgtgttatatagacctcgcttgtttctgtcaacagttggcgtatgctagtttgacccctacattgtccaagttattaaataacttgtagaagatcactgaatagaatacatgcttgtagaaaagaaatgcacatcaagtaagattctagtagtttttctttcccttatggttaacagattttaagatattatctctcatcaaataatcatgttgagagcttacattatctttttatattatctctttctatttgcttacataagctagtctacatgctgctaagaagaatgtggataaaagatccaaaatacttggtaataagtattcattggaaatgagtgtcactgtgtaatattgccaactttttctagttttgttatttccatgtacacactgaacacttagaaaattatatgtgtaactttaagtatttgttcacatatcattacatacatatacaattgtatatcagctgtcaacctgctatgatgttttctggtgttaaaagggactcagtttcttctatgtcatgtgaagaaacatgctgtcatccatcagactgttttacatttacataataaatcatgaaattccagacagtgttcactcatttatggttggtcattccttgatgttaatggaagacaaggcttatgagaatatttcacttctttaagttctgttggttaaaaatattcctaaccagcggatcacaaggtcaggagattgagaccatcctggctaacacggtgaaaccccgtctctgctaaaaatacaaaaaattagccgggaatggtggcgggcacctgtagtcccagctactcgggaggctgaggcaggagaatggcgtgaactcgggaggcggagcttgcggtgagccgagatcgcgccactgcactccagcctgggcgacggagtgagactcagtctcgggaaaaaaaaaaaaaattcctagccatgttaaaaattactttggcgttttaaaaatgtttaattttgatatactatgtcacaggaacaaagagtttataaaagaatttgtatttttttaagtaaaagaacccttataaccaagagccaattagagatgttcttctagcagcatatagactatgtaagctagtgtgaatttgggatattttttgtcattctttaatttctattctttacttagtttttcctgtttttaaaacttatatgaataggccgagtgcagtggctcatgcctgtaatcccagcacttgaggaggcagaggcaggcgaatcacctgaggtcaggagtttgagacaagcctggccaacatggtgaaaccccgtctctactacaaatacagaaattagccaggtgtggtggcgggtacctgtaatcccagctcgaacccaggaggcggaggttgcagtgagacgagaccaggccattgcactccagcctgggcagcagaggagagacactctatctcaaaaagaaaaaaaaaaaaaaaaaaaaaaaaacaaagaaacttatatgaatagaaatataaagtcgttcctattgtttctggctattgtcacacattatctttgtcagatgaatgtttgaattaattaataaatattttctactattctatttcccccatctttttgaatgttataacttcactttctattattttagtggttaccctaaaaattaaaacatggatatttaatatgtcaaaacattatcagtctctttactcacctcttagatatttcaagaactttaaaacactttctagatttacattatagtgtaaaatatatattctagatttttagtcttacaaagttatatttcctattttataattatttgttcatttctatcaacatagtcacccactgtttcccattgcttctagaatctcagaaggaaacaaaatcctttagaatttcctctacttaatgtttcttgatttttgtttgtctggaaatacattataatctgttgctgattttcctagttcttgaattatttgccagtctgttctgctggctttcattctctttccttaaatagttggccgttttttattcggcactgattatgatgctgaaataattatttgtgtgaattctttgaagtctatggtgaaggtcctttccttcatcaagaattttcattagattctcctgggtacctggactcacagtcattattttagatgcaaatagcataatagtcttaaggctattcaggcgtgctgttctttgtagatattatatcacaatctgtacttttatcccattcattagatttccaaaattttacataaagttcataggattctcattagctttttaatctggaatgaatctaaagttttgcctccacttgagccttctccatttttttctttatctgtctcaatggagatttgtcttatctttccagagaatatgttcttagactcactcattcctctcatcagttttctattttagtagactgtaatttttttcataattttcataaaatctaattttctcataatttccttttctctgccttctttgtattacctttcctttatttcagtagagtataaattttttcataaaatctaattctttcatagtttccttctctctgccttctttgtattgacttttcatttttgttacttcttaagatgaattctcaactgatactatattctttatttttagtataagtaaaacaataaatttcacttaaatcttctcttccgttgcatctcacaagttttgttatgcagtactttcattattgtttagttatgttcagtatcttttgatatccacaatcaagttttattagtccaggtatgtttttaagtgattttttacgaatttgttgcacgcacacacacacacacacacacacacacacaccccaatgtttattagtgatttctaatataattgcattataatcagagatattcttagacattttagagactcgcaatataatttattatatatccactttcgtaaaagttccatattttctggagcggactgtatatttcctaattgtcggccaaagaattatttatatatctttagatctcaaaagtttaggtgtgaagtttattttttattgtaggatcaaacaagttaatttagttcacaaccagcctggatgacatagtgagacccggtgtatacaaaaagcaccaaaacaaacacacaaaagataatttaacatggtgaccactctccaatgcattgttttaattagtttttcttaaaaaccaactttctcctgttgctttatttttgtaaatgtctttattgaagagaggcacatcagcaaggaaatagggccacatcctattggagggaattccgagttctaaaatgcacctctacattggcagagaaatgacaaccagttaatgaaaacgagtgtttggcagctgttgtctcctttgcctgaggccgttctctagtgtcacagcagggtaaagatgtgtgaaaagttgtatgaccagatggccatgagatccagaatgcctagaaataaaagttctaattgattctgcaaaagagaacttttaaaattgctataaggctagtcccagcatgatccagtacatgattaaagaacataataatattaaataacagcaaaactcaaagcaggaagaaagattgtcccatgctatcatgtgactcatccacacaacagaaaaggcaaaacacactcagcaaatggaagaatttaccacccttattctggccactcatcacctaaatgaacctaagccattccatctcaggactgtgccagttatcacacttccggctccagttaagagaatggtgggcaaacactggttaaacaatagagggtttttgtaaattatcatttttaaaaaattttatgagaagcctgaaaagtgggaatcctagatttggttaatgccatggaccattggtgttagacactttacttttcactctaccatctgtaatgggctaacctttgcggtcaggtccttccaggcatggttgatctcacatagccacatacaaggatgaggaaaagcctttctttctttctctctctctctctgtctctctctctcccccccctccccctcctcctctgtccccctccctccctcccttcctctctctttctctccctcctttcctctctctctctgtcacacacacacacacacacacacacacacacacacaaatatacaccatcagtgagaagtatcatgccagaatccctaacagattttattttggatcttattagtcaggattagtcaccatgtgctagctacatagaagcctgggcagggaagtctgtgacaggttcagggtcattctggacagctggtcaactctctaagcacagaaggaggtagaggacaattgagtagggcatccctgaggatattctgaagaatgtcagttgagttgtgttgggtttggttttctgtctccctgcaaacagtggcaagcctggaaacttgctttagctcttaaatagtacttttgtacttacttgaaatatagagtgtctaatattttgaggcatttcaatgatggcagccttgttctgtagatgttacagagagataatgaaacactcccactgcttggttcctgtccttttcctctgcccacggcccggtcagagctggaagggtcagtctgagagcaggagcagctctggctactgcaacctttgggcaaatcacttaacctttttaacatggaagtcttcattaaaataagggcatgcatgtatcaagggcattgtttgacttatgtgattatctcgcagttgcttttgccaatcacatctttctaaatacaaaagagttcctcttattgctgaagcacccagctaaaacagagttggtatttctcacaactcattcagtgtaattaaaaacaattaatagatacctactatgtataagatgccaacatgaatagatcatagttcctttccttggggacccacagtagagatacagttattgaaatgtaaatcaatacattaaaatgcaaaacttgtggaaggcagagaagtagcagaaaggagggatgctttgctgaaattaggtcacaagtagtaacttgctgagtttaaggacttttggactatggtctatacaacggaaaaaagtatgggagactttgaatactttctaaccacgttaaatactttataaccaggttattttatagacacaaagtaaaggatattttataaccatgttagaacttgaaaaagcacttgctattttggatttagtttattccttcttcttttgtgactctttatttccagcatcgtattggatatcttctcatgaagatggcataggcctttcaaactgaccatgtccagaaccaaactcattctctgtctcccccaagctaaacgtgtctcatttgtttttggtgcaagttactgacatgaccatgaacacagtcaccaaatagaaactaaggtttgttcatgagacttccctcttcctctcctactacacacatccaccagcatgtacgatgaattctatagtaaatcatttctcaaaatcgtttctgacttttctttctcgctcccttactctaagtcaagaatcagcagtctgtttttccataaagggcctaataaatattctcagttttggaggccatatggtctctgtcaaaattactcacctctgccattgtagcacagaagcagtcgtagacaatatgtaaatgagggaacatactcctgttcctcaaagttattatttctaacaacagattgcacttggcttaagggtcatagtttgcccatgcctgattgaggccctcctcaactttcacctggattaatattgcagcatatctctaattggtcttccaggctttaattctgctctacaatctcgcctttgtatttacctgcataaataacaaatcgaattcatactgtctgtatgaaaagaaatcattgcccataagaaagtgatatttcctagcttgtcacacgtggtcggtccttgcggacttagattcgtgtggctctttgtggcttcctgttccagcccttgttgcttcctgtagtcctcagaaattctgtcccttgcctctccccaaacacagtaacatcttccgtatttcctacatggttgcagttgtcacctcagtgtatgggtcactcacttatatgtgcatactctgtgtgcatgagagtgtgtgcgatttgctacagattttaattaaaaatattatagtcatatgcatgattatatttgtgtgtacttaaatatatatggaagaaatggacaatgacgtgtccatgacaacagagatactgtttccgtgcatctgtatttgataaattcttagtcatcttttaagacagagctattttgtgaagccacaccacacgtccttggggcagtcattgtctctctgagcaccctttgcacatcagtcgtttcttgtctatcacttgcagtggtgtgctggagcttgcttagactggctcaagaaaactgatggttaaattttcaggaattccgtgagtcgcttgttaaattgttgtaacttgaaattaaccatgatgggagtatctacaatagcagatgctacaaaccaggatgtgtttttagggtttattttgttggagaactggttgaccagcacaccactgaatctttccttttctgatcgacaactatgtaagacaatatgcctaatagatacccaatatatagatacataataacccttaatccttagtatgttttagatgactcagtagacttcctgactactgtctttaccaatgttctattagatgagatcaaaagatgcatctttacattgaatttgattttagtagagagaatcacttatttttttaattagaaattaagctgcatttagaaagttaaaaaataatgattactgattttacatttaagtcaactttcaatatgcttagtattaccaattgttactttaataaggtgtttttctgggaacattgcttataaaatactatttatatgtttttgtttgtttagctccaatatcaaagagaaatagctatattgcatgtgctataactgactgtcaatgaatgggtaatttaaaatagcctcagatgcctcaaaccttaacgctaaattcacctcacaaagggaatttattcaatccaaacgccctcctattgcttaaatgaagacattgatatgaagattcatatctgaagttaagatattagtaaatcaaacaatgtaaaattcacgaccatatatatcatacggatttggaattagctgagtgatctacttttgtatatttttgtggttaaatttaagcactatacatttatgagaatgattttctaagaagaaaccccatttattttctaagaaattgcagcctacctttctatgctggtttgttttatgtactactattgacttttcttcagttttatataagatacacagcctagtgaataataaaaaagtattattacatttactttaactcttagcctttgctttgactgcacagaaggagacctttaatttttatatgctttgaaattcatgaaaattgacatttttgcctgacaacttatttctccactttcatatgcctttcctcttgactgaatttagtcttttgtagtgttgcagaggctgtagattaccaagttctcctagattcacagggcagtaactataggcttgaagaacattcaccactaaacctgagtgaggctcattcgatgttgtaagaaatagagggctcatttgttccctctgacagcctctccaggggtgctcacttatgtgtacatgcactatgtatacatgtcctatgtgtatgtatgagagtgtgtgcattttgttatgcattttaataaaatatagtcatatatattattatagatgtgtatatacataaatacatatggaggaaatggacaatggtatgttgtaatgttcagaaatgaacaaggtgatgtaaacactgtccctaaatcttgtttcacagtagagtttccagtagatgacaagtacggtagccaccacaaagggctgtgagagagagggtgcatctctccaaaacaagtattccccacaacacagtgacagtaggctaaaacatttcgaatattttccctgcctgcttagagaaagcatagggctcaggctgtcattccatgttacagtaacagttctcgtttaaattcattaataaacaagcactcttctaaacttagctaatgtgctcttactcctgaaagataaagaaatccagttttgggatgctgacaaagtgagtcttctgagcctattagagtaaaaacagcttaccctagtgtaaggcaactataactgtaagatcatgaatgttctcgagagaccacttaaggacagacacaggctattctgggcatattttaatgtcctttttggcctttctattttaaaacatttcatctttcttgtgtgtggctcctatcattgctttcctaagtttaagttggtatattcaactgttcattcctgaactctatcccaggaacttttttctcccactcttaacagaagtcaagagacataggtcaattttctgtaatttagtaagtaattcagtagcactcaatactcagtatcatcatttatacattataaccattataacatttattctgcacatctaagtttgctttgaatgacagaattaatactaagagaccttgtctcccttgaaaattgatgggaaggaagctttagccagataaatacttttttaaaaaaaaatgtcatcaagtgagagagcctgaaccacaatcccaatgggatcagaacacttgagtcaattagccaagactccacctacctgtgcactagtgatggcccagccaatggaaacccactacttaacatcctggcaaagctccctgtctatgggcactgcttaactgggccatatcctcacttcctctctgtctcccctttctttttatgctttctttgctgaccaagcccctgttcacattctttcctatatttgttaatatattccatcacattattaaaatctaactgatcgtaccgtccagggacacatcgtgtccctcgaagacttgactctattctaacccgttattgttaaaattaactttcaaagggcaattagcatttgtaatttcatgaggaatagtcaaatagcctgaaagtaatatcaacaggctctctctatttagaggggcctcactgagaaaaggtaaagaatttcccgttttaacccatgatggtgtttgtaacctagaatgccatttttacagcattcaaaatggccagtttcaaggtggctgacgtggtttcggtgattcatattatcaaaaaatgtctgtcttactagatttttttaaccagaagttgatgtagttttaaattttttaaactgccatttactatgaattttaggtaggtgcacaaataacctacagctttgaactttctgaagtaatattttcatactttttacttcaaatgtagaataattttttactggttaaattattttgacagcttaaacccaatgaaagagtatatgtgtatatatttatgagaacattgaaatactgtttgagagtaattatttataacagagacttctggatttgacaaatgttatcattgtcttgagaactgtttctagttgtaaacagtaaatagataatactgtggtcagaaactttcctggaatttagtagtgtttgtatgaactgtataccactgagaaccagagcagggagaactttagtttattatacttgagttctgttttttctgtttgttttttgcttgttggtttggtttggctttcatcttgtaaatagtaaataattatatttcatctagcacatttttatgtatagaagatatacattggagatggaataaaaatataaactgccaatattttacttatacttttgaaaagatgacttgttacagataaatttatcaggaaaaaaaaagcaaacatagactgcaaatccctttgttttatgtgtcttcctaacagatgatgggagtttagtctaaagaatagaaagccatacggacaataaaactcattcacagagatgaatctcgaatatttcaataatattgcatttggattggaaactgtaaacaaaccttcagactgcaattcaaattttacttttattttttttcttacttaaacatatgtacattatattcctatttctcaaaaatatgactaggaaggtaaaaagcaactaacgttatagccttcttataaagaaatttggccctttatgagttcaactaaatagctaaatgtctacttttctatttgtaacatgtttttttcactgttaccagtaaaaagtcatttatttataggcctctttagatatttgtatttttcttcaaccacaatttaaacattcatcttcaaatcttgcctaccattgcatttatttgaaatcgacacttgtgttttagttcatttttaataatctgaaccaaggcttctgaatcatttatccatatggttacatagtctaggttatcaatgcctgtgcatatcatactgtaaagtgctttgaagatgtgttcatctctaggtgaagcttgttggctgatggatttattaaatgatttgtgacatagcatatcccttgttctacccccaaagtcttccattgagacagtatgcttcctccagaggaggagccggtagtctctggctatattctggaaacataggaaaagaggaatttcccttttttcttttgaggggcccttttcctggtgttgccttaaaatatttttgtcacgtcattttcctcagtagcagtgagcgttactgggtcagagtgttactatacactcagtaatttcacacatatttactcagttcatccttgatatgatttggctctgtgtccccacccaaatctcatctcaaattataatccccacaggttgagggaaggacctggtgaaaggtgattggatcatgggggcagtttccccgatgctgttctcatgatagtgagttctcatgagatctgatggttttatcagtggtggttttccttcttgctctctctcacctgccaccatgtaagacgtgtctgcttccccttccaccatgattataagtttcctgaggcctcctcagccatgtggaactgtaagtcaattaaacctctttcctttacaaattacccagtctctggcagttcttcatggctgtatgagaatgaactaatacaatcctcatgatgatattatgaaatagatactattattttctctatttaagagatgatgacaaactgtgagtcacaatttttaagtaactcagtaacacaactggtgtgatttgtgttactgcaaattactgtctgttttacagtaacattggtaattatgccattttcaccccgacacaatttcaaacacacccttccccaccaaaaactgaatccaattgagattcccagttgcagattctctgataattactcttgcaatcttttagggaggaacagaaggttacatggctgccttgagtggtgtagggggccccagccaatctccaagttttatcttctataccttacattctgccgcttttcatgatacattctgcctcttgattttgagcctttctggcattgagtggtgtagctcacctcgcacagatacctctccccacaagtactaaagtagtttttcaccatttccattttcacttctcatggacttcattatctttaaaaacttcattgaaatctctcacccaacagttgtactcatatttcgttgacgtttcagcctttatactttttaaaaatcagttcactcttactttggtgagttttcagaggcagaggaagcagaactataatcaactaatcaagcccctttgagccagcagttcttccaggtttgtgattcacagataccctggaagaattgatgaaggcttctatcatctcccctagaaatgtgaagacacaagatattctgtatgacattggggctgaggatagcttttgtggttgggaagaagtatgataatgtgtggagttttcccacatatatttaggaactttactcttttattaaaaaacaaattaaaagttgcatctgttaaattttctcttacaaaaacatttatggattcatcattaaacatacatgttttggaagcttagtatttatcacgtttgtatgataactcggtagtgagagcacagagggcagtcccagtgttcagagagtttatggcagatagtcgaaggagagaaatgaggaacaaggaagtataactgtgtgacaggagactatcatacaacttatgccctgggtgctactgaagcactgaggggagggacctagcatttggagtaagaaacagtcatcagggaaggtttcatcgaggaagtagggttcatatgttttgaaaatgttatctatttgaacactctgttatcaggtacagacatatttagaatttttctaacttgtagtgaattttaccttttttcattgtatactaaccttccttatctctcagagcgcctttttccttgtgttgtcttaaaatattttttgacacctcatttttctcagtatcagtgagttctctgtgcttcagagtgttattctatgctcaataatttcacgtgtatttactcagttcatcctcataataatactatgagatacaaaccattatttcctctattttagaggtaagaaaaaacatgatgcacaataacttaataacacaactggggcaataaataggatcaaattcagacaccagcaccttgaagcctgaacctctccacacagtaacactactgtatattacaaatgatctcaatacgtttatactatagcactaagattggtatatgattgtaaccatactaattttctttttcttaaaaaagttgtatttgccttagttacctttctcaattcttttactttcaaattttcttagttcctgtgtgttagacatgcttctcagaaatagtattttgctagatttaagaaaaaatcaatagttctgtcttttcagtatagtatttcttaatatatttctaccatcttattttgctttttctttttgattttcctttattccttcttctccccccccttttggttgatcaaatatttttaaaatatcgatttcccctacaattgctttgaaatgtatgtatgtcatatctagtattttagggattatccttattttttttcaaaaatacttattaaattccaacatagcttaagatcttgatctttctcctgaacataatcctaatcacagtatttgaaacttacttctaatcacaccctatcatgctatagtctactttttgtcctgagttttagttctcttttttaactttaatattagtcattatcacttttataattttagtttatgtagtcaatatagttttagattttaccacatttgcatatttcttctgttattatgtcatcttgtatttctctcttttctggacatagttccattctttgacacacatcctttagtttagatggcttttaatgggaatgtgttggtactaaggtgcttctatttttacatttttaatttaaaattttttcattttttgtttttctgaaaatatcttaattttaccatcttccctgtttatttagcttggtatacaagtctatgttgaaagtttagtttctctcagtactttgagtatattatcctactaaattctaccttttgttttcacttttcttaagaagcttcctgactgttttaaaattgttccttagggatactctctcttttctcccttgctacttttatgttccgtggtaatgtgctgttatagcatgctgtgtttagtgctagattacctttataaaaatgtttaattgggatgtattgtcctttctgaatctgaatttttaaatgttctggaaaattcttagatgttacgtattttaattgattctccatcattctcccttttctctcctctgaaattctattaatattgttccaaaagtaattacagtttttgtcattacttttaatggcaaaaaccactattacttttgcaccaacctaatacgttagaactcatttttatactgtatattgtagaatttatatttaatgtttctaagtttttttaaatttctgaatgacattgtcgatattcaatctacctttcagtttacaaactcactctgtagctttgtctcatctgcttaatgcaactaatgagaggtttttttctttaaaaaaatttaacttatattggtatataataggtctatatatttatgggctacataagaatgtctaataattatatcagggtaaatggggtatccatcacctaaagaattcatcgtatacacaacagagtactattcagccatataaaagaatgagatcttgtcatttgcaactacatagatagaactgaaggacattatgttaagtgaagtaaaccaggcacagaaagacaaactatgtgcgttctcactcatttgtgggagctaaaaattaaaataactgaactcctggagatagttgaatgatggttatcaaaggctgggaaggatagtgggtaaggtgggaaatggtgacagttaacggttacaaaaatacagttggatagaatgtgtaagatttaatgtttgatagtacaacaaggtaactaaagccaacaatattttattttacatttaaaaataactgaaagagtccagttagaatgttcataactaatgcgtttttaattccaataatatatttttaattcctggagtatccatttatttccttatcaacaatgactggtaatttttaagtattatttgatatggtttggctgtgttcccacccaaatctcatcttgaattgtagttcccataatccctacatgtcgtgggagggacccagtgagagataattgaatcatggcagcagttccccccatgctattctcacaatagtgagtgagttctcacgacatctgatggttataagggactttccctcacctttgctctgtacttcttgctgcctccatgtgaagaagggtgtgtttgcttccccttccgccatgattataagtttcctgaggcctccccagcactgcagaacagtgagtcaaacctctttcctttataaattaccagtcttgcctatgtctgtattagcagtatgagaacagcctattacagtatatcttattcttttcttgtatatttaattctcattttacttcaaataatttatgaatgttttatttctcaatccccaaatttagctgaaattgaattcatgggggccaaatattccatgcggtgtttctgctgaattctgttcattatacttgttttcttgagttttatatttttggattgtgagtttaaatttttcagggctttgtcattagtaatcctataattccagagtgaatccagagaggggttacactttatttcaaaagataccagcttggaaccattttttctattttaagttcttgatttgggggttatatccaatagtcagtgtaaattcaaaagctgtaatttaattcagcaagtttatggcttatgcattctcaagaatcatcattttttttggaaaaagataaaatacagacaaatttccttgtcatccctctttgctgactagttaatttttctccagtgtctgctttactgtgaatttagcatttttaggttttatgtggtggggctaggggcgtgagggagttcctattctttgcacaggtctattacttgatttctaattctgtttggccttgaaatccaaaattctgcattgtaaagattagtaaataccctctgactactatagcccaccatcagctaacaccctgaatttcagtgttctctttttttcttgatacccaaaagcttctcctattttactggatgctcagatatataacttaaaagatgtatgttacattttatttagcatttctaggtgtttgaaactggaaaattttcaggctcccatgttgcctcgtcctaggaaatgtaatccttagagattattgtttctgtttcctattatgtgatgtgacattacagaatgttaagtattttaaataaattatcttatatcagaaaatttatgttataaacttttggggtgcagttaatattttagaaatgttttcagatacaaaaagccatgttttaaaatatctcagaatagacattataatcttgaaaaaaaaaccctgatttttattgaagggttttgttatgaatgaaatttggaggtgctcttgtagcattctgcatttacattctagcatcacgcttcatcaataaacatgaagacatttgtataacatgtaaaaccatcttatttataccaagtgcagaaaattgaaaagcttctaaagattatatcaagaggaataataataatacaaacaataacaaacaccataacaacaaagaaaagaagaagcaggaggaagaatggcagtcacaggctcctattttaggccaagcacactcctaagcatcaaagccaaaaaaaaggcagaaaaatgttaaggtgacaaaggcaagagcccacgctacacaaagcatttcttggctcgccaatttcaaagcaactcctgagatagagcctcacaatctggctttgctattgatttgaagttaatatcaaattaacagaataccaaaatatatagtcatatatagaagcattccaaagctaaataaaactgtgtttgatttcctactagttgggattgtccctatcatcttaatgcagataattgtgagtctagtttatatccatattttacttttccatctgcaatgatactaatttttttaatagcagagccatcccccatatgaaagtatttggaaaatatatagactttcaaaatgacaatatagacgagactaagaaattattttctgggtttttttttgttttttaaatagagtgaaaaacgaatctctcaaatacaaaatatttttaaacgtgagaaacttgcacgctactccctcaaagctgtctaattcaagcaaacactaaatgacactggcagagctgattgagcagctgctgggtgtcagtcactgtactaggggcttttaatacagtgttttatttaacagtttacaaaaaccataggaattgggtattattaattcctgccttacaaatgaaaacactggcgttaagacaggatgagtgagttagtcagggtcacacaaatacatcttaaaccagttctggctattctgcagcccaagcttccaaccaccggcattgtatttttcagaatattgtataatttcatagtaattaagcaaatgtttacacttataagaaaaaatcagtaagacaatattattttatgttatgactgtatctgccgatgttttagatatactagcagtttgtggatataaggaattaaagttatctgatgtaaaaattatttattttatatttgcattttctctatttatcaatacacaactaggtcatgaaaaagactatgtaaaaaatatatgaaagtgtcaaattattcagtttgttcatccttttattgtggcccctaggcaacgatggctttttaaatcattttgtataatttgatttgcaaattgctaagtatcctagtttgtcaacatactagtctgcttctctaatttcttttcaattttacgttcttgtaaatctctttacgcttattaaaagatactcaaaaatatcactatcttttaatgttaaaccaactttagtataaacatattttatatataatgagtattatatgaaaataagatgggaaacccacaaatactattaaaaaacagttgctacaactaacacaatatagttattataaatatccatgtataaaaataacattctaaaccttaaatattatgaaatattctagctaaagtataatttaaaataatatggctactctaaatggtccaataaattataccaaattaattttcattaaatcaattaatctaataaacatcacttttaaaaataagtattttcttgtttatatatggcataataatttgtaaatcactacaaacatattttgcatttggaaaaccagatcattagagggaaaaaaaagatcctgggcattttcaaaattcctgagtttgttttattaaataaataaaaggctcttgaacaggagcataacaggatcagattaatatttttgatagagacacctcaaacttcaagccagaaacaaattggaagtggacagtagaaaatctgtggtagtctgggctcaggtgggaacgaagagaaagagggctattcaacaggtagaattaatatgatatgattgtgcattttgcagagtgaggatggaagtgccaggatcaactcttgattgattaatatgcacaaacttattgataaactgaagctaagactttttgagtgaccagtgatatagagacaatgacagaataccagcaatatcttgagttttgaacatgagtgcaatattaaaatggaggagtcaaactaaactttggatatattagtgttgagttcagaggagagagctgagacagagatatgattagagacatcctcccatagttggtagttgaagcaatggctttggataaggtctttattaaggagaatctgccaagaaaacagaagtagcctaggacaagctttaggaactctctcacttacagacgaggtaagagacaagaagtcagtacaggaggttgaaatgtgattgtcagaaaagtagaaggaaaacctcgaatgatgtagtacattgtcagccaaagaaagataaattatcaagaagagagtggcaccttctcaaactttttaatactgccagtttatctactcatatgaatgggcagtaacattgtttttaatcctattatattactctttctgtagtttatcttcctaatgagattatagcattcctgaggacaaaagcaatatagtttaggtgcttaataaatataaacaggattgaaattgccaacactatttttatcctagaaaaaaagtgatacttaatattacatcttcacttcctttaggtcttggtgtcagttctcttatcagaaaggtctctgaccggcagtttaatatctttcctctctcctggctctgtatccgccttactcaatacatttttcttcataaaaattaatgcattcattcaagtgatcattcacctaacaaatacagagcggtctataagtctggaaaccaatatatattatgttttaaagaagatatttttatcactattttcagacttaataaataccttgtatcttgatcttctctctgatatcatatggattgttttagataagtaaggtggtgatttttaaggtttgtgaattttgtgtcaacaaatatttttaaaaagatacatagtgctgcaataaacgtacatgtgcatatgtctttatagtaggaacagaaacccaaacaccacacgttctcactcataagtgggagttgaacaatgagaacacatggacacagggaggggaacaccacgcaccggggcctgtcggggtggggagcaaggggaggggagagcattaagacaaatacctaatacatgtggggcttaaaacctagatgatggattgattggtgcagcaaaccaccatggcacatgtgtacctatatagcaaacctgcatgttctgcacatgtatcccagaacttaaagtaaaaaaataaaaatcgtttatgaatcattgattcataaaatgaatatactagaaaaagaaaataccatattcagaagtgcatacacacaaacacagcccccccaacacacacatatgtaactaaataaaccaatgcagataattataaattgtgacaaattctgtaagaagaaattagtagttgaagatctaaaatgaaaaaaatttatagaaaaattttaaattgactggtctgggagggcctcttggaaggtgacatttgaactgacctgaatcatatggataactcagccatgaaaagtacaagtgagaaaaataggaagaaagggtttggttttcctgagatgcatagagaagagtatggctgaaacatggtgaccaaggatagacatcttaagtattcactctgaaaactagcaaagtagccacacaataacatggcagaactattgctaaatatgatagatttccttgaagagtaaagtatatattacagaaaaagtgaaactcatgtataattttcttacacatatttaatggtttaattcatattgttttaatttgtaaatttcagaagagggatgctctaagtgggtgaatgtatcctacgatttttagggttagggatctctctatgcctaaatctgcctaaaagagatgtgaatttaccttgcagtgagagtcaggagtcagaatattcagagtctttgaaagccacagaagtcaccctggtttgatcatatagaatacatatatgaggatcaagtgtaaaatgctactgacaggtctagtaagagaaagactgaaaatgttctttagtggcctgaaaattatcagacactatgaagagcaatctcatcaataatccatagaggttgaatgcataacaaggtggaataaatgtaatccaaattagagctcttggatgacagaatttttagcgttaagtgccatttcagttggaacataacattttatacaaatagtttttattttgaaacaatttaaaacttaccaaaaaaattgcaagaaggataaaaaggccactactgtacccttcacccagagacctccttcaacgtttgttacttgtttgaaaatgtccttgtattagtctcttttcacactgctgataaagacatattcatgactgagcaatttacaaaagaaagaggtttaatggacttacagttccacatggctggggaagtctcacaatcatggtggaaggaaaggaggagcaagtcacatcttacatggatggtggcaggaaaagagagagaacttgtgcagggaaactcccatttttaaaaccatcagatctcatgagacttattcactatcatgagaacagcacaggaaagacccatgcccaagattcaattacctcccaccagattccttccctgactcgtgggaagtgtgggagttacaattcaaagtgagagttgggtggggacacagccaaaccatatcattccttgtctggccccttccaaatctcatgacatcacatttcaaaaccaatcatgccttcccaacagtcccccaaagtcttaactcatttcagcattaactcaaaagtccatagtccaacgtctcatctgagacaaggcaagtcctttctgctcatgagcctgtaaaatcaaaagcaagttagttacttcctagacacaatgggcgtacaggcattgggttactagagctgttccaaataagagaaattgtcaaaataaaggggctaaagtccccatgcaagtccaaaatccagcaaggcagtcaaatcttaaagctccaaaatgtgtcctttgacttcatgtctcatatccaggtcatgcagatgcaagaggtgggcccccatggccttgggcagctctgcccctgtggctttgcaaggtatagcccccttcctggctgctttcaagagctggtgttgagtctgtggcctttccaggcacacagtgcaagctgtaggtggatctaccattctggagtctggaggatggtggccctcctctcacagctccactaggcagtgccccagtagagactctgtgtggggcctctgaccccacatttcccttctgcactgccctagcagaggctcttcatgagggtcccatctctgcagcaaacatctgcctgggcatccatgcatttccatacatcctctgaaatccaggtggaggttcccaaacctcaattattgacttatgtgcacccacaggctcaataccacatggaagctgccaagacttggggcttctgttctctaaagcagcagtccaagctgtatcttgcccccttttagtcacagctgaagggactgggacacagggcaccaagtctctagactgcacatagcagagggaccctgagcccgacccatgaaatgattttttcctccctaaacctccaggcctgtgatgggaggggctgccgcaaagttctgacatgccctggagacattttccccattgtcttgatgattaacatttggatccttgttacttatgcaaatttctgtagcaggcttgagtatctcctaagaaaatgggattttcttttctatcacattgtcaggttgtaaattttccaaacttttatgctccgtttccctttaaaagctgaatgcctttaacagcacgcattcacccctcaaatgcttttctgcttagaaattgcttctgccagataccctaaatcacctatctgaagttcgaagtttcacaaatctctagggcaggggcaaaatgccacccgtctctgctaaaacataacaagagtcacctttgctccagttcccagcaagttcctcatctccatctgagaccacctcagcctggatttcattgtccatatcattatcaacattttggtcaaagccattcaacaagtctctaaggagttccgaactttcccacattttcctatcttcttctgagccctccaaactgttccaacctctgccgtcaccagttccaatgttgcttccacattttcaggattcttttcagcagcacctcactctactggtaccagtttactgtattagtctattttcatgctgctgataaaaacatactcgagactgggcaatttaccaaagaaagaggtttaatggacttacagttccatgtggctaggtaagtctcacaatcatggtggaaggcaaggaggagcaagtcacatcttatgtggatggtggcaggcaaagagagagaacttgtgcagggaaactcccatttttaaaaccatcagatctcgtgagacgtattcaccatcacgggaatagcacaggaaagacccacccccatgactcaattacctcccactcggtttgtcccatgacacatggaaattgtgggagttacaattcaagatgagagttggatgggcacacagccaaaccatatcagtcctttacagcaaaaggacccactctgggatcacatgtcacaccctgtttttctgattctccagtctctaacaatcataattatatcttcactttagtaatttcttcactttcacaaccttctcattcttgaatattctatcccagtcatttgtcgcttgtcctgaaattggattagtttgatgttatacccagccttgtatttttgacaggtgtcttacacaccatgctttattcttctcattgaatctcatcaggtggccccccagtatcaattggtcctgttactcatggtgataacattgatcacttgattataaaggtatctgcctggtttctccaatgtaaagtgactgctctcccctttgaaattaataaacatatatatttttaaaattggggtacttggtgtatatatttatgaggtacataagaggttttgatacaagcattcaataatggggattggggtatccatctcaaacatttatcctgtgagttacaaacaatccaattacattgtttgttattttaaaatatacgattattattgactgtatttaccctattgtgctatcatatagtaggtctcgttcattagatgggggtggtttatgagttttttaaaaaactatatttttaaggagatagtttgaggctatgttctgcttccaactttcacccacttatttgagcacctattgatatgccttgcctgaattaattattaacatgatggtttccaaatggtgactttcttcttcctacattcctgttacatgtattacttagtgtagtgctattggaggagctttctattttccctgtgtatttattcacttttagacaggcagactcttggattcctactttattcagtaggatatgatctgtagcttcctctttttttctcctcccttttttattttgatattcaaaatctctttttgatactcaaattatttattttgtatgcaaattgcccttaatttgaggagcagatgccatttcaggctggctcctgtgtcattctgacatgaccccatcattctttgggcacttcattactttttggtgtggcaaaatgttccagattcttactgtactttccctaacacagcttagaatcagtcatttctccaaggagtcttggttttgcccagcatagaaaccaggatctgggaaacagaactattcattgctttgagagtgaccctgtacgtaggctgtcttcagtggatgataggaaccatctgtatattgaccaaatatacaatttcattcatacttatttctgtatctatctacatatagtgaaaaccacaaatttacactaattgattaaatcctaatgcaaacccactgggttcattctgtctttttttttcttttcttttttgagatggagtctcgccctgtaacccaggctggagtgcaatggcgcaatcttggctcactgcaacctccacctcccaagttcaagcgtttctcctgcctcagtctcccaagtagctgggattacaggtgcacaccaccacacttggctaagtttttgtatctttagtagagatggagtttcaccatgttggcgaagctggtctcaaactcctaacttcgtgatctgcccacctcagcatcccaaagtgctgagattacaggcgtgaacattctttcttatgtttcatatgtgtaccctctttctttgacgttgggaatttgactctcactatcctccatgtatttacttatttgcccaatcaacctgtactgtaaccaatctcccagccacatggggtggagatcctgtgtggacatcctctgtgcacaggtcctggacaccactagactctcttcccctggactactctatcttcctgcctgctgggaccctagtttttatgaggctgttttcctgcccctgctcaatgggtttttgactaagttattcaggaaggttgagtaaacagtagagattagtagacattttgttattcaggaaggttgagtaaacagtagagactagtagatattttgtgcaatctgccaagatcaaattgaaaggaagacagtaggtggttttaaacatccttaaagcattccaccagcctcccttggacctcccaaccttcccaactttaaaaaaggcagagagaagctttatatgcacttggttttaaacatgtcaatttttcaaccttgttgtccaccgtttgctttttctgtcccatcagatgaacattataacttacaacaatttaggttgccattttaatgtcaaaacaaatatcagcaagtttttcactgatgtatttctgaattaaaattttaaaaccttgaaaatgcttgtgttttctttgtcagcaagaatagcaatatactgagtggacttcaaatcaagtatgaagtttttatatgcaagtcttgaaacagaaatttcagacatgccagtgaagtaatataattacaatgttcctggaaagaagaaaggtttccagtgcatggaaagtaagatgcaattgagactgacaagattacaattcactgtgggtgttttaacacattgtcagattgtagaaaccagttacaatgacccatgtatagacattgtattttttattccaaattcatagaaattcaaagatataacaaaaatacgcaaaaattttaactttatatttttactaacttgacaattcgttacattcactttatttccattttatagctattcatttctgaccctcaaaatgccagctgcaaatttatattaccaaaaaatcccactgttaatctaagtaggttaaatcctgagctttggagtagtcactgaaggtatcacaaacactaatacactagtatttttactgaaatttcatttgttcataaagagaacaaacacagaaaataaataataggttctcctctgtttctaagggagttaaaacagcaggaggttcagtatcagagatccaacatctttagctcattgttgactaagggaactgtcaatattccaccagttacataatgtttcacaggtgtgagtaatcttcaggttctaattattaaaactgatttgagattataatagcaggatgtgtttgttatactttgtattagttatatattgctgcatagtgcattgcctcaaaactcagtggctcaatgtagtaataatttattatctcttacttttctgtaagaggccagtaatttaggagcagcttggctgggcagttctgacttgatatttcttataaggctgcagatacatgtttcctagagccacaatcagctgatgacttgactaggattagaggctccatttcaagatagcagactcacatggctagcaagctgctgctggaacttggtaataggctttagttctcctcctaggtgcctctccatcttactacttgagggtttccatggcttttaggctggcttccctggagtaagggatcaaaagaccaaggtgcagcctctaatgcctttatacttaaccttggaaatcatatcaccttgttactactgcaacattctgtgtcacacggagcagcactgattgtgtgggagggaactatacaggccgtaaatattaggaggtatttaaaataacataattataatgtgaagatttatggccatcttggagattgattgccggtgttcaccctacagcccacagagatacatatctttttccacacacgaagtacacccaacctcctctaaaagccatccaaagtctcattccactaggccatctgctcaaattccaggacctcattgtctaagtcaagtcaatccaaaatgaatctcagagagtccaagagaaaatgaagctgtttaggtatagtcactcaagtaccacttcccaagtacagttgtcaatcttaagacctgtaaacaagttttgtgccatcctcacaccacatatacaatggtagattatgcacagagaaaccaaattagactctctggttcaaaagtggagaaaataagagagacaagtcactggtccacagcagttttgcaatccagtcaggcacatgctggtcattcttgattagaactcagtcatgctgtttcccggacatgattctccatggctcttggctctgccctctgtgttagttctgccactgtaagtcatcctttttttatgtatatagaggttgtctatgtttacagctgcatagactcctgaccataaagtttggaagtcaaaggcctgtttctattttgtcccaactctgtccctttcagtacaagctggtggtgttacctccaatatagttatcttaaaaatgaatgggttttctatgaattttattcaggtttactccacttaataaaaggcacatccacaattatataaagataagctcccccttaccccttgagcttctgtagatctacagaaggaaaatgcttttaagataattagaatccctattgtttaactgaaaagacctgtaaagcataaaaataagctctttagagggtcttctgtctcatggagtgtctccctgaggaatacctaataattttcttgggtctttatgtagattttatagtcacgcttccttgtcatccttagatcatgttttcctggaatttgatctttgcttagaaatgtgatttcttaatgtttgcattgttcaccatctggagagattggaattgaaagagcattttactttaaaattcagtaatgcctggcttcttcatttgtaatagttcttctttagctttttctctcccattttctttttcttttactataaacagaagatgcccgatggctccttcaatactctacctggaaatgtccttagctagattatacaatttcatttaactgtatctttttcttttccatattatcacaagaaacaatgttgctaaactttccaccagaacatagcaaagatctaattttctctaatttctgatgacacttttctcaccttcctttaagtcattacagctcctcaagagccatcacgcttcttttaaggcctgtcccgctaacttgcatattcctgtccctaaattactgccacattttcaggtttctgttataattctctgccagtatcaaattctttttttttttggtactaaagtattttattctattttattttatttttaatttttatttccataggtttttgggggaacaggtggtatttggctacatgagtaagttctttcgtggtgatttatgagattttggtgcacccatcaccttagcggtatacactgaacccaatttgtcttttatccttcacccctctcccacctttcttccctgagtccgcaaagtccattgtatcatttttatgcctttgcattctcatagcttaactcccacttatgagtgagaacatacgatgtttggttttctattcctgagttacttcacttaggataatagtctctagtcccatctggattgctgtgaatgccattaattcatttaattttatgactgagtagtattccattgtgtatatgtataaaaaagccacatattcatggcagcacaattcacaattgcaaaaatgtggaaccagctcaaatgctcatcaatcaacgagtggataaactatggtatatatacaatggaatactactcagccataaaaagtagtgaattaatggcatttacagcaacctggatggcatgtccagacatcacattctttatttgatatctattgttgcattatgtgtcaccttaaaattaatttcaaacaatgatgaatattcattacctctcctgggccactccagaagacagtgtatgacatggtgatgacttgccacgaagtaagtgatctcagagaccaagttgcagagttttctattgttcacagaagtcaggcctaattgattatagaaggggacaacaaaagggtgtgaagtcaggagccaaagattaacgatgtccatcttggaatattatggagagaaaaaaattaatgaatatgtagtattttgtcctataattatcttctcctagaatatatctcctattggaaaataaaaggacttaaccacttcaaacttcaaaattaccaagatcaaacagaacattgttataagcgaatgatgaattcttgttttacaaccttaattatacccaatttgtagtaatcggtatttatgcagctgctgtgcttcagagcagcttttattttcacacatacatccattcattttgaaatctttcaaagctagtgtggatatggtgagactcccaattattcaaaaaaaaaaaaaaaacagaaacaaatgacagtcttcttaagagtggtcagtaagttacaactgggtgttttctctctgctaagtttagacattacactctattcaattttatcttgattaaacaattgaaaatcatgtgtgcacgcaactggtataaacagatcatttacctaatatcagcatttttctgaagggactaagtcaatgcgaatgaaaaaaatgtggttgactagaaaatacacatacacacacacacgagccatatattaacattaaagtagagccttacatggattttttttaagtcaagaagttaattcaaatacaatcttatttttatacagtactgtgttaataggaaataatatatacctttgtgattaatccttataggagattcaaatgacagttattggactttaaatattgtaatccattaatgaagagaaaaagaagatttctgctctactaaaatactatccttggtcaaaaagaataggatattttgaaaatgtcacttaataactggtatggtttggctgtgtctccacccaaatctcatcttgaattgtagttcccataatccctgtatgtcatgggagagacccactgggaggtaattctatcatttcataatagtgagtgagttctcatgagatctgatggttttataagagtctttttccccactttgcctgacacttctccttgctgctgccctgtgaagaaggatgtgcttgctttcctttctaccctgattataagtttcctgagccctccccagatattctcaactgtgagtcaattaaacctcttttctttataaattacccagtcttggcatgtcttttttaacaacatgagaacagactaatataatggccattttttgtttttattgaaaattcacttttatccatttaatggaactttggttccatcccattttatataaattgtttgttgttacagatataatattagatgaagtgaatgtgtcaataacttcagatttgcaagcagacaaattagtacagtttaaatttgcccagtaggcagatttggtatggtgaaccatatgaaaagtagaagctctggggactttctggagatacttaatgggattgaaaaatatcattttcttatggcctacaaattttccatccataatgggtgtttctatccaattatgcatgtttctcttaaaaagatataatagtaattgattggtggtgatctcttaaagttatttagcaataaactcttaatgtctgatttcaaggttggtgtgggcattctatttcctaatagaatcaacagtattgtgtgtgtgtgtgtgtgtgtgtgtgtgtgtgtgtgtgtgtttactcttgttatttactcttttaattttagttctatctgttattatttactagtatatataccatattatggtattttatatataccatattatggtattttatttataccatattagatagtttgtagaagatgtatattcaaagtagggtggctgacccttatgcctaaatttatttgcttctaatgttcccttagattttataaattaaaaaaaggcatctataatgcaaatatctctttgtaatgagttacacactaatctactttatttcataatagtaagtttggcttatttgacatctgaataacaggcaatagggaattaagaaaatagaaataaatatcaaagaaacaagaagaagaaagttggatagttgggaaagttctaaagttttgtgtcctaatctctgagggctggctcagcagagaaagaataacagtgagtctttgacagcagagggacagaaagatgtgacagtgagaaagatgatgtcaaaagagaaaatttgagtgacagtagaccccagaggcaaacatttacctggtaacccattacaattcaaccctgacttcttcctctgtaataatctcactttctcaaaaaacttcctttttctacactgaatataacatcagcaaggattaaagaaacagtagttggatgtgatggctgtggccaggtagaatacccacaagaattttagtgaaggttatactgtacaccagatttacattcccatttcttctgtttcacaggttttctgaaccagatgaataactcaagtcactctgtccttcagccttcattccaaggatgcatgcagctcattcaagtggacgatcaacttgtaaatttatacgaagtggcacaaaggaagccgggaagtttcgcgaatgtcagcattgacatgtgtgcgatcatagacaggtaaatgatcttttcatcctacctcacgttgtccaaactttccaaacctgtgtttctgttgtgagaccagtgaaacatcccaaaagaaaattaaagttaaaaacaggtaaggtggaaattaccattcaaagtacgtattgtagtatacttgtgatattagcagtgattatgtttatgtttttatgtggatatatatatcatatatctatcatgtatatcatatatagcatatatatgctatatatgagatatatcctatatgtgctatatgagatatatcatatataacatatatacatatatatgtagcatatatatgtatatatagcatatatgagatatattgtatatatagcatatatatgataaatatatatgagatatatcatatatatatatagcatatatatatatatatgtgataaaacacactgtggtgttatatttgttcaacagtctccaatcagagaatctgagccttcaataagtagttttgcaagcaacagcagtgtggcagagaaactctgacagttgatttttagtttacagcagaaatgtgccttctctttctgtctcaatcatgacttggcctcagcatgtgccttccaaaacccgcttctgaaagaaaaggaatattacaaaagtgtcagtgtgcaagatgggtatttatgaagcagaatatttagagtaactggttcagcttacaaaatacacctattaaaatatgacaaaaatcaaatctttattggttttgcaaacctggggagaaatttttaataaaaactttaattgtattctcacacagtgggaagatgcaacttttctgtgaaatattatgattatactgcatacactaccttaatatacttctagatagggcctgtcattccactatgaacaagtttcattttgagatgctttgtctgtaaacaaattatatatgatttgaagttaacctagtgaatttatatgattttctaagatatattgaagtcttttgaggaagaactgtcttatcctaaaagctcattttattaattttgtgtttagggaagatgaaagttctttaaatttttttaaaattttgaactaagatattaatcctatctcagtctacccacaacaaaatgtagaccataagtctttaacaaatgtattttattcaagaggaaatactttaagaagtcactcaaaaatgaattttacaaacatataaaataatctattttgaagtaagtttgctttcataaaatctgaataagatggcgttcgtgtgaatggtaagttacagtttgtggtggctgtaagatagaacttctataaagccttcacatgtttataagaagactttatgacatagtatactgcttatttctattcatgtatgcaagtactgatcttagtagcctaaacagtttatatttaaatagaatagtgaacaattttaatggaaatatactcctaattattgagccattaataatgtatcagctattatttctgcctagagcaagtagcagcaataatcagaaaagctgagatgaatgttttaaagatcatttgttctgattttagataattatctacatattgttttgtacagaaaaaaatattttcttcataatagttatggagttttttagtatctactctttttttcaggtcagtaattgtgatgatacaataatttcattacctctttcagcttggtaaaagggctaggtaatatgttgctgtttctctctaaacatcgtgtttctaggcattatatataaattgtttgctactaaagaaagaggggtgatatgttgagatattaatgttttactctgatagagacaggagttaaattggtcccaaaagaatgaatgggattttggtaaattaataaaatggaaggtgatactcctggtggggagaccaacacaagggaaggtatagaaaagaaaatacaagtttcaatttttcacagatacagagatacacaaaatttttttttttttttgccaaaataggtcaggcccaatattcatcttgccaagtttcctgcagctaaaagaacaaagttcacacctttcttattctttaggatgacaaatgaaaagattagctgcagggaagtagccacctgtgacacatctccacgcattttctaaacccattatgggacctatttttagcttacactttttttttaaggcaacaacatctgtacattaaataccaatgtgtgaaacagcagattcctttagtcacctaaaatgttcccagttcaaaatcttaagcatgaagtgttgtactttcataggtatgagacaggactattttacttaaaccactgaagagtgtattgatgatatcacccttaatctgtgtctttccaggtaaaagtaccagtggttttagtctgtcctcatagagcagtgatgtatccagataatcctttaatgatacacccctagcacatctctgcttctttctcctcgctgagactttgcaactgccccgtatctacaactttcttttcagattacccaaattctcccaaaggaagcctacagtggcttttcttttctccttcccagttccagcttgatcgatttgagagttatttttgagagggagaaaaaaaaaagtataaatgagaacatagggtaaaaaaaataaaagagctacacaagcctgacttttatagaatgtttggagataatagtcacagctgcaatgatttgatgagtagaacttagggaaacaatttgtctgaaggtgtttttctgtgtgttgtattggaataccctacgatttgaactttttttttttttttttttgctttgtgtgtagatttgcatgtggcttattttgttcacgtgcttattttctgaacgcagctttgaatcaaggaaaaagcaagcttgccaagctacagaattatgcattcagtatttattttctgagtgcatactagatgtcatgctattctaggcacttggaataaatccttgaacaggacagataaagattattgaaaattctaagctgacatggtagagggaggggaggaaggagagatgacaaactctaattaaaaagtaaataatctagcaagtgagaaggaataaattttatgggtaaaaatactagaacaaaacaaggaagcctggcatgtcagtagatcaaggtgttgagttgtagtttaaataggttgaccaggataagcctccgttgaaaagataatattactgcaagacttgaaagaggtaactgaatgtactaatgcagggaaagaacatttgacccagagagcacaggcaacgaaagaggcacttgcatgatccaggatcagtatggaagccatggtggcaagtttcgggaggtcaagaatagttgaaggaatagacgccagaacaagccctccagacttgtaggttattgtcagggtgtggcttttactttgaatgaatacaggagccatttgcagcgttctaaatagagcaacatgatgtactcacgtcttaaaaggatgaatctgggctgtgggagcaagaaaggtagaagcaggaggctaactaaaattatgccattataatccaggtgagagacgcgtgtaccctagaccagggtgctagcacaagaagtagtgagatgtggccaattctgaatatattttggaggcagagtcagtagggtttctttacaaattagatgtggggtatgagagaaatggaggaaatagggataaatccaaatgatttgctaagaacagcaggaagaaaggagatgccatctcttcagactgggaagactagttgtagagaaaattagtcaaaggggctaaagaaaaagtcagaaattcaaggttggacatgaattgaaatgtctactggacgtctaagtagaaatgtcaggaagagagttggatatatgtatgtaacaagcctgtgtctgcaggtttacacaataaacctttgtgattgacagaatcccttttgtttaactcttgagggtctttggtgtctttagttacattttataagcaatcatagaactggaaggggaggtggtggataatgggcagaaattgctctctaacaatggaagctgctagcttgattcccttagtgataatctgctcttagagaggaggattgtcatcaaccttcagtttccaaaacattctctgagaaaggtaaaatacccagagataacatttttgtttcttcttgcattgttactctcttttactcatttctagaacccttgcattattgactgcttgtggcaaacatcttaagatgcctgactcaactcttattctcaatctttttctctccagcctctttccaggtgtgaaaacctgagagcccaaaccttcagaaacactcctttagccacagttaggtccactcacttcttccttcaagagagaatcacaaggagaaccatagggcatctcaaagttggggagagggggtgcttggggagggacggacattgagggagagtcagggagggtattaggggatggagtgagtcagtccttgttggtattggctagaattcctaaactcggagactcgctacaacagatctgatagttggcctcagaacttgtgaattgttgtagaattattgtttgacctgtttttctgtggttgtagccaggacacatggttaggaagaagctgatgttaacatattttgagcttaattaagtggtgatcatgcttggtttgacaatttttttttctgttttgtgagtaatagtgaagtccattttgcaactgtggtttctgtttcagtcctaagagcactcttcacagctcagctgccagaggaatgttttttactttatgctaggcagaagcagagatgagacacagttctggctgctaagagctaagcagaagttagctgtggtgttcttgggaaagcttttgttctcctgatacagttgcccctcttgctctccaccatccttggtaaaatgtagaactgatgtctagagctgtagggtcaagaaaaccatagatcgagcagccactgatactaacttgtatgtgaaaaatatcaactatcacttatctaagtaattatgaattaagttttatttttcttggagccaaaagcacctgccctttccctagtccccacttctaaaattaaccagtaccatcattttaccagaatacagaagaacaaattcctaaatatggaaatgactttgaaagaaaagataatactttttggagtgtattaagttgcattttagtgatgtcccctagaggttgaaatctggggactaaatagctgtttagaggccaaagcaaattcatattgttagagccagcactagtaaaaagtgactcattagaattagaatctcctctgctctttcctgtctaactccattgaaaatatattaaaaaatacatttagaaacaaaatcagtaaacatcccagataacacagagagcggaaaaggaaatgcaaattgcccaacttaaacatagcctacaaaattaccacttgagaaattatgaatagactagatcctattccagagttagtaattaagtcttcattatatttttggatgaagtacataatcacagacccagtttttttttaattcaatgctttattttcaagaatatccagtttgatttttttctttcaaagaaaagaataagtaaatgaattttcataagaacatttaaatgaggattaggtagatacatgaaaaatatctcaaaactaaattgactctgttggaaaggcgaatgaaagcagtcaagaaggatgatatggtttggctctgtatccccacccaaatctcaagttgatttgtaatcaccatgtatcagggaaggggactggtgggaggtgattggatcatgggggtggatttcccccttaccgttctcatgatagtgagtgagttctcatgagatctgatagtttaaaagtatggcactttccccttcactcactctctctcctgctgccatgtaagatgtgccttgcttcccctttgccttctgccatgattataagtttcctgaagcctctccagctgtgtgggactgtgagtcaattaaaactcttttctttataaattatccagtctcaagcagttcgttatagcaacgtgaaaatggactaaaacaaaagaggtcatgagtttctacaaaagcaggcttaaattttgcgttcataacttagatgaagaaaacatgtaacatttatcattttctaaaatttgtcttcattcgctaattccctatttctagtcagtagcagaaaagataaatacttgaacacatacattttggtactgtaatcactcctcctttccgtgtatattcggtcaacatgggagttgatctcagtcaaaggtaaacttccttttgtggttgtactaccatttcaagagttctagatgccctagcatggcttgggtcagagtcagcttatgcaatacgttatcaccacaggggtgggatctgtcccacctgctccaccaaggttccctctgagctccctgagagtccccagcctggtcggccttcagggtcccacttctgtccctgccacccactgtcatgacaactgctccttctggccttcagatatgtcatgggtattgctggacttaggttctgggatctgtgtttaaggtgacagctattcccagcatgtctgagtcccatttggttttagcattgagagtcctgcttctggagaaacccctcagttctgggtaaattaggatggttggtgactatacacactaggtcttctttctcctaataccttcgtctgatctaccagccatctaagcattttataggccctatagggacacacagtgatttctatatcttttggagactacataaagctgaaataaatcatggcatatgtgttgttggggagaggttaggcattagggacagcttccttaggctacgccccctttacttcagcatgccatccctccctatctgctctacacagccactcaggctgacatgaggccctctacacattagaccctcaaaggccatcataggattcctaagtctctgctgtataaaccaaatataaaattctaagccatcatactgactgatgaaccctccccttagccaaagacattccaaataatcctgaaaaaaaaaaaaaaaaaaactagtttaggtcagacatgcctcacaaacatcaacacagagaccttaagactgatagaatagtctctttaagtctgataagaaacatctacaatccattctctctgaagactgctacctggaggcttcatctggatgatcaaagttgggtccccatgactgcttatcctaacccagacattcctttctattaattccatgtctttaaataataactctttcaaccaattgccaatcggaaaatatttaaatctacctatcacctgggagcccctgctttgagttgtcccacctttccagatggaaccaacatacatcttacatatattgactgttgtctcatgtctccctaaaatgtataaaaccaagtcacaccccaaccaccttggccacatgtcctcagatcttcctgaggatgtgtcatgggaatgtccttaacctcagcaaaataaactaaattgattgagacttctctcagattcttttttggcttagggttgagatttattcagtcaacaaatacttcttgaagatcacaccaaccagcagacagtacctcctgggactgaatgctgaggtgacgaagggagggtgattgatcagactctacactgttttaatggttgtttggcttttatgtcttaacacttacaatgcctctgttttgctctcaaaaatatagctttttccaatcaaaagctacttggttttagactacttttccaaaattaaatccacatgtttcttaattttctgtttcagtccagactctagaggtgaattatcccagaacctactttatatgataattgtataaccattgatccactggtaagacagccatagagtaagaaaaaaaaaattttattagtgtttctttagtgatggtttttatgacagatttcctttctctttcacctgaatcttgctgactccaaactgctaccctctaggtcggacacctccttttttcatacatttccaggttgaccatctccttctctttttttctttagaaatgttaatgtcatcatttaagctggcgtcaaactgtgcaggcatttctcttactttgggaaatattttgtcttttaccattaggtgcttatttcattacgcatactgtaggcttctggaaataccttactttcattcatgataattattgataagaggtaaagggggcagaaagtctcccagataaattcacgttattcaaaactctacatttgctcaatcctgacatcgttgtgactgtgatcccatcaaactacaaataatcaaagaacaggttggctgaagctaattctgaaagaacttgagccaacaagcaatttttcataagtgaaactggatttccttttagagactgtgcttcggacaaaagctcttgcgtcctaaaacctaatccccaacttaaacatatagaaaaacgtcagttttctcatggggtcatcctattgtgattctttcaggtagatacgttcatcttgtcccttcaccttaactcggtttatttcccatattggattccactgatttttatgttgcaaatcgctatgctctatcttagtttctgataaatgaaactactggcaatttctgagaagtcccatttcatcatgctaaatctgacttattcataatattagatgtgtgactctttatttaaactttattggccttccatgctaactccagtctttcatttgatctttagcttcctttggtttcttttagaagggaggagcttcctgtttatacataaacatttaagccatgggcatctttctagcacaaaaacatcagctcaatgacctaaaagtatcacatacccaggcgaacccatgttcaagtcagttgcctctctgaagtgatttcaaagtgattttattttaagtacaaatagaatactagagtgacaaaaacatattcttttttaaaaaaaggtagtgaaatgccagaggagataactctcctaagaaataaaggaaaagaaaaaagttgaattagccattttaagattcaacagcagctgtattcttctttgatgcattgcatgtattaggacaaaagaaaactatatttgcttttggcatggcatatagctgtgctttgacatttaaatcccaaggaaggcttagtgcattaaagtaatgtcagaaaaacagttatatgtttgaagataagcagaaaggaaatagataaatagttttaacatgtagctaaatcaactacggagagatttaaataagccaatcgattttatttcttgcttttgatatcatattacctgcaaaataaaaataagagcaattgattttaaaacatttaaaatatctttcttaacaagtgctttcttcttaaaataattgtttttgtcaattacttgaatacattgcagttacgatttcacactaagaattcatttaactgctctcccctaaaccaagattacagactcatggacatgtaccattctttttgtaaaatattgggactgatacaacttaatgaaggggaagttggagcttgtaggacactatccttcatttgctatatgctccctaacatgctgtgtgggagtcagttgttcattcctgaaaatgcatatgcaagtcatacttgttactgtaataacatggtttaattaagtactaagtacattttcaaatgagcagagacagaaaaaagtttctggtaaaatcaaatgtaaaagttttagaaagacaagtggctcaaaacaaacacaaaaccataagtttatgtgtgggcctagacaactgtaaacatttgcagagattcataaagcccaaggtgaactcactgaaattcattggcgattttagttttcgctgcacttgaaaccaaaactgaaaaatgaaggtgatactatatggaaatggtttgataaaaaggccggtggattgaactacagacttcaaataagtcttcaaaaaagtctttgggtgaactcacacccaaaggccccagagtaattccctctaacaacgagtcattgaggtgacataatgtaggttttcagttaaattaaaatggttaaggtgtgtatctttttaatgacatttctttactggatttcattaaacccaacatattgaagacttgtatcattccccaatctgaataaaaggagagttcattatttctttttgctttctctttttgaggagtctttgcattccaaatacagagaaaaaagaaaaggaaaggagaggagaggaggggaggaaggacaatctgttacatcacattgttatctggtttattagtataagactcttttactttcattaaatgtcaggagtaaaaatttacaatggtatttattatagcatttgaaaataacattttgtttgaatttttttctttggtatttaaatgatctataagctgaaaagaagaggagtcatagatttttctatgccaagaaaaaaacagttttaaaaagatgaagttgtcattttcattttgtttgattaaaaacacatatttccatttcctctttgtattgttgtatctatactgcccaaaaactagttttaagagggcaacaagcttagtttttcagatagcattgtctaaaattctcatggcacccattgctatattagagataagtactttgttgtctttgcctatgaattcattgaggaatattagagtctgaatcttgttttgtttaccaaatcctgcttacatcaaaaagaatgttacatgagtaagaaaggaatgcagatggaaggggtgaggagtatgtgtgtgtttatttgaaatggttttgaaaaatgagtctgtaataaattttaacaaattacggtatctgaaaagggtgtcttaatcagtaaacaggttgatttaaatagaccattatctacaattgtgatcagggtaaaaccactaagtaccatacaacatttgtgtatagcattaactttgtttgccttcaacgagtcgcagctgttatacttttactgtgatagtttcatgatttttgcttctttggcatagtcccagacaggcttcatcaacaagaaacttatcttcatgaacacacttcagtgaagacccccccctctgggaaattagacatgacataaaagtgcattgcttttttaaaacacttcaggcatttgaaaattacaagagaaattttcaagtggcacttcctaagttagaaataccatacacataaggccgggtgcagtggctcacgcctgtgatcccagcactttgggaggccgaggcgggcagatcacgaggtcaggagatcgagaccatcctggctaacatggtgaaaccccgtctctcctaaaaatacaaaaaattagccgggcgtggtggcgggcgcctgtagtcccagctactcgggaggctgaggcagaagaatggcgtgaacccgggaggtggaggttgcagtgagccgagatcatgccactgcactccagcctgggcaacagagcgagactccctctcaaaaaaaaaaaaaaaaaaaaaaaaaaaaaaaaaaaaagaaataccatacacatgaaggcaagtttctctcacatagttattataggacacttgttaatctcctatgaaggtcaaggccactggtactaaactacacaatgagaaaaccaaaagttacaggataggatctcttctcccagaacaggtactgatgtagcctagagacagtaaacattcacaagaaatgttaaaactatgttaagaagcatgtaagcatttgcttcttaattgttacagataatgatttctatagaaaattaataagaggaataaaaccactatcagctgcgtggttaatgaaaaccgcataaaagaagtaggttgaacttcagaggagcattagcctcggatgatgagaaagaaaggcaggaacatgccaggcaaaatcagaggcatgagcagaagtgtggaggcacagataaccatgtcccatttctgaaacagtcaagagatcatttaaactacagcaacatgtttgtataggagagtcatggaaaagttgaaaagatctatttttcatttattcatttatccattcattctacaatgtttcattgattgcataccatgtgtccaaggacagttttagccttgaagaataatttgtaaacttatggattctactttcttactgatttatgaaagagttagacatcagaaaaagcacacacacacacataccccatggaattgttggaaaaaaacacacaaacgccaaaatcaaagtatgcacaagggatcttgtgcctaattctccctgggatctaggttgggatggagatggcagaggagcagttcaaggcacatgctataggcattccagggagctggaaagtacatgggtgtgaatgacttgagtacgtgcagtaaactcaaggatttacagtaggttctttcacagactggcagctactagtgagggaagatttgaagctaggaatttagggggatcctaatgaaagaggaccttgcggccgggtgtggtggctcacgcctctaatcccggcactttgggaggctgacgcgggcggatcacgaggtcaggagatcgagaccatcctggctaacacggtgaaaccctgtctctaaaaaatataaaaaattagccaggcgtggtggcgggcgcctgtagtcccagctactcgggaggctgaggcaggagaatggtgtgaacccgggaggcggagcttgcagtgagcgaagattgtgccactgcactccagcctgggcgacagagcgagactccatctcaataataataaaaaaaagaggacgttgcattactagaaagactgtaatttatcctttgagcaatacgcagccattgagggattttcaggaaaatcaagttttgcatgactaacacttgttctgattacctgggcagaggtgatgagaaatgaattactgcagtagaaccaggtgaaaaaggaaatatccaaggtatttaggagttggactgaggagagagggctcattagatgtggaaaccggaaaaggtattggctagaaagagaaactggtttcagagtaagaaaaggctttaatgaaagattgttatattcactagtctccccaaacaatgtcttaactgactatttgtttagtagtgggtctaccggttagggtaagattttactgggatctggaagatggtgaaaaccagtagcagcaattgagcaatagagagtggtaaaagagaaaattaaaatagaggcagaattgagatagaagtgcaggtacacttagaacgatctgatctttgacaaagctgacaaatataagcaatggaaaaaggaatccctattcaataaatggtgctgggataactggctagccatatgcagaaaattaaaactggaccccttccttacacaatatacaaaaattaactcaagatagattaaagaattaaatgtaaaacccaaaactataaacactttgcaatacaacatatgcagtaccattcaggacataggcatgggcaaaggtttcatgacgaagacacaaaagcaattgcaacacaagcaaaatttgacaaacatgatgaaattaaactaaggatcctctgcacagcaaaagaaactatcatcagagtgaacagacaagctacagaatgggagaaaatttttgcaaactatgcatctgacaaaagtctaatatccagcatctaataggaactgaaacaaatttacaagaagaaacacaatcccactaaaaagtgggcaaaggacgtgaacagacacttttcacaagaagacatacttgagatgaaccatcatgaaaaaaaaaaaaacctcaacatcactgatcattagagaaatgcaaatcaaaaccacaataagataccatctcaggctagtcaaaatggctattattaaaacgtcagaaaataacaaatactggcaatgctttgggaaaaaaaggaatgcttatacactaccggtggaaatgtaaattagttcaaccattgtggaatacaatgtggtaattcctcaaagatctaaagacagaaataccgtttgattcagccatcccattactgggtatgtaaccaaagaatataaatcattctattagaaagacaatccatgcagacattcattgcagccctattcacaatagcaaagacatggaatcaacctaaatgcccatcagtgataaaatgtggtacatatacaccatggaatactatgcagccataacaaataataagattatatctcttgtgggaacatgaatggagctggaggccattatccttagcaaactaacacaggaacagaaaaccaaatgtcacatgttctcacttataagtgggagctaactaatgagaacacatggacacatagaggggaaaaccacacactggggcctgtcagagagtgaaggatgggaggagggagaggatcaggaaaaataactaatgggtactaggctcattacctaggtgatgaaataatctgtacaacaaacacccatgacactagtttacctgtgtaacaaacctgcacatgagcacctgaacttaaagttaaaacaaaacaaaaacaaccacaaagaaatgcaggtagtgagatactggattaaaaaggaaagcagaagatgtgcagagctatactctctaatactgcagccactagccatatgtggctatttcacacttaaaaagcagctgttctaactgagacgtgatgttagtgtaaaatgcacaacagattgtgaatacttcatacacacacaggaatataagacagctcattgatcatttttgtattcattttattttgtgttaaataaaatattaatattattgtcacctccataagattttaagctacatatggcatgtggctcacaagttattaatattagtgctgttctggaatctttctctaggtagttccagctggatgctgtattgcaagaatgagtgccctagcttctttgttggtcttgtccacagatgagtaaagagatcctcgcaacttctgataggactcaacaagttgtcctttataactgttttatctcagagacaatgcagatccccagaatgtctgtgaaactggcatcattctgaaatcacagtcccttttcattagttagaagttttcttaagcctaagtgtatttgcaataccatctccagagaatatctttacagacttagaagccagatgtgttggttttctcccagaatattaattccctgttcattaaaaataaaataagaagtattcaatgggaaaaaaaatgtggcctaaattaagatggtattttaattgagcacaagttagaactttcctggctcaaagattaattttttctagtaaagtatctgtcagttacacaactgtgtataattcatcatccttgaagtgaaagtttgggtctcagtaagaaagtgctttcagctgttaggaacagagacccaatcagttttccaggcaaatctgaagtttatttctgcacatgtaagatgtctgaaatagacaattcaggctttgtataatatatctagaaagcgatccgagacccagactcaaacattctgctccagtttccttagctcatggtttctattttcccagtgattaagattgctgctagaactccagaaatttcatctgattttcataaagaaagtaggagggtccaccttccgttttaaaaagccattccagaagttccgtgcaacattttcaatcatatctcattagccagatttaatcacaaccacagagttgcaagatagactgagaattacagtttcattctaggtggtaatatgcctgctaaaactttgaggattatcactaggaaggaagaggaaaatctgtaatgagatagatagcactctctgcccagttgatgtttcgaaagattataaaatataaatagtaaaaaagtgcatgcttccagaaaaaaatatttgatgcagcatttatcttattcaaaccatatattttatatttttcctccaaaaatttaaaatatagttatcaaacttcaggcttagacaatcgacattttagggtattcaagagtgaagatgatccagcctcccttcaaggatttcataagagagtggcagaggtatctagttcttattctgacctcctactcgaaattcatcagtaacttcttattgcccttaagaaaaagacccagatccttaaaagcagtgtattagcctcttgtggtctggcctttgtcttcctttgcagcttcatctcacatcactctcctccatcccctctagccacgctggcctgtgctcagtgcctcagatgttctttcagtggggcccctgcctgtactgatctctgggtctagaattgcttcaccccaccacccatctctgtctctgtctcttgctttcttatccttcatatctcaattcatagataaactccattaggggagccatctcaggatctgtaagactgggttaggcactttttaacctgtttataatcacacattcaagactgtaattacatcttttcttcttctagactttgagcttcccaagaatgggaaacaggcctgagctcatgccccactgtgtctctgtgcctaacacagtgcttgatacgcaatatgttctaaatacattttttatagaatgaatggaaaaatataatagtagcataaaaaaggactatgaaattataaagaaggaaaagaacaattctaaatggagggatttagcaatgctttatgagtgaaatagaattaaaactggtccttccaggacagaaaggctcatatcagataatatagggcaaggctgtcttggaaaaatggactatataaactaaggcatgtgacacagctgaaataagaagttgcccaaaattctcagaatgcctgagaaaacattctaagaatttatgctttagtctgtagtccaaggaattcataaacttttggaatgtgcatacatgtttgtggttaagtgtacacattccagagacactgtcatcacattttgcctgttagaatggaaactcgtgtcaactcattcattcttaaaactctcctaccagtgtcttcccacctatcctcttcgagtcaatggtcagaaaattctagaagtgcatacatcggaaaagagtttactggaaatagttttaaaataatggcttagagtcaaggaatgctctacacccttctactttgccagtgaattgagtaagaaaacagctggtttctatcgaaaaatttactgtagagtgttttcttcatggagaaactagattttggatgtcacgagggaatggaagcgttggagaaaagtattcaaggtaaaacagtagcttgttccaacacaacaggctttcccctaagacaacactctctaaagaagtcctggaaaggaaaatgagaatgtggtagggcggttgatacagatcagtaaggaaatgaaagtccaaaagttatttacatggtaaacatctgtgccaagaggagtactctcaataacagggattagtgagagagcagttggctggagatggaagctcaggcaggtgagcgtggggtgcagagaaaaaaaaatgtatgaagaataaatcaatatttttttgagaatgagtattttagttcagtacttctcaatattttaggtgcatacagatcatctgggatcttgtcaaaacaggtttggctcagtgtgattgaagagaacactgggattctgcttttctaacaagcttcaaaatgctgttgctgcagctgcttgtgggccacatcttgaacacagcagagctccagcctctgcatctgggcccccagatacatgaaaaatgcagctcaggtagtgacaaaaaagatcagtgatgtgggcctttggtgtgttatggtttataaaacagaaaagcctattttcttttcccttaccatttccagggaaaataaagtaatggggatgatgtagaaatcacctgaaatagtctggcacagtgcttgcaaggctgtaggaaccaactgaagtttgctcaaagctttatgtacttctgtttctcacttgtatcacctgttatctttggagtgtcatgttttacgttacatattagcaatggaaacagaaaatggtttttcaatcactcactgtgtctatgcatagaaaggctgggcgcagtggctcacacctgtaatcccagcactttgggaggccaaggcaggccgatcgcttgcgatcaggagttcgagaccagcttggccaacatgctgaaacccgtgtctgctaaaaatataaagattagctgggctctgtggcaggtgactgtgatcccagctactcaggaggctgaggcaggagaattgcttgtacctgggaggcaggggctgcaatgagctgagactgtggtattgcactccagtctgggcaacagagcaagagtctgtctcaaaaacattaaaaaaaaaaaaaaaaaaaggatgccaacaatataatataacaaaatatctaaatgtgtagttgtttgatacttattgactgacttattttttgattcactatcagcagctttttcttaatttggctctttcattgcaaggaactgtaagtcagagttcttagttatgaataaacaaactaaaaagacagatgcaataaaattcaaatgaatttaagaaatggattctcccaggtgcggtggctcacgcctgtaatcccagcactttgggaggccaaggtgggcggatcacgaggtcaggagatcgagactatcctggctaacaaggtgaaaccccgtctctactaaaaatacaaaaaattagctgggcgaggtggtgggcgcctgtagtcccagctacgcgggaggctgaggcaggagaatggcgtgaaccttggggggtggagcctgcagtgagccgagatcgcgccactgcactccagcctgggtgaaagagagagactccttctcaaaaaaaaaaaaaaaaaaaaaagaaaagaaaaaaaagaaatggattctctatctgagaactgatagaaaacagaacccaaagagggcaagacaaagtcaaggctctatcacctgtcaccagaacacaatgttctagactcccctcagccatacagaataatccctaaagccctacacctttgtatacctccctcaaaatgtggtttcaggtgggagcatacaattgcttatgctgacacctctttcagagctctcacccttattctcccaccttggtctgtcttattaaagggtgctgccctgccttccacttaatttgaaatttctttctaatagacatgtcttctacagagatcagttcaagctagtccaattgataaggttaggctttgtgtccctacccaaatctcatcttgaattgtcatccccataatccccacgtgtcaagggagagaccaggtggaggtaattgaatcatgggcatggtttcccccatgctgttcttgatagtgagctctcacgagatctgatgactttttaagcggctcttcttctttcactcatcacttctccttcctgccgccttctgaagaaagtgccttgcttccccttcaccttcggccatgattgtgtttcctgaggtctccctagccatgctgaactgtgagtcaattacacctctttcctttataaattacccagtctcaggtagttttttatagcagtaaaaaaatggaccaatacaccaagtaagaacaacttgtaaagctacacatggaatgattaggaaaaaaaatgtgaaaattcataacaagggagcataaccattgaatgaccatatcatttgccgttaaaccgggccttttttaatcatggaaggagtgtaacaagtgtgaactgattctacaccggacaggccaaggtgcatggtcaccttacctaataagtgtgagccctcctgtggcttatactagagaaacttcttgattcaatagagctttaaaggtatgcattcatggatctccacccaaacgccctgcattaaaatatctgagctgtattgcacttatctgtttcctttaatcccaaaccaactgaatttctctgcttatagtttttgcagtcttataaattctgtgatgggcatatgttgcttactttctcagcaatgacttcctgtgggtgattcacaccctatttctttccatcagcctctgttttctgtttgggttcagagaagttgatttgtcttcaattacaatcagtttctcaacctgtggccacagggactatttcaagaacattcccatgattaaggccacacagcctgaaactcatgcgtgatcatgagcagcttggccttggactgaagacaaagtggagaacacaatcagaaagagaaataaaccacaatcttggtggctgtcaagccactggatcaagtctacacccaactccacattgagccaataaagttcctttttttgtgagtgcagacttagttgggtttttggtttacagccgaaaccatcagaaccaatacaactccagtgttcacagtgccccatattttgtcctgagatccctccacagtcccctttgtttcagaatggccaactgttttcatatcttatttcaaatttaagaaaggaaattcgttggctcgatttatcttttatctccagaatctagtaatatgttgctcatcaacatatggttcggctgctaggtcaagtgcccagccataaaccagcctctggggctggatgggagggctgctgttcttctctgaagacctgtatccattttcctgccttgcagataccagtaggaccagtattaggacatctgcataagatttaattttagaggccgtgtgcagtggctcagtaatcctagcactttgggaggccaaggcaggcagatcacctgagttcaggagtttgagaccagactggccaacatggtgaaaccccatctctactaaaaatacaaaaattagcctggcatagtggtgtgcacctataatcccagctactcaggaggctgaggcagcagaattgcttgaacccaagaggcagaggttgcagtgagccgagattgcgccactgcactccagcctaagcgacagagcaagactctggtctcaaaaaaaaaaaaaaaaagattcaattttatgctgcatattcattatcatctttgccttttgactgtatcatctcaaccacggttatgtatcacagaggcttagaatattataactcattgttttagtttatccaggctgctataacagaataccatagactagctcataaacgatagaaatttatttctcgcagttgtggaggctgggaagcctgagttgaaagcgctggcagatctggcatctggtgaaggcttgcttcccaggtcatggatggccatcttcttgcagtgttctcacatgctaggcaggcaaaggagctctctggaatttctttttttaaataacagcattaatcctattcgtgaaagtggggccctcctaaaagccccatctcctaataccatcacactggggattgggtttcaatatatgaattttggcggggacataaacattcagtctctaacattcaccttttgcacattagagaacgtctacaaagaaaacgttaaattttagttttggaaaacttcctttccttttctcatttttattctttcctttagcaatgtaattattattgtatggaacccgtatctgatgatggtgagtttaaatggatcaaaattattgttccttaaaagcaacaccaaaattttataagatatgctgcatactaattaaagctcaaggagccccaggcaagaaagaaagataagccattgcttaagttatgcaaaagtgtattaaatatttgagattaattaaaatctagagaaagttttttaagagttccatttaaagtttgcataaaagttcacgcaattattataaaacatttgctatcaaactggtttgatgaataagggaagtcaattagtaacatagtgaaataagagttaattcatgtttctctaggtaatttctttcctttgttctgtaaaagtcatttataactacataatagtacaatcatacaataacaattatatgccaatacccactgttttacaaagcgatggaaagcatagttctatggtacttacttattttctaagtgaataatattcttcttaaacccatcctgaaaatttctacaataaaagattcattgatggaaagtcaaaaagtttgatttctggtggtttttgttgttcataaaggaaatgaaagcacagcttttactgagcaggtggttcctggtgtgtgagcccttaatggaagaatgatctgtgtcaacaggactgggaaagttctgattctgacttctgaaattgacctttattctccatttcagaacacataagccacggtatcccttttattatatagacatcgatatgaagagaacaaataaagtcacaccaagaatgtctgggcttgttcatcttacacaatttattatttttgaggctatcacttagtggggaaaaattttcctgcaccctaatgtaaaattgcaaatgtgtttccccagagtaatgatagtctaaaaatgagggacagtgagtcgtaattaggattaggcttgggaaacaagttcacttatattatagcatgttgctatggcaaaaggaaaaatatggtctgattttcaaacaattgactggcaaatgggcttatcccatgccatctattaataatcaatacagcttattcaaaggacaaaagtcactttctctataaaagaaagtgggacaaatttaacaacggtctactttactgcaagttaggatagaatctagaggtaagtaaaaagctttaggtaatgtcttcaagcctcgaagcaccagctttattctcaccggggaacaaagtctaaagaaactttcatgaccactgtgtctgataaagaatgaaaattctgctgaactcagtggtgaacgtactcattattaaacggactcagaaatactgtggttcaaagcatgcttcctaaaaataaaaccaatataatctatgaagaaagatttccaatgccaaaaaaatttcaatgagcattcaaaggttgaatccatagccaccacatgaaatatgatataagcaagtcagtaagagccactgaagtgtacggtttcagagtgaatgtttgtttcccagggaggagaatccaggccttcctctcttctctctatgccctgcctgccctgctgtcttccagcctgcaggcaagttccctgttgctttcaagctggagcttggcaccacaggagtccctgcttgccctctcattcccaccaccaaagcctcctggcagcatttttagctgtgtgggccttatattcaacaacaaagatgaagatatatggctaggagtataggagaaattatgttcttgatatttatttggaatattaaaaagaacaaaaaaatgagctctatgttctacatcacatcatactgtctagcaagatgccttatttttatttaataatttcatttataaattgcctctttacaattatgattgaagactgagaccaagggaaaaagaaggcagaagttacaatatttcctgtgcctgagcttaaattttggcttccagtttcttggaagctttcttacagggttagcatacatctcagctggagtttcccatttagattatctaccagtgtttttgtaggtgttggcttagtatattaccaacattactgcatcaaatttgaaaataattcttcttgatctggtcccagatttgatccaagaagcacatgagtctgcaggatgtattcagactcaaagttctagaatagttatagattgtgatctctccaaaactctctaatctgggtgtcattaggtatttcttgagtctttgctatgccacttgctgtgctgggtggatcactagcagcagtcaaatttccttcccgacccagacatcttatcaaataaagcttagaggcagagattccactagacacacagggccacgagttaatctttgtgaataatttcattgttaactattgggacaaggtacaaaaaacaaaaacagaaacttgctaatggaatacactttctaagattataaattgcaccatttgccaaatgtatactgttagaaatgagagcaataatttgcacttactgtaagtccagcatacggagagggtcatatgttgaaatgccatctctattgaggtgtcataaaaaatatttcctccagcagcacccagtcattctaaggtattaggtataatttttaaagtattatttggtgttctgaataccaaaaaagtacatcttgagtaccacaattggtgacattaaagttaattattttcattaaatattgcagtgctgtcatgaggaatgaaacagaagagcaaaatgaggttagagatgggatgtgttcaacattgctccccaagtatttccaaataattaatgtattcattgaatgatatttattgagggtcagaaaaagtgccatggtatttgatacagcaaaagatcacatttatgatttcattctgtcactttctgcaacaggtagcatccccttgccagcaccaaggcagggttgcatatttgaaagttactccctcaaaaaattcatttaaataaatagatttttttaaagaaattatgaaatactaacgttgcattcagttagtgattttatatggtgtaggattgacattaaaaaatacttgtcattaattttactctgtattaatgttatattaataatttctgaaagtaaccaaccattctaactgcagaacccagctgtggacatgagtttctaggggaggactctgaaattgtgtcaatgtttgtaatctagtcctcggagaatacaaaatttttgacaaagaaggaggttaaggagtgttttctttttgatgttcacctccaaaggaggatcataaagaagtaattcttgaaaagtattgcaatgcagtcttcacaaaaaaagcttatccctgaagtacagaaacacacttaaaaggaacatagatgaaatctctattcaaagagtttgggtttgacctttatgcattacatattatcactgttttgaattaagctattactgtctcattgttattttagcagctaacaaatgagtaggtgttctgaaaagcagtgtttagcatcatgtaaaatgttattttaaaagttcatttccactgagaggattttctaataaccacgtttctgctagtaactcagccatatatatataaaaatattgaaattagagaaatagaaactactgctgtgatataatttgatagaaaaatattaatagatggtagacattgtagagtttctttccatgtagaaatgttacattggaggattaacagcacttttattcattcaaaatagtcacagcatccattctattttaaaatgttaaaatacaaatacaattaactaatgtatttatccacattatctaaattacacaaataaaatatatatttaatattattaaaatatctagggatctgatatgtcctggtatgtctatctaatctgtgtgtgtgtgtgtgtgtgtgtgtgtgtatgctgagatatatatacataaagatatatacatctatagatattgatatagtttggatatttttccccacccaaatctcatgttaaaatgttatcaatggggcctggtaggaggtgtttgggtcacgggggtggatcccttgtcaatggctagggccattcccttggtaatgaatgagctctcactctgtgttcacttgagacctggtcatttagaggtgtgtggcactgccccctcaactctctctcctgctcccattcttgccctgtgagatgcttgctccctcttggcctttttccataagtaaagctccttgaaacctccccagaagttgagcagatgccgtcaacatgtttcttgtacagcctatagaccgtgagccaattaaatctcttttctgaataaattaccaagtcttaggcatttctttatagcaattcgagaatggcctaatagtgtgtgtgtgtgtaactacagtatatatacagtatatatatatatagtatgtatatatacagtatatatatatagtatgtatatatacagtatatatatagtatgtatatatacactatatagtatgtatatatacacaatatatatactgtatatatagtgtgtatatagtatactcatacacacaatatatactgtatatatacacacacactgagcatatattcatccacacatccagtcctctcagccatggctctaccctgaatttatacactatgtatgtgtatatatacggtatatacattgtgtatgtatatatacatactatatatgtaatctgatatatgtgtaactactgattatataattcataatatttaaattcccttatgcaattttttactctgctattatcctaaatttataatcattccataatgaagcaaataagcctatgcctcattcctggggtgtttagaccctgtttagatcctgacagatgcaatgtcttcaattaagttcttttacacactgaagggatagttcaggaggatcattaatactgataccatctaagcagaaaatagtcacagataattaactaaacttaatcgtactttagtatggataccttctttacatcgaggatcaattttaagttcactgaaatggatgtggtaaacatatcagagttacctcctgtggcattatatttgtagtaaatgtagtttttcaaaaccctttaaatacttgaacatatttttaagctcacaaaatactttgttattattgctttggagccaaattttccaattgcaaatatctaatgataattttttatatataactttactgcatacaagttggcaaaagaaaaaaacaacaacaaaattttaacttctttgtaagaaatcaattgtagataatgaatgatcgagctacttttctgaccagtcaagaagtgtgaacagatgctggaactgaatagcagttgctaagactttgcaggccgaccaccaccaggctctaagtgtcctatacaacaggtggagatataaggacttcttttaattgcaagacacatgatgaaaaataaaaggcacattctgtccacccttaaagttctttccctaattccctaaattaggttcttgtgaaatacctgtagttgttatgaaagtcatagaatttaatttataggtgtctcttaattaagttaggttagctagctgatgtttgtttcaaggatcatggaatcggccatgcagtaatttatatgcccaaagaaaaacctgattaaaatgcttaatatgatgaacagaccttgaataatcttcataattatagagtacacactacttacatttttgaagtggttccaaaaccatttgtccactgtgtgtatcttcaaggaataaacaattcactaaacctcctctctatggaaatgtatagacccttggcccatcacctcctcatccttgcagattttaatgcctggttcactgctccatgatccaataaccctcttgtagtattctttggagttttcaatatccatgtagaccattctttcaatgaacctatctctgaaatattggccctcctccattgataccatcctccagcatgtcttaatcactcagttccaagatcatctcctggaactcaacataatcattaactacaactactccataattgtgcttctcatttcctgcagctctctaaattcactgttaacaaaagttacatctatgtcttgttcactcatgtgctcacttcccttccacttagctttagtcccacattctatcattatgactcccttgcaatcacctttgatttctttgctcctctctctttcctaacacttgctcagaaaaacagcaatgctgattaagtgaaacttgtgcttcagcatctccctggggggaagaatggaagaatgtggctggggaaaaccacacacctatgctgattggtctcactttaaattcatagctcctaaccttcagtgggaccctggtgttgcaatcctacttcattccgctgctccatttcctcctctcccccaataccttcaatctacccatttcttcttcagccaattacatttcctagttgtttaaaatacctacttattttcttgttctcttttaaagtaacaatcatcattgctttcactttcttttgcctcattctttttgaacctatttcaaaaagactttcatccccaccatatcagtccctgtcaagtcatcagcaatctgcatgctgctaaatctagtggaaaattcccaatccttaccttcagcagcatttgatacaaatcattccgtctttcttgaaacattttcttgtagttttcttagtatttctctctctctcttgcttctcctcctactaaacctactgttccttctcatttagatgtctcctcgattttctcatttccaaacagtggagagccccaggtttcagtccttggacttatactgcttcctgtctacacctactccctaggagatctcattcaagttccatattccatctgtatgttgacttatctctctagctatatcctctattgagttttagaccttacacacaactgcctgctcccagtcagcacagtctaacaaacatctcaaactctttgtttctaataccaaactaccattaaaaataaatgtttctctctcagttttctccatgcaagtaaatgtcaactccattcatctattcactcaaaccaaaaaccttagcttcatctttcactcttccttttgaccttcacatccagtccaacctatcaggaatggctctaccctcaatttatacccagaatccagtcatttatcttcatctccattgtatccacttctaggccacctgttggatggactgctgcaataaccttccagttgatcttcctgctttcacccatgccctgtccccatggtctaattttagcacagcagccagagtgatacatttcaatgagatgttttcatccccatcccattcaatgtaaaagccaaaggttttgcaagtggaattttttttttttttagaaattgttttcgttttcagatgatgagaataatgcatgttcaatagaagtgtttctaaacgacaaaaaaaaaaaattgttattctccttcttgttccacacaatgaccattgcctttaaaaaaaaaaaaatcactgttcaggattggaattagctaggtaggtatgaaaaatagagaggatttaagttgtatttgcaatattaccatggtgctttacttacagcctctctcattgtggtaaagaaagactgctccttcatgttacagctggtttatatgtaattattttttttaaatcctgtaagaaaactcactcaactctcctgaaaaaccccaaagtgcagagacaaaatattccataaatatctttagaaactccctgatctagcatccagcccaacctcacaatcatctatttgctctccaccccattgtcaaaccaagccatgtggaatttaatatggctacctaacttctggatctttctctgataacaattctcatttttgtatctgttgataaagaatgcttctactgaatccttcgtccatatacccaaggaagggtaaatggaaaatatcgaagagatgaatttttttgaacttcttgtcagcattgttaattgaagatgtattttcctattgatttgatcatgtgttacttgattttgttctgattctcagtttaacacggtatttccatctgaagcttctgatgcatacttcatttattctaacgttaaacagaattttaaagctcaaaaacttcaatgttaattgactgaaaatgctaatctataaattcattttattgtagaaatcttataaggatatgttgtatagttctatgtcatttcccatgaatttaagatttagagattaaaaaatcagtaatttgtaaatggtaattttatcttgagcagaattctatgcctgtaaaccaagattctgtatcagtcagtaatagggctgaatatgtgacgatgtgtacacagggagggtgtactttacctttaagctggccaaatgtgcttttttatttttttaaataaaaaagagcctaaatagaaatcttatctgtaaatattcattggtcctaattatcttttatagagttgcttttaccttactcagttgtgatttcattattaaaacttcaagtcacagaccaactaagtgcttctttggtgtgtgtgtttgtttgtatcatggatatccagaacatttgtcattggatatgatcattataaaactcttgaacatgacttctctgaccgtggatctcaggagctgtacttgaagtttcaaatcagctggcagtcaaaatgtttaataattcctttccaccgagcaaagatttctttcaatttctattctaggagtttgtactttttctaatgtatcctgcacaactaggtccatcaagataaatttctgtgcttaatgtcatgaatagaacagaaaatatgttaaaaagtgatggctccaaaggcatagcattttaatctaaaacatctgtgatttttcttgttcacagaatgtctgcctccctcattaatctgtcaggttttaaaagatctgggaatgaatctgctttgtttaccactatgtcttcagtgtctcacctggggaaaagtttgtgatagatttttagggaataaattagtttttgttggatggatggatggatggatggatgaatactcttatactcatcctgtaaatataagtgacataaaaatcatcacaaatagatgtattgccaggtggtttttgataatcaactgtctcagtccatttgtgttgttataacaaaataccacagactaggtaatttataaacaatagaaatatatttatcatggttctggaggatgggaagtccaaaatcgaggcaccagcaggattggtgtctgatggggattgctcttcttccaagatggtgcctcattgctacatccttcagaggagaagaatgcagtctcctcacatggtgaaaaggatggcctggagaaagagagtgttccatgtattcttgaacccttttataaggatgttagtcccattcagggccctcatgctgtaatcacttcccaaaagtcacacttcttaatacagttgcattggggattaagtttcaacatgaattttggagaagccaccatcattcaaaccactgcaaaacagaaatcagtcttacctggaagtatgtggaatggctttattgaatatgggttctttcaacagatagagataagataaggtcattgaacaatatgattcttatcagagcaaacagaggcaacggtgactgagcatggagatatgtgagaaagtttaacaatagtttggataaaatgtagaaataaaaccaggaggcccccgtcatggagagtttttgaatgttaagtcagagattgggtgttttagtgggtagataaccaatagggaacacaacaaggagtacataaactacatcatattcacattgaaaactgagagaattgaacggcagccacaatgaagtacatgaagagaagtactaactaaaaatagatatttttcagagatgcttttaccatttacaaatgcaggtacatgcactctctgcctgttattcattttccaagagggctccaggcaatcaacctttatcttttttgggacttcaaaagaggacaatgttaaagctgcattagacataccccaactgtttgtttatgatggcttttactgtttatatgcaaacctaaatatgtaaatcttagaaaagaatgctaaaagaaagggtataaggcaaggaaaatctggcaaatttttaaattttaggtttcagttaaattaaaaaaatagtaacattatctttcaaacgtgaaaatttcagttgcaaagaatagtacaaataaatcaaagtaaatgtagatttagttggctcatattaaaagaaatactaatcagtaacagtacagcttgatttgtcattggatgaatgatgaactggggaaattgaggcaatcacaaatagtctagcttcagtttacctcctcatgaagacttctcagaatactcaaacctacaatgaatcctcagcactttgcctaaggcttgagccttataacctactcaataaatatttgctaaatgactttgcccttactaactttgcagccttttttttcagttagtaataaaactactttgtattgttatttgatatcttcatttttcatctagacagtgtaagatgaaggccctctctcacacttttctttcatctcatacttctcatttaatgattaaaattggcaatacaattagcgttacataaattgcattgaattagattgctactgtcttctaccctagaatggaggattcaatttatagttgacctttcttctgaagcttaattgttgtttattattcagtttgttctacggaagttaccactttcttttacataggatttagagtgtatttataagttggattctctgcttttggaacttccattattcacttaaaacagattcatgctttagaaagataaggagacaagaggaagaatccccctgtgttttatgtcctacttttgtaatacctgctcttctaaggttgtgattttgttgctgttgttttatttcagtagttttttgggaacaggtggtgtttggttacatggaaaagatatttaggggtaatttctgacatttatgtgcacctatcacctgagcagagtacagtacacccagtgtgtagttttttctctctcatccccctcccactctttcccgattctccaaagcccattataatattcttaagtctttgcatcctcatagcttagctcctgtttataagtgagaatatacaatgtttgatttttctattccagaattactttacttagaatgttggcctccatctccatccagatttctgtgaatgccattatttcattcatttgtatgtctgagtagtattccatggtgtgtgtttgtgtatatatatatatatatatacaccacattttgtttatccacttgttggtcaatggatatttagtcttccttatttttgcaattgcagattgtcattttttgatttttttaaattatggccattcttgcaggagtaaggtggtatattattgtggttttggtatgcatttccctgataattagtgatattgagcaagttttcatatatttgttggccatttgtatatcttcttttgagaattgtgtattcatgtccttagtccactttttgatgagattatttgtttttttcttgttgatttgagttccttgtaggttctgtcagatgcattgtttgtgaagcttttctcccactctgtgggttgtctatttactctgctgataatttcttttgctgtgcaaaagctttttagtttaattagatcccatttgtttatctttgtttttgttgcatttgcttttggttcttggtcatgatctttttgcctaagctatgtctagaagagttttttctgatgttatcttctagaatttttatcgtttcacatcttaaagtctttgatccatcttgagttgatttttgtataaagtgagagatgaggatccagtttcatttttctatatatggcttaccaatttttccagcaccatttgtttaataaggtatcctctccccactttatgtttttgtcagcttggtcaaagatcagttggctgtaaatatttggctttttttctgggttctctattctgttccattggtgtacatccttgtttttataccagtaccttgctgttttggtaactatagccttgtagtatagtttgaagttgggtaatgtgatgcttccatatttgttctttttgcttagtcttgctttggctatgtggggtcttttttggtttcatattaattttaggattgtttgacttagttgtatatgctagatgtcaaagcaggaaatagatatttggtgtcagaaacatgaatctatttattcttgtgttctcatcccattttccctctcaactcaccatgagccaaatacaattattttctaagtaaacattttgacaaatgcattatatatttagctagaagaagtttctgccttctatgaggtcacagcctaggaagaaagagatttgataatgacccagttaattggcttgattacaaaattttggcttttagttagcagaattcctatttaactggtttttctaaccatctcaggattaacccatctgttcagtgaagatacttagagaaacctgtattctaagaggttattcaaaagtattctcagaggtacatgtgcatatatcttttgccagtacaagctagcaatccaatgggaagatgtttacctgaaaaataaagaggaaaactaatcccctcagcaagtgtttatcaactgtctttgccaggcaccacccaccagtgctctacatgtgatgtgagcatgccctgaaggagatcatagtctagtgcagcaattaaacagtaaagaaataattacagtacattatgatgagtccaactaggacacagaggaggagggagcattatagggtgcagagaaacattcccagagaactcagagtaggtaagatacatgggttgaaggagccgggcacagtggctcacacctgtaaccgcagcactttgggaggccaaagtgggtggatcacgaggtcaggagatcgagaccatcctggctaacacagtgagacaccgtctctactgaaaatacaaaaaattagccgggcctagtctcagctactcgggaggctgaggcaggagaatggcgtgaacctgagaggcggagcttgcagtaagccgagatcacgcccctcctgcactccaggctgggcgacagagtgagactccatctcaaaaaaaaaaaaaaagatacatgggatgaagggaacagcatgggcaacagaaggttaggagaagcgcaggtcatatggtatgactggcttgttgaattcatgattaggttggtttgagcaattgaaaagtgattaatgtcaaccacttctcatttttcttttatttgataaatatttcttcttacatatctggtcacaaacctttaatgaattccatgtaaaacaatcaataaattttcttattctttccctcctgtgacaatagagatggtgtctctctatctcttttggaacctgtccctttaatagcttctgagaaactttaaactataaacttttccctgtatattgcactgctagcttcaaaccaaatcactgccatcagcctttaaacatacttgagtctgtcccatattaatcttgatttcacacatgtgcccctacaacctctgcttctctttacaataaagacttgtacaagagttgtctctagctccacactgccacttaatcctggaccgctccaatctggctttcacctccatcactcaaccaagacagccctccacaaaggtcactaatgaccgccatgtctcttaataaaatagacttttcagtcctctccttgtttttttctctgggatatgtttggcactgtaaatcagtttatctttcttgaaacaatttcttatgttggtttccatgacatcccactcttgtttttctctatctttttgagttctgcctgcccctgctaatttccttttctaggcttattctcctttacctagttggcaattagaagttcctgaaggctctgcactaagcactttctctttgttctttaacttcttccatggatttgatttctgagtactctaaaaactcccaaatttaattcccagtgaagacttgcctttcagtatatctgggtttgtttaacatgcatctcaaatgcatttcccatttcttatatcctgaaatctgacctgcgccccttgttttctgtgtaggaaaattcacaaatatctatcttgtgcattaggtcaagagaccatggaaaactctttaaattgttaaaacactttagaaccgagtttcttaacctcagccctattgacattttgagctacataatttcctgctgtgggggtctctgtgcattgtgagatgtttggtgagcattcctggcctatacccactagatggcatagcaccccctccagttgtgacaagcaaattgtgtccagacattgccaaatagctcttgggagggataaggaggccaaatcagcccttactgagaatcgcagctttagaaggaagataagagacaaagctgtgttttttaaaaaatagaaatcatgctgaagttttctaccaaggaaattattagttcagttgtatgcccaaagtgtatgacattaagtattatttatcaatatcactacttcccacattagctacatgttgtgagtctcattggttatctaaaatatgcttcacaaaatttgcccagcaaagatttgtccagtgagcaccaagaaaccccatttggaccttgctgatagttccagcatatttccacacaatttctctcctctcatcctcctaatctcccaaccacagtcacagtgttttttgaaatcatatgctcctcctgtcatccagtgtcacccagtgttctttctggaacatcctgcccatttcacttaaccccccttcatcctgcaaacacagcccagacatcacctccctacagaggcctttcctaaaccccaaagccctttaggttttcatgcactcttagagctgtgctgctttccttcactggcacttacctaagtttatgattaaatatgcattcgcatggttatttgaatatttatcacacccaatagcctttaacaaggatgtaacacataagctctaaaacactggtgcctggcagtgacatgtatgattcatttcaaaacagaaaggtagataatcaggcacaaggactgctacctggctcaccagcagcacaggacatttgaaatcagcattgcactaaaaaatgtccttgttatagtggccatccgcagagtgctgaatctttcccctgtgtcgtgacgcctcttttatatcataatttttaaatcttcaaccatcatcctctaaaatactattttttcagagttgttaagttccgtgggcgaataatttgcattcattttaagacaaatttgtttaggcgataaatgcattattatttttctctacctcacaatatgacatggattttcaattgaaaattctgcctgaaactgattggagttgggataaagttgtagacaatctatagtagttcatttggtcacagcgtgtttgctttacttttggatcttgagaagaaaggactgttatctgcagggcactctgggacaacttcttggtgataagagtgaagactcatatttgctttgtaaatcaataaaaaagagacctttcaggcaaaagtgttgatgactgaggaggacaagttgtgaattttatattggaatgtaatgttacctatgaaattttccacctattttaggattttcatattttcagatcaatcaaaatttgttgtgaacaaggtttctcctccgtgtcctacgaactacaaaaaaatgagtgcctgtgggtgttttcaaactgcctgtgggtagacagagctatgttactacctggaactctgtgaatgtctaaaagaaagtcaaaatatcaaaatcgaaaaggaacttattttctttgatatgtcttgttgtatgaccttggtaggaacaatgacaaaattttgacatgttcagatgtcttagaacaatgaaattagtatatattaaaatagcagtgctttgttgtccttttaaataatacatgcattttaaagtattcagaagctttttctactttgtataaataccttatcagtcctctaaaataatccaagcttaataggaaaaaaaatgaaggagctttgttgaggcttactgaatgtcacagagcctgcaaggttagaactgagcatagaaagtgaagaaatatgttcttgatgcctattcaactgggtttcctgttcaaggttatgcactctatttgctaatagttgtagtattctgtaccacaattgctgagattaatatcttgagaaaatattgtaccattccagttaataattatgttgatttctattcttcagtttaaagtagatatatgaaaataggacctagtgtgtgaccactcaaaaaccctattttcctcacgtttgtagtgtatttctaaaggcctctccaggattatttcaaaatcaaaattgaaatattgtctaccaagatattgaattaattatgtatctatttcattttactgtttgaacactcccttctaatttgtatatagagagatagaattgtctagcacttttccgaaggaaaaagaaatcaagaataatatttaaaggctcataatatcttccgtctacatgtattaattgtatatggactttaaacaaatacaattaaggatagtcttgttctgcatataattgatttgcctatgttgatgagatgctgacaaccaggtatgaaagctggttttgcttatctaaaagagtggactaaaagtaagttaagtggtttctttagtgttctgtagctttagttgtacatggagcacctgctcctcttggaagtcacagcactttaagtaagttcgccatggtctgctatgctgcgcagactaagctgtgcagactatgctgcccagactcctcttcctcctctttagactgtggcagtaacctaaaagacttggcctctgtttcaactctcatgccacacatcatcttttgtctttcctgtggttcaggtatttgtgtgtgagggttgaggtgggggtgcaccaaattcatacagatttcctcagtagctttattttctgaatttgaggcaacaggacagtgaaaaatggcgatcgttatattgattcatacaacacagagatctgaaggaagcattttgtacaaaccctgctctgggtaacacaggaaatgccaagattttgaaatgtaactttcttggtcttgaagaccaaattgtgctcagaaaaggcagagtccctataagttttgtcacaataaatgagtagagcccactgcaggttggaaatctacaaatcattgcagggtattattaagataataactgcacgagagccatcacagcagcagaggtaaggatctctgccaagattcaccttagaccggtgattctggaacttgagcaagcctagactcaccaggagggcttgattgctagagtaggagaattttccccgtcttacatataaccaggtgatactgaccacacttggagaatcactgccttaggcattaggatctgagactatatatccatggattgcagcaagaagcagacaaaaacatttcttcatacacaagaatgtttgtgacttagcaaggctgttattggagacctggccattttaggtagttttgtataatttgccttattccatccaatgttctaatttctaatgtttataggctgcaagcctagacgctactgttgtgaaacagttaaacacgttgggtgtggtgccgagctccttcctaggttatcaaatccaagctctgccatttattaattgtgtcattttgaggcaggtatttatattcttagggccatggtgtcttcatctgtagaataggaataatagcacctattgctagtattgctattaggattttcaaaataacacacataatgcattggagaaagtgcctggcaaattataagtatgtaataaaacttatctctctttttactccttatttcttattacagtggttttgtttttcatttcttttattttttggatagttaaaccttataaggatttaaaagtttcatgtgaccattcaaatatcccaatttatcatttaaacgtaaacaacaatggtgccagagtagtcatggggccctctccagcttcatcctacagaggagccccacctgggcaactgaaataagattataagctactagaagaataaagaggtcttatttcattatttaattaagccgctgaatagtttattcttcctaaagcaacatcacatataccaattaggttagatacccttattaactagccagggaaccttctctcttgaaaaacatcaacaagaagtttttgttgttatttttgtcattcttgtttggttcaagaaatataattaaataaatttattccagaaattttaaatttcagttaaaaatttttaatttgatgttatatcagagttatgaaaatcatggctaactataatatggcctgagaaaatccacttatttcaaaagggaataaacagactaaaaaacaataagaaaacaaaaagcagatgagtgtgaaaattacaagataaactcagaatacacctggtcaaagcaaacattacactgggcaaagttacataggcaagagaggctttattcaaaactattgtaacagaagagagaggctgtaactcagcctgagctcaactccactgaaacaaagggatgaagagtttttaagagctgggatgggagaatctgtgtaggccatttgtgcttgctaattggctttacccacagatgaagtaaattttctcctatcttcatgacaggaggtagttttacaacttagagcaaggctctttgaagttaggctcccacccacactcaggtgtagactgtatccctttaatgcttttatttcaaagtgatggctcctgggtgcttaaggaaaacattccagggttttaaaactgacaagaagctttaaaaaaaggtttacatctcaatcgggcaaagaaagagtttcaattacttgttttctaaagtaaatgctttaagaaagggaagttagggacctagagtcaggaggaagcctgtataaagtttagtccagctgagggaactgctaaggccatcttggtctcggtgaacacttggttttcacatagttttaatcacggaactagtatgtggcctggacacacttggaaagaagccaacaccagagggattgctgatatactgtgaatatctaattcctacatttatgataatgaggtggaatgaaataaagaggagacagtgtgaaattggaaagtatgtagtttgatgttacttgcaagtatactgtgaggcccaatttatgacactgggctgcatagagctttttctgaaagtccatctagctaaaccctgtcctttaaccatatgggccaaatgacttttgctttattttattttagggaattttctttatttgtaacattcctttcagctctttttagattctaatattccagaatgtcttttttccagtgtaggttcttggcatctttgtccaacatttcatagtaggtgtataaatttgtttttggtttctgaattctattccattgatctgtttgtccacttgaatgccagtaccaggccattttggttactatagctctgtagtataatttaaagtcaggtgattcctccaattttgttatcttgctcaggatagctctggctattctgggtatttttgtggttccatacaaatgttaagatatttttctatttctgtaaagaatgccattgatgttttgataagaattgcattgaatctgtagattgctttgggtagtatggacattttaacaatattgattcttccaatccataaaaattgaatactttccattttatggtgtcctattcaatttctttcgtgttttatacttttcattatagagatctttcatttccttaagattgatcattgttggcatatagaaatggtactaatttttaatgttgattttgtttcctgcaactttacataatttatcagttctaatagtttttttgtgtgcagtctttaggtttttccaaatataagatcatactatctgaaaacaaggataatttgacttcttccattccaatttgaatgccgtttatctctttcttttgtctgattgttttatctaggacttccattactacattaaataatagtggtgaaaatgagcaacttcgtcatgttacagatctcagaggaaaggctttcagtttttccccattcaatatgatgctagctgtgggtttgtcatatatggctttcattatgctgagatatgttccttctatccccagtttttgagagtttttatcataaaaggaatgctgaattgtatcagataatttttcagcatcagttgaaatgattatacggttttggccttcattctgttgatatgatgtatcacattgatttgcatatgttgaatcatccctgcatctcagggataaatcccccttagtcatggtgaattattttttttttggtttgctattattcaggatttttgcatcaatttttatgagtgatattggcctgtagttttatttttttcatgtgtctttgtctggttttggaatcagggtaatactggcatgatacagtgattttggaactatttctctcttcctctattttttagaatagtttgagtaggactgctactagttcttcattacatatttggtagaattcagcagtgaagccatcaagtcccgggctttttttactgggagactttttattatgcttcagtttcattacttgttactagtctgttcaggttttgaatttatttgtggttcaatctcagtaggttgtatgtgtctgggaatttgtccatttttttccctagatttttccaatttattgacatatagttgctcatagtagccactgataatcctttgaatttctgtggtattagttataatgtctcctttttcatcctgattttatttatttgcatcttctctctttttctgtagtctggctaaaagtttgccaattttgtttaacttttcaaaaaaccaactttttatttcattggtcttttgtattgttttcttcatttcaatcttatttatttctgctttgatttttaccattgattttctactactaatcttgtgtttggtttgttcctgcttttccagttctttaagatgcattgttaggttgtttatttgaagtttttcttattttttgatgtaggcacttatagctatgaactttcctcttagtactgcttttgtcatataccataggttttggtatgttgtgtttccatcatcatttgcttcagaaaaattccaattttcttaatttttttattgacccactggttattcaggagcatattgtttaaccatgcatttgtatagtttccaaaattgctcttgtcattaatttctagttttattccattgtggttagaaaagatgctggatattatttcaatttttttaatgttgtgagccttgttttgtgacctaacatatggtcaatccttgagaattattcatggtctgaaaaaaagaatgtacattctgtagccgttggatgaaatgttctgtaaatatttattagatccatttggtctatagtatatattaagtctgatgttcctttgttgattttctctctgaaagatctgtccaattctgaacgtggggtgttgaaatctccagctgttattgtactggggactacctctctctttagctctaataatatttgctttatatatctgggtgctccaatgttgggtgcatatatatttaaaattgttatatcctcttgctgaattgacccctttatcattatagaatgacctttgtttcttatagttttaatcttgaaatctatgttgtctggtataagaatcgtaactcctacttttgttttggtttccagtggcgtggaatatctttttccatcccttcattttcagtctacatgtgtctttataggtgaaatgtggcaacagatcattgggtcctcttttttcatccattcagccacttcttttcattggagagtttagtacatttatattcaatgttattattggtaagtaaagacttactcctgccattttgttctttcttttttgttgttgttttgtggtcttctcttccttgtttccttcctgtcttccttttagtgagggtgattttctctgattatataatttagtttcttgttttttattttctgtgtatctgttgtgtgtttttttacttctggttataatgagacttgcaaatactatcttatagcccattattttaagctgataacaacttaacatcatttgcataaacaagcaagcaaaaggaaaactaataaaagctctacaccctaatttcgtcccctggtttttaactatttgttgtttctatttatatcacactgtaccatatgtcttcaaaagtagttgtagttattatttttgattggtttatcatttagtctttctagttaagataaaagtagtttatacatcatggttaccatgttatattctatttttctgtgtacttactagtgagttttgtacctcttggtgatttcttattgctcattaacattcttttctttctgattgaagaactccctttagcatttcttgcaggacagatctggtattgatgaaatccctcagcttttgtttgtctgggaaaaatctttatttcttcttcacgttcgaaggatattttcaccagatataccattctagagtgaaggttttttcctttagcacttcaaatatgtcatacgactctcttctggcctgtaagttttccaataaaatgtctgctctcaaaggtattggagctccgttgcatgttatttgtttcttttctcttgctgcttttaggatcctttctttatccttgagcttttggagtttgattattaaaagccttgaagtagtcttctttaggttaaatctgcttgttgttcgataatcttcttgtacttggatattaatatctttctttaggcttggaaatttttcttttattgtgtctttgaataaaccctctacccctgtctatttctctaccttgtatttaaggccaataagtcttagatttgcccttttgaggctactttctagattctatatgcatgctttattctttttgttttcttttgtctcctccgtgtattttcaaacagcctgtttttaagctcattctttcttctgcttgatcaattcagctattaaaggactctgatgcattcttcagtatgtcagttgcatttttcagctccagaatttctgcttaactttttaattatctcaatcttgttgttaaatttatctgatagaattctgaattccttctctgtgttatcttgaatttctttgagtttcctcaaaacggctatttgtgaattatctgtctgaaaggtcacatatctctgtttctccagggttggttcctgattccttgtttagttcatttggtgaggtcatctttttctggattgtcttgatacctgtagatgttcatttgtgtctgggcattgaggaattaggtatttattgtagtttttgcagtattggcttgtttgtacccgtccttcttgggaaggctttccaggtatttgaaattacttgggtgctgtgatctaagctgttccttatttagggagcaccccagtaacactatggttcttgcagactcatacagattcatcttgatcgtcttaaagaagacctgggcgaattctctggattatcagatggacactcttgttctcttcccttactttcttccaaccaaatgtagtctctttctctctctctctctctctctctctctctctctctctccctccctccctccctccctccctccctccgtctctctctgttctgagccacgtggagctgggagtggaatgacgtaagcacccctatggcaaccaccactaggtggacctgaagccagcacagcactgggtcctacgcagcatctgttgtaatcactctctggctactgcctatgtttcctcaaggccctgggactcagcagggggcaaaaccatctaggactgtgtccttcacttcagggttgcaagttcccctaggccctgggtgggttcagatgtgctgtctgtgagccagggactagagtcaacaaacttaaatgtctactttgtcctcttttgtcctgcagctgagctggcactcaaaccacaagatacagtccttcccactcttctctcccctttccaaaggcaaaggagcctcagctcatggccactgccactacaggtcctcagtgaatacttccagcctaccaaaaatgttccattgaggtccaaggactcttaagtcagcttgtggtgaatgctgcctggtttgggactcatccttcagggaagtgggctcccctctgaccctggaaatgtttagaaatttcatccaggagccaagtgctggaattagggactccaagagcccattttgtgccctactctcctgtggctgagctggtacctaagatgcaagatgaaatcccctttgcttttccctctgcctttcttaagcagaagtctcaccccatagccatcatagctggaaaagtgctgagtctcacctgaagccagcaagtgtgaatctcacccaaggccctcagtgtagtaccaggtattgctgctggttatttgagcccaaggacacttcagttaccagggtgaataaatcctgtcaggactgggtcatttccttcgaatgagaaggttgctctctggcccagggtatgtctagaaatgttatcttgcaggtagggcctggaaagggggcctcatgactctgactgctgccctatcctgctatagaagagctgctatccaagaggcaaaacgaaatcttctccagtcttctgtctcctgtcctcaagcagagaaaaggggtctcttttggagcagttagttgtacagcctggaattaggggagaggtggtgcaagcactcctttagccaccctggatagcatctcaggaggttgtgtgccccaccctcacccccagtcagctgggtttgggcccagttcagcactaggacttaggagttgcggtcttcatggcctatactgcctttcaagattatttagggccgggcctcagggcactttagccagcagtagtgaggcttgtgggaactcaagcactgaccactgggatcagtgattcccctctggctaatgctggtttaaatggtccctccatgggtgggtgtcagcggagtttgatctggttttcctttctgctataacaggacaccactgagtccaatgactgaaattgctgcacgctgtctctctcctcagcacatggaaatgctctcctcacccatgctgccactgcctgcaggtggtggaggggtgtcgtcatggcaattagtggcaatagtcctgaataggcaagtaaggactatttttttttctccttctgagtgactctttcaataataggaagttaaaatccagcactgcgagtgttcatttggtttttggtccttaggaaagtgcttctctctgtagatagttgttaaatcggtgtcctagtagggggatgatcggtagaggcttcttgctctgccctctaatttgtaacatttttttagctctttttagattctagcattccagcatatggcaacattttaagcattaaatttctgtataggccttccagacatgggtaagtgtgtgtagagatatgtttgtgactttatgtttcctttaatatgcaatttcacatttaccaatcctaaaacattaaaaagagcataatccaaatacagtgttcaaataaacactgcagttatttgttagcaaagcaactggctgtgattctatttcaggaagattatctcctccaagacgtagaaatttgccagctacatttgtttgctactgattcctgagtttggtttgctttcattcttctttggatctcagtctcctatgcaccattcacattttctattcccagtaaaaaggtttttgtatggtcttggttttgttcctatcagtcacttaaaagaacagacacccaaaggcaagggcattaatcatctgtttgaaggtccctgggaaattattatttatatgttgatagtgaatctattttaccctttaaggggcaaaattgctagattaggaacatggttaggaaaacatagcagtcattaaccttatcgcttttccaacaaagaaaaactgtgtaacaactggccaaagcccgtggcaatttgagaacacaagagatcaacaaaatgaagcccaagatgagataaaacaagttgccagccttttggcataggtttaaaataattttctgtaaacacctatcctcaaaaatggaaatcagtgaaaatatttcataaaatggctagagaattctaaagcttacattatattctttagtattttatataagaaaaattttgtttgctttagaaatttcataacgtatttcttttagtctaattaaattttctttttttttttttttttactagcatcattccccttagtcactaagagtgaaattaaaaccactaaattttatttttttaggttgttggaattacaggttctctgaaggggttgctctgcatagattattgacaataaatatgttccaaaaaactccatgccaatgagatgagaggaattattgggcaagagccaaagaggaaccagggagatagcaagtgcaggaggaaagcacaggtatggaaagtgagtgaaagtaaaggatgatgtattagtccgttatcacactgctataaagaactacttgagactgggtaatttatgaagaggtttaattgactcacagttccacaggctgtacaggaagcatagctgggaggcctcaggaaacttataatcatggtggaagggtaaaagggaaacaagcacgtcttcacatggtggaaggagagagaaagagtgaagggggatgtgctacatgctttcaaacaaccagatctcttgagaactctatcaggggaacagcaagagaagaatccgcccccatgatccaatcacctcccaccacatccctcccccaactatgggattaaaattcaacatgagatttgggcaaggacacaaagtcaaaccatatcagatgactagccgaatgttaacctgatctgtcctctcagcagggacaggtgccctcctgctttatggatgatttaaagttattataacagatggtggtgcttcctttcatcttttactttggaattttagcattaatttaaaaaatatttcctatgaaacagtgagacaataatgctagaacattctagtggttcataaagagcctttacaggtaggattcacttggttagggcgccacattacagatttgatcccaaaattgtggatctagaaattttattttcacatggtattttatgtgggttagacatattagaataccctgcctcagtttccttgttggttgttgtggacaaaaataaatgtacttagcactgttttgaggataaaggtgttagaacactgcttgacacaaagtacttaacaaatgttagttgtcattcttagttttattaacattctcaacaggcatatgctgatttattagcttatgaaaaatacatttaagtgggtccagaattattttattctcctttcagaatactctgttcatgataccaaaataactgagaagctgcattagtctatctatgtttctttccttctttctctctttttcttctttctttctctttcttctttctttttggagacggggtcttgctctgtcactcaggctagagtgcagtggcatgaacatggctcagggtagccttgacttcgtgggctcaagtgatcatcctggctcagcctcctcattaattttaagatgattctactatggagaaaatttaaagagtgatcaaaggttctgagtggttgtaggagatgttttatttgggatctgaagactctgataaatcgcctaccaccctacacctgcataccatcacagaacagtccacaagatgtcagttgcacaaggatcagggcaagacacacttgctctttgtttctttcttttttttttttttttttaacctgtgagtctctgtatgtctctctcttgctgttgctctcactgtcggcctcctctctcctccccccacccctcactaacttttgagctatcatgttttgtttcctagattccaaggtggcactcttccttcctaacatcctttttaattccacttatgccattgcttatgttaaggtttcctgcaaatgaaatgaatcgaaatgaaataggatcaatttcttcttgcttttagctgggagagtccttaagtgtatcactgaaagtggttgctggtttgaaacaatatttttgggttatctggggccataagtaatgacatttgatttgtccacatcatcaataatggagttagtagtagactgaggttcaagaagttgaagacctgagacccatatccaagttttccactgtttacaaccacgactgcgagaggacctaactgttgtatcttccttacaattagaagagacacaacttttcccaagaacaccacctcaagagactgtttacattattgaattagactaagctttaacatacagtgagtattcagttaaattatttctcttcacatcagctggtagggacttatggtgagtacaaaatcagctatgggcaaagtttaaaatgttatattttctctggacattaattataatagaagatacatcttatgctttccacataaagaagtagcatgttaggttaaaagaattttagggtgtctgataagaaaatcaaggtcagtgtgactaaagaagagttaaagagaggactaggatggtttatggatgaagagatggcagaggctgcatttcacaaagccttgcagactatggtaatattttccattttattccaagtgcattagaatgccaagaaaaggcattaaagaaggaaagtagtacaatcagatttttattttttttaattactatgacttctatatgaagaagagattcagaagagacagattcagctgtgaactagataaggggcgcttatttcaaccatgatggagctagtagatgcacacaagtggacagatttcagaaagttttagagaatgcatgcgtaaatagcttccacctgcatgctcttgtgtacatgctctacatgtgaatatatagatctacttacatatacatatgtatgtttgtatatagatatgtatttgtttaggaacatacttagaaaagaagatagaaaaacacaccaaaatatttacagtgacttcaatatttaaggttatagtatttggggttatgtttacttgctggtttgttttgagatggagtctccctctgtcacccaggctggagtgcggtggcacaatcgtggctcactgcaacctccgcctcctgggttcaagcaattctcctgtctcagcctccccaagtagctaggactacaggcgcgcgccaccaagcccagctaattttttctgtaattttagtagagacgaggtttcaacatgttggccaggctggcctcaaactctggacctcacgtgatctgcctgccttgggctcccaaagtgctgggattacaggcatgagccactgcacccagcctatttggggtaatttttgctgccttctttacaatttttcttttcttaatattctacaatgaatatatgtaaataaatatatatagtatatatagtatatgtacacacttgtgttaatgaggcattatggaaattaaattataaatatggctagtatcaagaaagtcctaattcaagtttcattacaaaaattgtttcccactactcaaatatgataaagcacttttaacataaacaatttttataggcaaattattgtgttggaggccctctcaattggttcatgatcatgcatagctcctaaaatataagaaggtaacaatttataatacaatggatttcaatcgatgccctttgccattaaatcacactagaattcaatgacacaactgattaacaattaaattaatggtggtgaccttgcaaatgaaaagtgatatatagtatttatattttcctcatcttccctctgtttctgaaaatgtaaaaatattcttttaatgtttgtagtttttaatcttaaaaacacaatgttgaagaggaattatctggagagtgctagattagagtcaattaagatttccaaattaaatttttaaatttataactagagagatttttaaaatgttagcagtattttttccccagattatctatctgcataagattctagagaattctgagacattcttcttgctttagagttgggtgctacataaacattaatcagtgctaagtaaaaacaaaccaaatatgtgtgtgtgtgtatatatatatatatatatatgcacccccattgtttagtatcagtaaattttactagaaatactgaacaagtatatggcaagcaattgacaaaaatattggttcctgatctccttttaaatagtatctatgatgctaaataaaaagtgttctaataatagaggaaatattttcatattttaggtcatatacatatacacaacataatagggacggggagaggcatcatgaaataactcaaggtagtatactatctgaaaatttatacttatgaaaatttatgttataaaaataaagttaaattgcttttttaaaattgctttagggtttagctctctgtctacatagttggcaaccttgggtgacttattttattgtaatctattgttatgttaatttcccctattgctacttgtataatttttatatacataaggcctcaataaataaactctttgaataaaaaagaaccctaagcatctttttgcaaatagttctaaatcatgaaaacactaatattttataatgctctaagaagctaatgaaccagaaatatctttaaccaaaggcacttttcctttggttttcacaaagcagagaatcctaatggacaggcaagataaatcatttactgtgtaaaacactcatatacctattgaaagggtaaccacatcaaatgttctctggctatttaaattacctacaaaaagaaatcttagcaaagtgcaaaatgtgatagacatttgcagtctatctgtaactagcccaattccttcaaagagaaatgtgaacataaaatgcaaaagcatgactgaggagtcatttcatgcattccttgattcctcagaatggctacaagcaacgttctcatctagtgtggggcctcactatgcaaatctgccaaggttatccccgtgggcaacctacaaccaacgtgtctttgccttgggctcagtgagttgactataatggttatcctggcaagacggagctgatcctctctcagaagtagacgataagatattatccagctaaaagttaaaagtggaagacagcttacacttcaaggactggagaaatcaaattcagtaatgccatttctcagaggaagtctcagattaaggacatagacaataaagctttatataaggaaaatatttgtttaaggttgaaaaggctaagatataaacatccagtcagtttgatttaaggtggaaaaaaaagaatctaattcttagaatggagctagggatatcagtggaaactcttcttccctacacaagtgacttgacatgtttcttgtttttgattctaaagttgttttagaaattcagatgtgaaaatacaaacattctctgcttttttctcccttgtagctttgattcctcaatattcaatttgtcagccaatcacattaactctatgtccaattgatttcccatatgcctgctttattttctgtggttaccacttcgggacatccttctcacttcaatccccattcttctgtggtaggcaaaaatttgtaaatcccccaaccaagggtgtcctgtcctgatccccaaaacctgtatttatgacaagatatcactcccatgatcatgttatagtatatggcacaactgactttcagattatccaaatcagccgaatgtaatcacatcactctataaaagcaaagaacgtttttttcccactggtggaagaagagaaagtcatagagattagaaatatgagaagcactcaaatgccattcctgacttgaagttggagatatccatgtgagatgcaatatgaggagcctctaggagagaaagtggccctgtctggctcacattcagccaggaaacattatcctcatgctacagcaataaagaactgaatttttccagcaacctgaattaccttgcaagagagtttttccccagtgccttcaaatgagaacccaccctaaccaaccttgatttcagccttatgagaccctaagctgagaactcagccaagctcacatggactcctgacctatagaaactgtgacataataaatttgtgtggttttaagctgatgagtttgtggcaatttgttatacagcaatagcaaaagaagataccttcccacctagccatattcatcagatcagcctttataaatgactccattcatcttaacatttgactatgtaaaaatctacaagtcttctcaatgtttcagaccaaattcaaaacctttattttgactttaagatgccagtaaattaataagccaaagtttcttatcctaccaaaatttttactattcttgtataaagatgctcctctaatactttgttgcatttgttctcccatttgtcatgttataattttctatgtatttgtctgtcacctccattaaactggacattaattccttatattctcagtacctaggacatcacttggcatcagtagatctgtaatcccactcatggatgaaacaactccacattaaatccaggccagacccttactgttctttgaccaggccatgcagagctcctgcctctttgccttggctaatatgcttccctcagctggaatatctcatttcttccactatctaccaacgtgctgagggaagagtcaatataagacagtcaatatacgggtcctttgttgaggcaaaaaactactctggattaatgtctccttacatgattgcagaacacaactaaaaaatctgcatagaaacaagagcccactagtctggagccatagagtctccttgacactgaaaggatacagcccttcggggatatgtttgtcaatttcttaacaagtctatgaatttcttgagtaaaagaaccacattttctattttttggataccactaataatatctcgttggcatagaatatatgcttaaggaaccaaatttgcacttaagcttcacaaatttcagacaacatagcaactggtgtagttatcttactgctcactttgtcactatttctttaattcaaactccctccctgccttgacttaccaaactgaagctggatgggagaaacagtgggagtaataatacaactagggcccagagaaaactttctcaagatcacgtagctagaaacatactggacccaggattgaaacctgtggtttctgacgccacagctctgcccatcataactcccacaccttcttgcctatccccacccaactcccagtccctaacagtctaggataagaatcctttgtattcctacaaagaggttgctatgatttgaatgtttgtttcttccaaaaaaaaaaaaaaaactcacattgaaatttaattgccattgtaagaatattaaaaggtggaacctttaaaaagtgactgggtcattagagctccaccccgctgggtaggatatgtgctatgacacagggcaagtttggtgacctcttgccgtctcttgctcttccaccatctgcaaggggaagaggcaacaagaaggcccttgccagatgctggccccttgatcttgcacttctcagattccagagctgagagcctatacagttccatctattacaaattaccccgaatcaggtattctgttatagcagcagaaatggactaagatagtgtataattcatgggtagaaaaataatgaaatgacatgagtgttttgagataggctttcgactacaaatattagagacaaaccctaaaaaggattacatagaactatctttatatgaatacacatatcagacagatagacattcaaacttcctctgtccaagtcctatacatgccactccttagtattttcagattgcatcttagagaaatcattattttatatcaaaaagtagctggccttgacagagtataatcaggttcacagtttatggttctactgtgattaaaattagaactttgatgcttgttttatagatgagaaatgaccttcatataatgtacattgttagtaaatgatttctaaaaccacctagggcatttctttaaatctaattaaaagcacaatttcaaaacaagcagatcaaaatgtttcctataaatcagcctggtgtagtactaataaaaagtaataaggagaaaatattttaatatttacatatgaaaagaagttcatgctaaattttacaaaaggcagttgtacctgctaattggatgtgttactaaacataatttatgcaaagaattcaccttttggtgtaacctaatatatatatcagtcattacattacattgatattgctagattatggtggggatcaggtctccctagcttactgcctgatatgtaagtatgcaagaaatgttacagaatggagatagaaggtaaagaaagacaaacgtagagtaatgtggaaaggaaggggacagagtgaagggagaaaataaagaagacagacaaagaatataaaggaatgagaaactagaaaaaatagaatgggagggagggagaagaaagggagggagggggaaggaaaggaggaagggaagaagtagaaacagaaagggagaaaggaagaaaaaagagaaagggaaaaagagagaaagggaaagaaggaagatgtgagaaagtagaaaagggagagaaatggaaggcaggcatactccttgccctctttttccctttctcctgctggcaaagcctgctcctcagccagatgaaagatttgttgtcttaagcatgccatgttctgcaggtctcatagctgcctatttataccaacccttttcctcctggtaaacttctcctcattgttaaacattcaaacagtagtgcctcccctagtccaggtgcttcaggaagaatcagagacaccggccttcctgcttccctatgacttctgctgtctcagagagtcaagtgaagttaccattagatacttttctcattattgtgtacctgttgctgtagtgataggtggtctccccattacggtgtgatctccttgagtcaggaaatggtctcagcactttgtattcctagattcttgcacagggcttggttcacaggaattattcaataattctataaattatcacattcagttctcacaactaaccatgtgaattaggcgttatattctacatttcaaaagagaataaacctcaattcagattatttaagtgacttgtacagtaacactcgtgtaagtgagcctgaaaataattcttttgttttcactgatgagatctagaattgaaataataagttctaagaattaaagtacaacaaactcccatgacacaagtttatccaagtaacaaacctgcacttgtactccaaacttaaaagctaaaaaaaagaaaatgccaccaaaagttctttaatgtatttttaaatgataagtggaaataaggccaaattgtggctgtttcattgtgaatttttgagaattgtattcttcccacgtatctatatgagaaagggaaaatttgtgttaatttatgaaacagaaacctaagatgcgccatgttctcttatttgttatttataggaactggcttataaaactggggcaaaaataaaataaaaattctacaactgaaagcatttgcatttgttttagacatagagttttacatcaactaaagatttgtgaatttttggtgtgttctttcatatattaattcaataaatgtttcctgcccatatatgctaagtaagcactgactctctgtttaatcttactttagtttacacttgttaaaatattttcccatgccatacatttctagttcaaacatggaattaattttctttggtggctttttgttggttttccaatcttatattttgtttattttgcaataggacgtcgagtttaagtaaactatgtgttcagccaaggttatgcattcctcttgttttataaattgtcattattcatacaagactttgctcttttctactgtattatacagtattttgtgattttctttattttgtcttataattacagtttgggatatatattcagtatatcattttatatttgaccaaaatcacaaatctattaatattgctaagacagttttccaacagagctatgatttccgagtatttgccctataacttcaaggatacaataaaatttaacttaagggcttaaaatctaagcagaactggtgctgtttcatcaggcaatgcattgaatggtttataaactgaacatgaaaatgtctaaaagaaggcgtctcccagagcccattaaccttcaagacgccttagcctttctctttttttttttctgacatgagtaaagtgaacaggattttaataaaagtcctgcagcagatattcctgaaaggtcagggctcatgataaagctgccagcactgcaactttaagaaaagagatcccgacgacctttaataacactaggtctgccagtgctcattgtagaggatctgtattttaaaattccatttgagaaactgactcccccatttgacaggatcatggtctttaatcttacttttggtgtgtaagagctggcggtatgccccatggaaacttgcattttgtatgcttctgaggaccttgggaaataattttctctagtgatagaaatgcttccccgtcttcaactttgactttctgatcacccatttcattaatactaagtacaccatatctgaaagtagaaggaatttaatattgaagaagtagacttgattcaccaaagcttctatttcatttattttcattttcgttccttaatctctcttcagctttttatagattgaataactctgaaatcaggaattagtgatatacaacagtaatttccacatctatgttttcactagcagaacaaaggtacaattattactaaaaatatatttgttattataactccaatttaataaggggtaaacaaagactttaaaaacttcagtaagttgctcgagttaacataggtaataaataacaatgccagaatttactgttttcagatcactcagtttcaaaacctcatacaatttccattctctaagatgtacatctacatttctgtcttcatcatctcagtttaaattaaattaacaaataactctttggaagctagaataacattatgagtaaaaagtaaaatcttgatgtaaactattccagagaatagaaatagagggaaactttccccattctttttgtgaagtaatttcatcaatgaaaaatctggcaaagaatttaccaaaagaaagcaaaaacaaaaacaaaacaacaacaataacaacaactcagaccactctcaccagagtgccaatcgaaagtcttcaataaaataacactaaataaaattgaataccacattataaatgatatcacaccatcaagtgaagattcttctagcaagccaaggccgttcaacactaggaagtctaatagtataattcacatcataataatagagccaatgagtaaagcaatatcataatctccagagatgttgaaaaggcatcagacaaaattcaatactagtaatttaacaaaaacaaaaacattctgtaacataagaattgatgaattgatgactcctttgtaaacatgagagtgtacttgtatgtatgtatatgactatatttgtatatatagttttgtttatatcttcatcaaaagccatttatatctccatcaaaagcagtatttagccagcatcttccttaaaggacaaacactagagacctttccactagaacaagatggtgctacccactgtttttactgtgatttaatattatattggagatctatgacaaagaaagcaattagaggcctacaacttggggagacagagctagaactacctctgcttacagatgatattattagttacttgaaaactgaaaagtatcaatgaaacaactagtatatagaaagagagaatttaagaagatggcaagcataactttaacatacagaaatcactagcctacatgtaattacaaacagttttgaagatattatgaaggtgagcagaaaaccttttaaccttaattccaaataatagtttttcaattttttttctttcattggagaggtggggcaagtgtgatgtgtgcctagaacaatgagattttgtgactcagaagaaaggaaagaggaaacatctcagtagagaaccttgcatggggaagagggaaatttgttgctgtgaagcagtactttagaaaaattaatcacagaaaaaaatacaactagatactttagaaaaattaatcacaggaaaaaaaatacaatcaggatgcgatgagaacctgaaaaggtgaagcagcagtgttaatggaatggacgggataataggagacatttaaaaggatcaaccatattaatggctggaatcaaacatttgtagaaagaagtaaatcaattaaggcagggacagaatgttaaccaggaggtctgtataatcatttggtgataagtgtagaaacaccagtaaaaggagtgctatagaaattgtggtcaataactattccactaagagtttctactagttcacatctcttgatgaaaatcatttaaaagttacaaagtagtcaggccttcgatatgaattcaaaactaactggaccagtacttttcctttttttctgatattttcctttgttctcatatgtctattccaaaaagccaaatataaatgcctttcatttcactgtgtcatgctgagaaaggcaagatgaaaagggcgagaacaaagaaaaagaacagatgaaaaagtaatgttggaagttgtaaaggagttctctgggcttttttcccatcacttacaagttggaaggtgaaaattaaagctcaccagacatcaagaatgtcattttccttcgactcaatgtgcttccattttgggttctttgcagttgtaacgctcagccggaaattcttcttccgccatatcctacatcgctgatcacttggtcaaatgccacatcaccagaaaagcccatctcccactgttctgtatcccctgaaccttgctgtatttcccactgtagcgcttactgtatatttagttcataatttatctcctgtcgtgagactacaaagttcaagatatgagaggttttttttcctgtttttcttatattcccttcgctgttgcattctgagagcctgaaactgttatctgccatatgataggcatccacgagatattggttaaataaatgaatgaacaaattaatgaatgagcaagccctagaaacagtattctacaaagttcttacaattatattttattttgtaatcaagacaatttcaagaaagaaaaaacaattagagcattttccctttaaaaaatactaagcaatatctatgctacatagtttattttcaatgaatcaacaaaaaaaaaatctgatctttcttgaattcttgaagttgaccagttttttcaaaagggaggcagtgattagttttgggtggccacatctcctcctgcctgtttccagctctttctctttgtattagggtatttctccttttcattcagactcacatttgttaagcttcaaagcactccatggtttattatggatttttcactctaggaaagaggtcatcactttattaaacattaaataatggtgataatcaataataattgatatattgtctctattggtactatcagaaaaaacaaacataagcatttcaggttactatgtgcatcaagaattctaatgttttgaaaatctgcataatatatcaaatgtgctgtgatttatttatctacctgtttagtgttgaacagtaaattttattccattttttggtgttataaatagaaacgtggatctctcttggcacttgtccttatgtccaatttcatcccaaattcatgcaaaattaatcaaattgcaagctcttgatgcatagactcacaagcaaaagtctacttattgagatactgtgttgataacatgatataactttcatgttgcttctctctaacttatgaacttgttgtcctttcatcagtgaaaatgaaaatgaagaactatcacttaagaaagttctactacagatacaccagggctttgatatcagacttgacctgaagggctcctctagttatgagctgagggatgagaagcggacatgcaggaagatccccttggcatggcaacctttgcaaagcactgcctgatagtctccctcctgctgtgcccagtgtcaagagaatgagcttataatattttgtaaaatatgtagattgagaaatcggaatctcatttatcccagaaaacagatttcctagtatcaatatagcttaactttttcttgaaatgaaggtcattttacgaacataaatttttctccaaaatgaattcaaacagaattttaaaagtatggagctggcataaatattttgtgaactgaatataaacactttgacttcatttctcatatgtatttcacatgcatgaaatcaagagagaaagaaattccattggcattcagccaaggaaattgattttttttttaccactgtgccactatattatggtttattatctccagaatattactctaaatagtgctacccaacagaattttcagcagtgatggagatattctgtatctgcactgtccaatatggtagcctctagccacacatgattgttgaacacttaaaatatggctaatgcaactaactaaggaactacattttaattgtatttaattttagttaattttaattttggttttaatatttgcatttggttagtgggacagcccagccatcgggtaggtcattccatttctgcatttcttttatcctctctccacattctgcttgaaagctgagaaagctgccttgtacctccagttctatgatttcactctggatactgctagaaaagtagccctttacctatgacagaatggtggtttccagaatgtactaatccccaaacctatgaatatgtcacctgacatgacagcagagactttgcagatgtgactaaattaaggatcttgaggtttagagattatcttggaaatgtgggtgagctcaatatgatcacttttcagagggaggcagtaaggttagaaatgaagaggagatgaaaagactaccaggaccaaaacaggatagagaggaaagaagatgctacgttgctggcttgaatatagaggaaatgggccatgagccaaggaatgcagactgcctttcgaggttggaaaggcaaggaaacagtttctctccaacaagaacttccacatttgaaacttctggcctccagaattttaagacaataaaattgtgttgtggtaagccactaagtttgtggaaatttgttacagaaacagtcggaaactagcattctgtcctggaaaatcacttgttcccaggacactgatctgtgatgaaataggtaggtctgaaacaggaaaccaaacaccgcatgttctcattcataagtgggagttgaacgatgagaacacatggacacagggaggggaacatcacacaccagggcctgtcaggggatggtgggctaggggcggaatagcattaggagaaatacctaatgtagatgacaggttgatgggtgtagcaaaccaccatggcatgtgtatacctatgtaacaaacctgcactttctgcacgtgtatcccagaacttaaaaaaaaagaaagaagaggaaaaataggtctgcggtgctgctccacagagagcggccaggaccccatttcatctgccaaaagaaaatgtatacgcagactcgtattgctggagtccattatgccttttaagaactatgcctcttaaacagtacggtgcttgtgggtaaatcatccctgccatttttcctattcaaacatgttctggtatctactaacacaactgtattaggtgtgtaaaaggcatctcttccctgagtctaagcagaagtgctacctcgcccccctacctcccatcaaatctgtggctgcataaattgactttataaagaaatcctgctttgcttaaacagctttggaaagctgtttaatatatttggccgtaattggttttgttttaccatctggtttagacttccccctcagccaactttaattttgaagttaatcatttttaaattgggctttgaatgcacctaggtcagatttgccacatcagaggagagtttatgtttgcattattctcaaaaagattcttcagttttgctttgttttttgcagtttatttccctatgtgagtttcatttaaaggaaattggtgcctatactaatagctgagtattcacatgtgtggaagactttccttggcattaaccattagataccatctgatgcagctgtcagtgacattggatgtgcatggggctgtggaattgaatgttgaccatagtattctgcatctagttagggaagtcaagcagtaattttgatctttctacttagtcaattgtttggccgaatacattgacttatttgggagagtagaactttttttggtggagaagaagttgtgtcgtgatggtatattttgagttaacctcaatcatgacaaaccagaatgatttcctagatgcacagagaaggaaaatgttaaagactctcaattgctttttaatatataatatgcaatatggaaatctgtcacgacacttgaaaagaaaacatttataagtgaggcctgcttcacagtaatgacaaaaacaatagacactaacataaataaataaatacataacaaaatatttgccaataaactcaagtttagatttcagtaattaggtttggaaatgcatctttgctactgagacacaaacccctaaaaacaaacagttcattggttgtatgaaatgctgagaaaaaaaatggtttcaaaaaatgctaatgctgtaataatttgaagagaataaaagtaggatcaagatcctctaaccaggatcaaattattgcctatccatttttctgaagggcaatcagacgatttttatgtaagataataaatctgtagaagtgaactgtttgtaattaaacatggcacatcatttcatgaccatttataaagtcaagtgcttgttaacaaaaccgattttcattgttattactttctttaaaattattttcatgtgagatgaattcttttcttgaaagtagtccagctttgggggcattctgaaatttaattatcctgggcttgaaaaaaagctacgttttgacttaccatgttttttgtttgtttgtttctagtgaactgaagaataattgaataatgagtttatagtaacaattttataatatgcatatctatcatagaacaggaactacagtagaatcattggtgcagtcttgatttcttaacttaaaactaaaattagggattgagtgcctcattcgaaaatagcagcatttaagtgaatgtagagttaacttataagaatgtgaacaatacaatatctttccaatatttaatgttatcatttgtcatatataaaaataattaaaacatctctttcctctcccagttttactttcaaagtttcagcaatagtcgattccctgcatacacaatttaccatgctgctaaaagcctttatacctaattttgcccacactgctctcgtgacccagagttccttttcatattcttaaccctcatccaccctgcaaactcagctcaagcaccacatctaaagagattccagaaggacaagcctccccatcaccaccatagatagcatcatatatatagcaaccctgtatgccccacagtatcctgcccatgcgtctacgaaaacacttcctgcattgcacggaatttgccaaatttgcttagagtccccagtgcttcatacagtgcatgaaacataataggcagccaataaatacccttttcatttataaacaagaatgtaaagtactgcttacttctcactagtggtttcttcaatagaccttaaagataccttctctagaaagcatttcattttccagcccctattaacgttagccaatttacttatacagtcaatttcatgttttgatttgaatgtatgttctcaaatggagccctaaagatatcagtacatttaattccatataaaaacaaataaaacagtgtttagcaattgacgttgggacataaacagatgaaaaaggcagttgtcatataccatagtaaccagaacttccataaacgagttaagacctttaaacgagaatacatttgaaatgatttatttctataaagtcttgcttagttgagtattcacataaatagtgacaatattgtgtaatcaatgggattttttgtttgtttgtttgttggtttttttgagatggagtcttgctctgtcacccaggctggagtgcagtggcgcaatcttggctcactgcaagctccgcctcccgggttcacgtgggatactatattctaacaagtgtatcgagaagtaacagttatgaacacacttgttttgaatgtgctgtaaataacaaaatggtaaaactgttttatttgaattaacacattattaaatgggttatgttccatctttactaaaacaaagcatgagattatgatgaaagagtaagcgtgtaagtcaccagttctatctcccactacttgttgacatttatgagatgagatttgtgccctgggtcctctatcattttttaacagaaaaagaaacaagtgtgaagaaggctagaaggcaaggattaaggatattaatcttagaattgtatggcaatagcaagctgtgagacctttggaaagctgtttaatatatttggccataattaagtgcatctctgaaggaactattaaaaacagatgctttaaaaaaatgttacaaccttgaacttttttgattctttttgggcttgaacatctaaaatagatgaggagaagttccttaaactgttttcttcaactcagtcattaaaacacatttattgagcttctactatatctcacgtgcagacccaggtcttatagcaataaccctcccccagaaatttagaatctaattggagagagagtaaaatagagataaaacaaaaccctgtgtcatgtacctattaatccaatatctcttggccttctgaaggatcagaaaacttaactccctgccttctttcaaacatgttcaaatcctccaactccagtaacatagatctcttttcttcactttttggcaaaatcaacagcctttttgcaaaccgtatctgtcacaaatggcctctcacagagagatttctagctagctcaatttacaacaaacattgccttccaaacggaatagcaggttttccaggaaattaggtaaaatagcaaggaccataacaaaacagtagtaattgtttaaatagtttaccacaatatttattttggatcagctacaaaagtaatgtcagaaacttcatttcagtttcttcagtctacaaatactaaaaatctgcataaacacagtatacctatttggccccactactaaaaaaaaaaaaaaaaaaaaaagagctagagccagacattagagagaatgtgtctggccaaaagacatcccaattgtttaaagacaatacatatgtgtgtgcttgtttgtttattggtgaataagaattatttaagtatatattgtgtgctttccaaggatctctgattggcagctatgattctccactgtaacttatgacaattctgtggcattaaaaagtactagggcagggtgtggtggctcacacttgtaattccagcactttgagaggctgaggctggtggatcactaggtcaggagatcaagaccatccaggctaacatggtgaaaccctgtctctactaaaaatacaaaaaattagctgggcctggtgacgcatgcctgtattcccagctacacgggaggctgaggcaggagaattgcttgaacccgggaggtggaggttacagtgggccaagatcgcgccactgcactccagcctgggtgacagagtgagactccatctaaaaaaaaaaaaaaaaaaaaaaaaagtgcgtgtttgtgcccaagtcctgactgtgtcacaaatgtgctatgtgaccttgagcactcttaatatcatggaattgccacaatttttagtttcttcatctgtaaaataaaggcattaaataaggagttctgtaatttttctagctctaaattttaccactccatttcagtggtttgaattttctttgaacccaggagaagtgaacagatgtggattttacaatttaaaaatttaaagcaacagaaaagcatacacacatgcatcatgacaatttcatagcagtgtgattttaacaggctgttaccttaaggtctgaaacaaaaataaaaagatcttcaaccatattcataggagtgaatataacattagatgtctaagactgtgtaaacaatcttcatggccaagaggctcaattataatgattctctcctgatatgtatttcatttgatgtgatacatatacaccatgaaaaactatgcagccataaaaagagtaaaatcatgtcctttgcagcaacatggatgcagctggaaggtattatcctaagtgaattcatgcagaaacagaaaaatatcacgttctcatttataattggaatctaaacagtgggtatacgtggacacaaagatagaaagagtagacactggggactccaagagtgggaggaggggcagagagacaagaggacatggttgaaaaactacctacggaaaactttatttattatttgggtgatgggttcaatagaagctcaaacctcagcattacacaatatacccatgtaacaatcttcacatgcataacttgaatctaaaattttgcttaaaaaggaaaaaatgtatatttcatttgagatttcccatcatctacagctcttataaattgcagtgatgtcagtggtctttgctgaagattttatgcgcataaattgtgttctcatagggagatttgacttcatatcttggctactgacatagaaacattttttatattatgcgcataaattgtgttctcatagggagatttgacttcatatcttggctactgacatagaaacattttttatatgtctaaatggcaaattgctcaatttaagcataaatcaacaaatgtatcaccaatatttcagcagacgctaattctttttcccgtatcatttaaaaagttattagatccgctggcttgatggggtcaattccagtttttaaaatcttggtccacgtgtctatgtgtctttggacagttctaggcatccagtgccccaaagtcatgggagacttaattcagcaaatcatatgctaattgaatgtcttccctggtgcagttcttccctggttactatttttacctttcctttttaagagttggggcaaaccttatggtatcttctgaatacaagtcaatattcaatggacgttttaaataagttaattgtatctaatgtgtgtgtagctcaatgtaaacattgccatatttatatctactataggagccaagggccctctcaaagctcactgaaaaatcaacttgcaaaaagcatattggagaaaaagcatacaaatgtatttaatgcatatacatgggagcctgtagaataaaggccaaagatacagaggaaattgtccatttttaatgtctacgttcaaccaagtgtggacagccatctagaaacatgattgaaggaaaaaagggcctgatctaatgctaatagatttagtggggaaacccaacaaggcctaagttcttcttggcctctctctacagcattccttctttcagggtatggaaggaccctctctggaatggaggttttatgacctacagtcaaacaatatacaatatatcaattgtatattgataatttcttatggccagtttttacacagaatggtggagggaaaattagagtgatgtttttaggttttatggctggctttggggaaaaggggttctggtttctatgacccactttggggaagagggattctagtttttatgactaaccttgggggataataggatctagacacaggagagcaggaaaagtacagagaaaatcttttgcttctgagactgccactgaggccttcatttgggatattgttttctgatccccaacatctgagcatcctagaaaataaaaatttatgcagtggctcattcctgtaatcccagcactttgggaggccaaggtgggctgatcgcctgaggtcgggagtttgagaccagcctggccaacatggtgatacccccgtctctactaaaaatacaaaaattagctgggcatggtggcgggtgcctgtaatcccagctactggggaggctgaggcaggagaatcacttgaaccccaggaggcagaggttgcagtgagccaagatcatgccattgctctccagcctgggtgacaagagtgaaactccatctcaaaaataataataataataatttactaattacacacttctgccttgggagaatatcttttatttaagttaatgtatcttatataggcttttagaagccatttgtgtctccttatttttcagaatactgattgcagcatgtttgatactttttaagcaaaatcacactgaaaataagacatttcaactgttcttcattagtgaatatttgggagagcagaatgcaatgatgcttatctaaggggatgtttcagtttgatttcagggctgtaaaaaatggtgaagccattaaaagagacatcccacttcaaatgatatagttatatttgtaaattgtcctattttgttaaacttaaaacagttctatatttaagtaactgtaactacttgtaggcattcggaagaataaaccttaaaataatttattgctttcatggtgattttattgaaaacgtcacttcctttaaatcatttcatcaattattctcataagaaaatacaatgtcagtgaaataaacagaaaatcaaataccacatgaactcacttataagttagagctaaatgacgggtacacatggacactcagagtgaaataatagatactagagcctccaaaatgttgcggggaggaagtattgaaaggtcacctgttgcgtacaatgctcaccatttgggcgacggatacattaaaagctcagacttcaccatatatggatgtgagacatctgcacttatacccactaaatacaaataagtaaatgactgacacgatattatattatccaataacaattactcatactagtaatttctttaagaaagaacagctgtggctgggcattgtggctacacctgttacccaatactctgggaggccaaggtgggagaattgctttaggccagaagtttgacaccagcctgggaaacatagtaagaatgtgtctctaaaaaaaattttaaaaatcagccaggcatggtgatgcatgcctgtagtcctagcttctcaggaggctgaagagggaggattgcttgagcccaggtgtttgaggttacagtatgctatgatcacagcactgcactccagcctgagcaacagaactcacatctgtaatcccagaactgtgggaggccaaggcgggaggatttcttgaggccaggagttcaaggccagcctgggcaacatagagaccccatctctacaaaaaaaaaatttaaaaatataattagttgggtgtagtggcacgtgcctatagtttcagctatataagaggctgaggcaggattgcttgaccctaggagtgtaaggcttcagtgagctatgattgaaccactacagtccagtctgagaaagaccctgtctcaaaaaaaagaaaacaaaatagaatacttacaaatttatggtgttttcattcttgtatagctttggtattcttgtatacttttgatattacttgtatattgattaacttgtgaaaatatatctttgcttaactattgggtttctccaagtttggtcttgcttttctaagtgttgtatctatatataaagccttcagtaattttgcaggtaacgggacttatgttaaatattgtcttttcttcatctataaatgaaatagcattctgatagatgagattatgtaaatcctttagtcagacgattagacttactgcataattatattttagacatgagatcatatagtagcctcaaattgtatgacagatttgagagaaaagggataaataatctaaaactcacttgaaagtcagcagcctgagacattctctgtttctgtgtacaaatatgttagaaaaatggttctgaaacactttgacattcctcactacttaaagattatgtaagaaagtagcaggatggaaactgccttattattttcttttttcttcttcttcttcttcttttttttttttccccccagacagagtgtcactctttcacccaggctggaatgcagtgacacaatctgagctcactgcaacctccgcctcctgggttcaagccattcgcaagcctcagcttcccaagtgcgccatcacgccaggctgatttttgtatttttagtagagatggggtttcaccatgttggacagattggtcttgaactcccaggctcaagtgatccacccacctcagcctcccaaagtgctggggttacaggcatgagctgccgtgacagccaaaaactgccctattttcacagtgaatacacaaaagagctataaaattaaaacatgaagctcctttgcagtaatcattaatggagcacaaaaccctcaagccagcctatgaaatgccagttcaattccgtgtccgttctgtaattcaggaaaaactctacaaaagtatcttacaaaggaagtattctgctttactaaatctttcctttaatgaaatactgatctgaaaacccctaattgaagtaggatgaaattcattcaaaaaatatcaagcatgtgccaggcactgtatgccagtgaacaaagatgcatgccttcactgcattttagcagagggagtaaaacaaagaaacggcagggcagagcaccaggatgtcaggctgcaattttttttttttttttttttttttttctgtgagacaaagtctcgctctgccgcccaggctggagtgcagtggcgcgatctcggctcactgcaagctccgcctcccgggttcaagcgattctcctgcctcagcctcccgagtagctgggactacaggcgcccgccaccacgcctggctaattttttgtgtttttagtggagacggggtttcatcgtgttagccaggatgatctcgatctcctgacctcgtgatccgccctcctcggcctcccaaagtgctgggattacaggcgtgagccactgagcccggcccaggctgcaattttaaacagagcgattagagcaggcctcattgggatggcatttgtgcacaaagtcaaaagtgatgaaaaaattatccatgaagttttgtgggagaaaagcattctaggcagacactagcagtcacaaagatcccatggccagctacactggaagaatagcaaagatggccgttgtggacaaggcagagtgagcaggaggaattcaataggaattgaatgaggtggggtggagtgcatgtaatttagggctccatagaccattgtaagctttcttttactcaggtaggaagccatctaaacaagacttagacttttaaaggatcagcctggttgctatgagagtagaataggttgggtgagaagagacacagatgaggcaaaataaacaccagccgggaaaccacagaaataatccaagcatgctatgatagtgtcttggatgagaataatagcagtagagatggtagctatggtagtgtcttggattagggtaatagcagtagagatggtagctatgatcgtgtcttggattagggtaatagcagtagagatggtagctatgatagtgtcttggatgagagtaatagcagtagagatggtagctacaatagcgtcttggattatggtaatagcagtagagatggtagctatgatagcgtcttggattagggtaatagcagtagagatggtagctatgatagtgtcttggattagggtaacagcagtagagatggtagctatgatagtgtcttggattggggtaatagcagtagagatggtaagattttaggtaagattagatgaaggatgtgaggagtccaagatcatttctgcctgaaaagccagaagaatggagtggccattaagtgattgaggacgactgagaagaaaaatttcagaggcaaaaatatgctttatttatttattttgaggtgtctagtagatacctaactgcagatgaggtggggtggagggcaggtaatttagaggttaatataatctgatgtccttataatgagatgagatcaccaagatgagtactaagagaggaggcaagcagcccaaggtcgagctcgggggcacaccgatgttttatcaaaattcagggaaatgaagattgagccggcagcaaaagacagactgagaaggagcagccagtaaaggagaaatgtcaagcaagtgtagaaatttgcaagccaactgaagagtgcttcaaggttaaatgctggctgctgattagatttaacaatgtggaaatctttggtgagttttactaggagtagaggagtggagacaaagcctaatcacctgtcagatgacctaaccaagtgtccaaacttaacagcctgaaaaagccataactgtatgatgcaatatggagaccatagcatcaccttgcactcttgcatacaaagtttaacctgaaacttaaaaaatttagacctttcagtttacaggaagttcaaagggatattagaagttaaattaatgacactacaaaggaaaactctacaagacaacaggcctagtatttccagaaagtgagaatcttaaatgaatcctgtttgggggatgagggtagctatttacaaaagagacacatggaaaaatctgaaataagaacttgatgttaaattagggaagtattttaagtggggcagtggtattgagaatattatatagaatcatgttcttagcagatgtatgtttaagtattgtcgtgtctacgactttccttgaaatatttcatgtaaagcaaatatgccaaaatattttaaaaaaagaaaagtggttctgacagccatttccaactattcaaactaattgatattcacttactcagaacttcttcaaccattacttcttgagaacctactcaatgccagacagtattctaggcaagggataaagtgtgttgaggaaacagacatgttccctactctcatggaaattacaggtcagtgaataagactgacaatgaacccgagaggtatagaactaaaaagtttgataaattaaagagaacaacaaatggtaatgtagatgaaggtggtgactacctcagattgggaagacagaggagaaacgtttgggaaattgcatttaagggaagaaccaaaaaatacagatctttttgtaaagattgaggaaaagagtgtatttgaaaaaaagaagcatgtgtgcaaaggcagcctcacacttttctgctcagtgttcagttgacacctgcccttgttttgcttcttcgtgggttatgctatagaagaggagcatgaggcagcagtggagaagcaggtagcagatcatgcaaaaacatacaagagctcatttcttcctaaatgaaaggagaatccattgaagtttttctttttttccttttttttttttttttttttttttttgagactgagtctcactcagttgcccaggctggagtgcagtggcatgatctcggctcactgcaacctttgcctcccaggttcatgcgattctcctgcgtaagcctcctgtgtagctgggattacaggcatgccccaccacgcctggctaatttttgtatttttagtagagatggggtttcacaacattggccaggctggtctcaaactcctgacttcaagtgattcaccgacctccacctcccaaagttctgggattacaggcgtgagccaccacactcagcccaacaacgatttttaaagtagcgtgacatgtgaaagatcagtctgccattttattgagaatgaattaaagcaaggcaagatttggaaggggcagtctagtcaagaagctgcaaaatggggtgggtggggttaggaggttgaactggagtggcagagacacagaaaagtggacagattggagccagtttccaaacttctgtttacaaagctttgttaatgattgatgcagaagtgaaaggaatgtgaagaatgacttctggtttcatggtgccatgaactgtgatgagggtgagcagaggagtagcaaaattagagaataacatccaaagatatgtttgatcatattcacccagcaatgcctctgatacctctaagtgattatatcaagaagcaggtggagtgtccaagtttcaggctctcaaagtctcaactagagatacaagtttagagccttcttagagaaagctaagggctgagccctaaggatgccagaactcagagttgaggcagttaaggaggggccaggaagaaacagggatcaactcagggcaataatgtgagttcaaatacgttcatagactgagaaaacggaggttgtgaatgcctgtgagaaaaggagcttttgtggacagatgagagtggatttcaggttggagttgactgaagtgttaagagcttgcttcagtgaatctttcaaggagtttgtctatgaaagggattagggaaattaggaactggagagggttatggggccgaaagggagagttttgtcatttgttttaggtaacattaatgaccacatattgagagaagtaatgcagaagaaaagttgataattctggaaaagtgtaagttgaatgggttgacaaagccagaggagataggacacagagctcatgcccacagagacgctcctttcaaatagcggcagcaccgggagagtttcctctgttctggttgtgtaattgtgtcgagggtccaattaccttcctgaatttttttttaatgtaagtaatttgttttaattgacaagataatgaatacctttggtttaatttatttttaataatacgaaagggaatatggtcaaatataagttttccctgcacctcaggtcctctccaaggaaaccactgtaacagcatccagtgtcttcctttcagaaatattctattcacagataagaatatttatgcctatgtagatagatagatatggatataggtgattctacatttctgtggtatcagtcacattctgaagaggacagaactgatccacttaaattcgggtgcggtggttcacacctgtaatcccagcactttgggaggccaaggcgggcagatcacctgaggtcaggagtttgagaccagcctgacaaacatggagaaaccctgtctctactaaaaattcaaaatcagccgggcgtggtggcacatgcctgtaatcccagctactagggaggctgaggcaggagaattacttgaaccttggaggcggaggttgtggtgagccgagatcgcaccactgcactgcagcctgggagacaagtacgaaactccgtctctaaaaaaaaataaataaaaataaaaaataaaaaataaagttttgtttttacaaatggttgaattacaagggataaagggacctacacagataatgcaggaatccagggctggcagctatagagctcacaccaccctgggcccaaggatatgatggggttgcagagattagagagctcagatgtgtttgagaactgaaatgagccacagttttttaaaaagtgtgacattcttggccgggcacggtggctcacgcctgtaatcccaacactttgggaggccaaggtgggcagatcacctgaggtcaaggagttcaagaccagcctggccaacatggtgaaaccccgtctctacttaaaatataaaaattagttgggcatctgtaatcccagctactcaggaggctgaggcaggagaactgcttgaacccaggaggtggaggttgcagtgagctgagatcgcaccattgcactccagcctggggaacaagagtgagattttgtctgaaaaaaaaaacaagaaaaacaagtgacattcttgtgacaaccaaaaacactgaaaataaaaacaaatcattataatatagtgtagcacagagcagacaagagaagtgactttcttactgaaggctgactgaggcagtctcacaagaaagaaccaggaaaatgcataacctgacctaaatcttctccccactctaatctgctgatagggtaagctcaatcaaggagaagtttaggatctctcagtgtactctgccttatggagctgagggcagggaggggaaagctgaagagtgattcttggaggggaaaatggagatttctgaccttcatgcatcaccacaatcaattcactattcacacaacagctagaacaatcgtcatttaaaacaaatggaagcatattataaacgctgttctgtccctcttgctttcttcccctggcaatatatttttgagattgtgtcttatcagtacacatagatctgcgttgtctttttaatggctgtcaggggttacattgtacagactcccttaatttattactaagtttctaaccaataaatatttttccctagattttttggctgacacaaacaatgatgcaataaacatttttaaatatgatttggggaaagtacactagtgcgtgtataagataaattcttagacatgaaatgactaggtctcaatatatgcacatttgaaattaatagactttatcaaattgttctccagtgtgcactctgatcaaaagtgcatgagaaggcttttcccattaaatatcagagagatgttcaatgaatctcattgaaatttaatttgggctgctttgattatgaatgatgttgaacattttctatatgtttaaaagttatgtgtttttttttctgtgaactgccctgttcaaaccctttactcatatttcaattatattgtttcttattagttcctgagtattcttcataggataaagaaaatggtcctttgtctaccatattaaaatatgcttaccaatttgtctttgtatttggctatgtttggtcactcaagatttaaaaaaaaaatatgtagtcaaatttattaatggttcctggatttgtgtcttcattagaaaggccctctatattagttgtttataaaaagtattccaccataccttattatgttttattgccacatacgtttaaatctttcatctatctggaatttattttggcaaaggaagaaggaggtctcactctttttctcacatgatagctgattgtcttacatcatttactaagtaaagcactttctccactgacttaacactgttaacctaatttgtataagtctttgtatttatttctggatttttaattctattctattgatctatctatattttaatacaccaatattagtttatatttactgtgggtctagtaaatattttatctactatcgataatcttacctgttaagctttaatttcagaatataatatccccgcctctgtttatttttattttttatttttatttatttatttatttattttgagacggagtctcgctctgtcacccaggctggagtgcagtggcacgatctcggctcactgcaatctcctcctcctgggttcacaccattctcctgcctcagcctcccgagtagctgggactacaggcgcccgccaccatgcccagctacttttttgtatttttagtagagatggggtttcaccgtgttaaccaggatggtctcaatctgctgacctcatgatccgcccacctcagcctcccaaagtgctgggattacaggtgtgagccaccgcgcccacctctgtttattttttatatcaattttagatttcatcatgactttttaagtttcccgttagtagtgtttgtggttatattctcccaacatctaggtaccttggatgtctttctcgcttcctctctctatctctcatcttccttctacctacatctcactatatactctctctcctagttcatggctacccataaacttttcctagtctgcccctgcagtgtgtaatcaaagatacaccaggttggtcaggcgcggtggctcacgcctgtaatcccagcactttgggaggccaaggctggtggatcacttgaagtcaggagttcgagaccagcctggccaacatggcaaaaatctgttttctactaaaaatacaaaaattagccaggtgtggtggcaggcacctgtaatcccagctactcaggaggctgagacaggagaatcacttgaacctaggaggcggaggttgcggtgagctgagatcatcccactgctctccggcctgggtgacagagcgagactctgtcatttaaaaaaaaaaaaaaaaaaaagatacagcaggttgtggtgaaataaaatgtatctatggacgtgaagcagataactcaaacttgatacttaaaacaagtatgttacatattcctgtgcatttcagaaaatttactttggggcacaatatttcttgtatctttttgttatcgtcatcttttttcctccagtaaaagagatgagatggaaataaggctaaatatttttttggggagaaatatagtttacaattattctaaatttaacccattttgagaaaacaaattatgaatttaaatttaaaatttacttttttaagagtttctatcaaaacctatcaggtttgaaacttccttgttatataagaaaaagtataacctcaaactgaaaatgccactgattatcactggtttctacacacagaatatctgaggcatcttaattaatttacctccaagtaatcaattaataatgtaacccctttaatccttttgggtttcttgtggtctcattctactccaggtttttaagattttctacttggagcattaaaatagctgttgagtttattttgcctttagtttttccctttcctgtctatcctgcacctattactaccttaatattttaaatatgtagttatcaagtaagttcatttttgaagactttcagtgctttccatgcctagtaaaaaatgttctaaatgccaaagctagttaaaaccattcaattaggggtgaagagaatatatctccgtggtgcatctcttgatggctggctttattttgcctctggataaagttcaaaaatcccttgaacagtgaatggactgtatatcatcacacaatctcccagaaatattgtttcctgctatttaacttcttgataagaaaccataatcaaatggcagagtttacaccgtaggtactcaataaatataagtcgaatgaacaaacaaagctacattctccaagaaaatccctaatgtaataattaatacattttgcaatctgaacccaacctatggttgtacatttaacatctatcagttcagttttttcagctgcatataacgcaacacataaatgacttaaataatagcagccaccaaatgtattatgtcataataagaaggcaagatataggtccacatcaaagtagaggaactgcagtcctattttagttaggatatgtatatttgttgtttttttctttttctttctttctttttttttgggtggtgggggagggagtttcgctctgttgcccaggctggggttcaatgacatgatctcggctcactgcaacctctgcctcccgggttcaagtgattctcctgcctcaccctcccaagtagctgggactacaggcacccaccaccacagccagctaatttttgtatttttattagagacgaggtttcaccatgttggtcaggctggtcttgaactcctgacctcaggtgatccatctgcctcggcctcccaaagtgctgtgattacaggtgtgagccacagtgcctggcctatttgttgttataataaagacccaaaataacagtggcttaaaacatccagaattatatttctctgtcatgaaaacctttgggtaggtggcccggggctagtatgctacccaaagctcagattacttagatattttcctttcattcactgaatgaaagttctcactatcacaggttcatttctggaagaagattgggaaggacaaaaaaggagaaatagttcatatccttcccctttaggagcttcatccagacattgcacatggcacttccattgccttcaacttagccacagggccatgtaacttaaagaaagcctggaaaatattgtctgtaactggtggggttctatgtcaagacataaattctattgctatagaagaggactgtaaattttgcataacaatgtgcaacagcttaatgactttgttaggatgcctgactctttccttcttgatccttggagactgaaatagtatccccttctaaaaggcacaggccacgtgaaggaggctagatacttgagcaagagcagggtgacgacaggaagaaaggggaaagggctgtggcatgggcatccacaactgtctgctgtgatcctcattcctgtgtgcagactttcttctctagctaaactcactgatttattacttcacaaccacattctgtgcttaactaaacatgcaggcccttgtcttccctccacgtagaaggggattcctcctccttccaggctactcaagtctaaactttctttcaaagatttgttattccataaaacttccatacacgcataaaacaatggcctatgatcttcattctgtaccagtttttctaatatctggcatatgtatatagaactcatttgctaattatgtttgcatgaataaagacaatttctttagaatgaaactttctttattctttgtttctcagagtttgttttagagtgtcttatgtggaacaggcgactgactgatttgaaagaacttagggttgtttatttaggtttaatacagttcaacctggagacagatgaatagacagatggttttgcaggttcttttcctgtgggccagcaatctttcaaaagacattttatttacaaaacagtgagaaatatattgtaaaagtataactctaagtaaattagcaaaatgagataaagtgaactctagttcattataataaaaaagatttaaaaggcagaaaacccaagttaagttgcttatctcatcatagcaaaattaatgattaatagatgtagaccaaatatgcttgctttttttttaatgaaaagtttgggcataatgtcagaggtacagtaaatatcttagcatttaaacatttctataaataaatgcttgttgaaggagctccatcaatattacaatagtgtttctagttttaccactataatgttatgtaataacaacattttaaattagttactggaattgtgattatttttctaaataatttctatttgaataaaataaatagaaggcaggataaaataaatagaagacactccatagagaatatcctttcaactgaaatcaaaatctagttagtatagaaataaaagtactcaaatattgttgagatcaacatagaaggtaatgcagaagaaaatactatgattatggaaacagctctgagagtcacgagtatgaaaaacagtattcaaggaagcaagaattctaaatatatttcttgtcttaataagcaaaaataaaatttcatgctgagatgaagggaacaactcataaattaaggaggcaatttatactggaataataacttataaattgttttaaataatgggccaatcatttacaaaaataagctatcagtaacctagaagcagtcttttctaaagtttagaacaaggcatatttaatgtccaggtgtaaagttggcattagtctaaaagcaaattaaatatcctagcactgttatatgtatgtggtctaagcatggggaaagtcttagctgaccctgagattgagaatgctgaacttgattttatgaagaagtgaaactgcctttatagtcagtgatcactttctatgaattatatgaagtctacagtcaggtgcagaaatgatttaacttgctaaatgagattacaaagattattatatgtcactctgagtagatcagattaaaacatggcaggaggacctatggaaaagcagtcttaggagaaatgactgaacagatcgtgttagccctggctgcaggctgtcttctctccttgtgctcccttcctgggctgtttctcctcctactcagcaactgcattctcctttgagcccccgctgcagagaagtgcgatgcgctagagccttgctattccaaccgtggttctctgcccgaccacatgagcatcacctgggaccttgttaggatctcagaatcccagactccaatcctgaccgcaagaatcagaatctttaagattttcaagagattcctatgcacacaaaggtttgagaaacactacttttgagtgccaaggattcggtttatacagaacagcagttattctgatacacacggcactgttcattgcgcttggtaccaccagaacatatttccatgtggatttctggagtcatggtgctatgactatggttttcatttcaggttttacaagaccaaatatggttttaaaggtaacacaaagacattttattttaaaatgtctattttaactttaagcactgtagataaaaagccttcaacgtgcgttgatgattaccaaggcatacagttatgctgtcaggctaacattttttagatttgaaataaaagttcttccactatccctgcttaattaaacaatgtccataaactaccaagtaagctactacaaacaaacaaatctggtaccatttgcagcttcttctatttgtgattcccaaaattcccaatgctttgcaattaaaatcaagttcagaaataaaagagatgctatgggtaaaataaaagtgcaactgtcatccacagccctggattgaattgcaacatccatctaaccagccactctgtccatgttgatttattttgctttaagtaattgcagcccatttgaccttccaaaatatagctttcatttgtcttatgtattggagtctaaatgaattttatttgaataaaatgcatttgattctaaagcattttgaaagctggaactaagtatgagttcgatggagaaggcagggctgtctggagcccgagttaattggatgcatcacttcttctggagtcacttgatcacaacaaattgacacctgccaacttctcccctgtaccttcctgatcccggtcaagtcattctcaagtagaagcagtcgagtcatttttattcatttttgatgtgaaccaaactttcaagctaggacttgccatgaaacaaattacacattccttgtggctactaaaaaaattagtttattagcgcaagagtctggatttgagaataaaatcatagatacaaataatctatatttctcacagtaaaagagatatttcttctgaaattacttgtttcttggtggtgtaacattctagcattgcattcatccattctttcagtcaatgtgtcaataggcagttactgagcatgcacctagttatgtaaagaattataagataaaaacccctaattgtaggaatctcagttcagaagagacaggtgctcaacaaaccattgctaagcaatgtaataatggtgtattggacataggttactagttctgtggaaatacagaagaaataataggaaaggggtagctaggttaattagtattttgttttgcttggtaactggtcctaacttttaaaatatatatatatggcgatagggtttgcaattatatttgaacaagttggttaggaaataaaacattttccaccattaagaattagaatacctataatcatcacagggagaatgtcaattttcaaaataagaatcaggcccgtgtggtggctcacgcctgtaatcccagcactttgggagtccgaggcaggtggatcacgaggtcaggagatcgagaccatgctggctaacacagtgaaaccccgtccctacaaaaaatacaaaaaaatattagccgggcgtggtggcgggtgcctgtggtcccagctgctcgggaggctgaggcaggagaatggcgtgaacccaggaggcagagcttgcagtgagccgagatcgcgccactgcactccagcctgggcgactgagcgagattccgtctcaataaataaataaataaataaataaataaataaataaataatcggccgggggctgtggctcatgcctgtaatcccagcactctgggaggctgaggtgggtgaatcacttgaggtccggagttcggcaccagcctgaccaacatggtgaaaccctgtctctaataaaaatacacaaattagctggatgtcgtggtacacacctgtaatcccagctacttgggtggctgaggcaggggaatcatttgaacccaggaggcggaggttgcagtgagccgagatggtgccactgcactccagcctgggtgactctgtctcaaaaataaatcagtaaataaattaataaataataaaaataagaattataagaaagaaaaatattaaaattgtatctaaataaaaaatacttttaaagaaatccttaatactgaatttttgaagtacagttggacctctgtatttgtgaatccatcagtggatccaaccaatggcaaatagaaaaaaattaaaaataatacgatgataaatctaagtaatctagagatgatttaaattatgtgggaggctgtgcataggttatatgcaaatactacaccattttataacagggacttgaaaatgcgtggatttgggtatctatggggtgggtggggattggtgtggaacaatcccctcacagatagagagggatgacttgtattcattaatctcacttgatggatatatcctttttgcatgcgtgtaagaacacagtaatcttttctatcatcgagatgattttctactctgcccattatttacaccacatttagattccagcctggttttcctctgctacttagtacccttctgcactacttcccccgaattaattgatataatgagctgatgtaaattactttcaatattaggctgagctaatattaacccgcaataatttagaaagtaaatataccatacaacaccatatacgtactgaattccaaaattaagtatcaaggatgttttagtttcatgtaattttgaagtgtctagcccattgcttccttccatcatatgcagaaccacctgctctggatgtaaacaccttctgctgtgtgtgttcccacgcctcagggcctgtacagaatagtggctataggaaaggaccctcacaaccctgcacctcccactgctttcactcttccacctccttatcagtgcttttctcgcctattctgctaggaatgattttcaacattttaatcataaacatacaactcttcttttcaggcccgggtgaaatgttctgaactttatgaagcctttgtttatcatccacttgtaactcctctagtatccaaatttctatagcatttcgtgtatcttttatgactcatcaaattcttctgggtttgcatttttcatgaatcagatccccaccccacctccactcaaatttggagatgaaacatctttgtagccttgataacactgagcccaaattttataaaaaagtaagtgtctattaaatttagggtgaattttccatccctcatgataattcaacaagatgcttttgtttatattgtatttttccccaatgttcttcctctcattttcttctcttgtagtcctgtccattcattgagtctcaacctaaaagcttttaattgtgcccaaaatgtacatgattcctcatgtgaaatcccgtagtactttatttgtccctgaattatgctgtttttcatttcttccttgcactgtagttttcatacatactgtatctacttctatatgaactatgagctcttctgcaaggctgtgaatacagtcgtagtcatcttctattttccgtagtgctgtgcatatagcaggtgctcaatcaatgtttgtttcaggagtaaaagtttgtaaaaagttgtggaagaacagcaagctactcagagccaggggctccatgccaaactgagccaagcccagctacaggtggttttaggcatggctagtggtaaattgagaacaggagttggagaatgctatttctgaggccagctctatcagattttgtagcagggagctgctagggcattatgataaaggggtggctctttatctgtcctttgccagtgacccatgattatagattctgctattttaatctgggaaagttttcctgtttttgagagttccctactaaagtctagatgtcctttgtgaatactggtacatcacaatgaatacctttgttatctgtgagcatcttcagcaggattataacaaaaatcaggttgtggggtagatggagacaggaattgatgggagggatgagtggatggaaccaggagaaagggtttgtgccattgaaacaggggtgtttcaggacaaatttcagcctcacaatttctgaggtacagtaaagctgtgccctggaggctgtgtttcagaaatctaaagcttccgtttattggcccactatttcctgcctattagttgtctgttaatacttcatgaacattatcctcaaaccttaaaattatttgtaagatagaattatcctatttttcaaaggtgaaaactaaggttcagaaaggttcagttaagtagctacaattagtcatcttaataaaaagatatagatttgaacacaaaacctgtatctttccttctgtattatgcttgctgcctctttcagcaggctgctttagttatccagtgggaaataggtgtttgggagacttagaaatcttttctttctaagttagtatattttcattgctgttatcatgacgttatttcaaaaactcaaattgctatgaaaaacttgatgatacccctctttacgtcagtttttggcttgacaaagaatagaataaaacaagaaataagacagcttatcttcgatctttcaccaggagggaacttagctgctgtctttgttttggggtaaaagaaaaataaaatgaatctgtgatattcaagtaaatccctcagttgtttgttagtgtctactgtttactcaaaaatgggaagctccaggtcggtgatacatcatctttgttgcgcttggcaccttctttcatgaatcatattaatctgcttaaactaacaaggattaattgccttggtaaggcaacctggcattgaaatgatatattgcccagacagcttggaatttggccactcataaatctcatttgtttgttggtttatttctgtttgtctctctctctgacagatgtgtgcccaatcactgtgagcatggtggaaagtgctcgcaaacatgggacagcttcaaatgcacttgtgatgagacaggatacagtggggccacctgccacaactgtgagtgccaatttatctcactttaatcttgtaattgcatgagaatctcaagtcttgagctgtgctttgaagctcagcaacctgaataatccacataatacatcactcgaatctgaaaaaccaagattccaattgtcatttctccaaaaaaaaaaaaataaaatacactattctacttgttaaaatatgttctctggtggcaaaggactcaaaaagaaggaccagcatttcctctgttccataaacacatagttgagattggaagtccaaacttggattcgcctctctgtgtctaacccacatctgttgggtcgattgtttgggaaatcgtgttagtgtgatgtctctgactggaccctcatttattaattaatccgagagggagacacagggtaattggaacatttagtttctggatgatggctgcctcatgctttagcccaactatttgactacctttttttagatcaaagaaatgagtccgaaatggaatatctaaaagccaatagataaaatacataagaaggtaataaaatgaagacataagagggtaaaaatattttaaaatggcaaaaataaaaagtaacatgcaaaaatgactaggaaaacacatatgtgccttggtttatataaatagctttattccaaaaggttaaataaaaaataaatttctgtacttaaaaaatttaatgctaactcttataattataatattaattttccaataatgcatcgccatttgcagaacgcttttgaaaacaaagcacttttgaaaacatatttggcatgaatcacataattacaagaagagagtcaactgttggttagtgtgtgcatacgtatgtgcctgtgtgtgtgtgtgtgtgtgtgtgtgtagggaaggaagagcaagagaaaaagagagattcaaccttctctcaatatgcccaaacactgaaactctaatatctaaatcctccgattatacaaacagatttcactttacttttaggaaatggtgacaagcaaactatctcagagtagagccctgtgtacagtaaaaatgtcatacagctctctaagcctttccattgtgttatttgtagtaatgtgcaagaagaaatcgtgttttgaatatattgtaaaatgttgacttacaaagttgcacacatttatttgtttaggtagatattcaaaaacaagaggcaaaggaaatcttgacaaaactaacaatagaaagatgtcaagaaggtcaaaattgatactagattcattatctgtgtttacatatatgaaagtattttaatgaataaagaacaaaaatgattgatactgaaattaattcaaagagttataactaaaattgttccttaccaatcacatcaaaatattaacctccagtatgtgacatttattaaatataacgtgatgctagaattacattgatgaaactcagtgccttcactccactagcataatttttatcgtgtgttataaataccatatttaattacacgggatcttgttcctgaaatacgataatgctaaccaatggtcaagagcaagaaatcggtggtggttgcaaggattttctatctcagtgatggcttttacattgaactgaaaagcaacttattctttttttataactgtttccatccttaaaatacacagcaaaaaggcaaaaaaaaaaattaaaatgtatgctactggttgagtagctgaggtttgttttgttttttaagggtaatgactccaaggattagaaatgtcctaagtgtgtttaggtttggtgctagtggccagctccaaaggtaaaagacaaaaattgtcttttgttctgctgctccttcctacttgttccttgctccattttgttggatctttaaaagcagaatcattctttttaataataaaagcctgatcttttgttgtcttctccaaatgaagccaaaattttgaatatccaacgtgtgcataaatagaggtgaaaagaccatactacataattcaagagagggttggctggtgactttttctttcgaaaaatatacattgtagcttattgaaggccatttgcctcctaataacctgaaagacttgatacagtcttacttatccaaatggattagttaaaaatttcacacagcacaaatgtaagaagatacaatgtatgccattcagtttgacacagaatgaacaattttacatttttgcgaaatcaatgaccacattcaaagcaagaagaacgaagtgcgaaggccccagtttctgatgtgtctgacgctagctataaaaccatcaggccgtgtgcctttgtggtcaatcatttgacttttcttgcactttgttcgactgaagtctcttggtattctacaagccagtgagctgagatttgcagttgcttattctgtattctgtgggtttgaactgtgtaagtaacataaaatattttgcttcattatttcctgcagaagaccaagcattcatcttgaaaagaaatcatgctaattattttaaatagtatttttttttaaaaaaagcagctaactaagagctaaagtttaatataatagaacatttgttagagtttcaaacattacaggctacaatattttagcacaccttctacactagcccgggcttggtcaggatgagacagcagtgctatgagtgacctgtgatcatccaggctagaagctctagttcaagatggaacagagaggcctttttgcttggtcactctgccttgtgttgactttgactttaccattttcttacttgtaccctaggccatttaaattatttgagcttcagttttctcctgtaggaatagataattaacagtgctcacctcttcaagccattgtgagattaaatgaaatgatgtacggaagatgctgagaaaaactttggcttatgtggtactcaataaatttttgtcatttcatcactttcagagcaattgtccttttcctttgaacttctataccaataattgcccaaatcacacaatgtgtctcttaatttaatgtcaccatacattgtttgctatcacttttatggcagatttggactgcagtgaatgactggtttccatagtatttttctccagaagaattgaagagtatgcctcctaaacctatgtctcctgttttcatttgttagtttgtgtgtacatggggactttgtttttacgtaaattatatgtagggcttagaggactgtcatttgtgaactgctcccctgaggagccaggatgtctccctttgggatgagtagacaactcaatcccacagacaaagccaaagatcacagaagatagtcagatcacaggaaagggaaagccagtttttgtcgtttaagaacaaaagaggcaagtttgttacaaaatgcaaatacattaaattgttgaagttttaaacttgaaaaaattttctcatacaggcattccactctccataaatcctttaagatctgaatagtagcatatctgaacaccaaaccatgacaaagggactaaaatgatcatgttgaacagtttgtgtttattgtattgacttatccctgcttcagtctcccaaaagcactgtaagaatgtatcttttgcttggagatggagtcttgctctgtcacccaggcttgagtgcagtggcatgatctcggttcactgcaacctccacctcccaggttcaagcgattctgctgcctcagcctcccaagtagctgggactacaggcacgtgccaccatgcccagctaattttttgtattttcagtataaatggggattcactgcgttagccaggatggtctggatctcctgacctcatgatctgcccgccttggcctcccaaagtgctgggattacaggcatgagccaccatgcctggccaaacattcttatatatactactagttccttgtgtggaactgctctaaaaattccttagaatatcctcaataatatgaaaacttttggctaatttaatgaatgcaagaggttaaaggatagtattttagtgttcgacaaaaataagcaatgttagccttggaaatttattaaatgtcagatgtgcattctgacagaaaatatttttgcagatctttttattaaaggagagattttcatgttgcccaaatatatagacgtaatgtttccaggggaaacaggaggaataaactagatgacctatataattctcttttaattttaaaatcacgagatttaaaaattctgaaatactagtaaggaacaggtcctgacattgccaaataaagcaaaagtaaaattttttctagccaatgttagagaaaaatttaaatgtaaacggtaacaattgtacattccgtatgctggagcatttcctctgggttcataaatgtgtaaactgtaaattgtgttgcaccttattacagcacacgtgagaggcgcagtggatttcaacagcccataccatgttgttgataatccatttcacctataattgatataattcaaagaataattttcaaaataaattgaattctatttgctgtagtcatactaacatagagcataaagacctagatttattggcacgaagaaacttggtgtctctgtccatttggagtttctacaacttaggcatcaatgataacttggagtttgagcattgctacaaaaacaagcagcattgggtagaattgcgttggatatggtattagtctgttctcacactgctataaagtaataccagagactggataatttagaaagaaaaggggtttgactcacagttccatgtagccggggaggcctcaggaaacttaccatcatggtggaaggcgaaggggaagcaaggcccttcttgacatggtggcaggagagagaattgcaagcgaagggggaagaaccccttataaaaccatcatctcgtgagaactcacccgctgtcatgagaatagcatggaggaacttcgcccatgatccaatcacctccctcccttggcatgtgggaattacaggtccctccctcaacacgtggggattacagttcaaggtgagatttgggtggggacacagagccaaaccatagcaggtatctaaaataaaatttagatatttagccttagggaattggaatccatcctttggggcaagttcacctggcttgccaggtcctacgtaatatggccatgtctttaacctgatttcctcccctacatctcctcccattctccccttcaatgcactggcctcctttcagtttttgatgcatgccctgcactctcatacccttgcccctcctataccacgaccccccaccacaggacatttgcacatctacctctctgctttgtctagtacatttctactcctccctcagatttcagctcagcagtcatctcagaaaagctttccatggccctgtagttagatcaaatcctcttattctaaaacacacatatgtcttttagcactagcaatggttatgattttgcacttattattcataatgatttaataatatctttctcctccactggtctctgcatctctggcaggaggtggtgccacatttcatccaccagtttaaatctgaggctcgcccagcacagactatgcacgcagtgaatatgcactgcctccaagcattcttgaatgtcaaagagtatccagagcaacagtgttttctttaaattttattcaatgccctctttacagtaaatttatgaagatagtgaagctataaggagagagtacacttacagggcaaaaagaaaaatagaatcaagtccaataacaaaatatgggtaaatggaaggcagggtactaaaaataataccaaaaactaccacaagacattaaacattattctaagaaattatatggaggaatttaggatattagcaaaaaaaatctacatatttcaaattatctttaaggaaaatattgtgccatgttaagatgccccattcattactgaaatttgtgagaactatgacattatagtaacaatagcaaaggaagttgcaacaaagataatatcttagatcagcactctccaacgtttttggcaccaggggccaggttcataggagacagtttttctacagaccagggtgggggaagtgggtaaggggatggttccagatgaaactgttccacctcagatcaccaggcattagttgaattctcataaggagtgcacaacctcgatccctcacatgcacagttcacaataggtttcaggatcctatgagaatctattgctgccgctgatctgacagaagacggagctcaggcgggaatgcctgcctcctgctgtgaggcccagttactaacgggttggggaccccttacatcatagagtgtggtcaattactatactggctaactataggagttattctaaaatagatacagatatgtttaaatattgactagtacatgacaagaagtttattttaaactctataaaatttgaataacatgaacataaaaatcttttgatttatcatgtaatattatatgtgtatccttgctacagggaagttatggagaggggaaaacactcagggtttgaaattagatgtcctgatgtcaaaccatcagatccttaggctatgtggccaaacttacttccccatcagttggacatgtctaagttccagaaaaatgactgtctccatactttataaattctctgtttcctcaaacacgcttgctgcattaagtgtggatttcactcatacttatagaaggtgaagtcagcttttccagtccatgccacaggttactgacagcaataaaataggaatgattcagatttaatcactttcctccccatctctccgcccccgctcctctgtgctatcttggttttgtgtttttagacacgtcatttaatgtctctaaacttaagtttccttttgaaaattcaatgagatattgtttattaaagtactttttaatgtaccccagaacttaaagtataataaaaaaaagtgctttttaaattcagaaaatgtcctacttttaaagaacttatgccactaagtttcgaaaaacagctagtcaaattttactttgagtgtaagtcgcatctactgatccgtatactcttcattcggtacacaggccatattttcatatcagtgattctcaatgaaaagaccataggatatctcagtatttcaataaatgctctttgaaaagataaaggtttttattagcaagtataatagccacactagctgatttatatgcatggagtacatctactctttctaatcgagatatggtattatctagtcaggttgtgcttctgtgttatcaagtgagcaactaccaaattccttcaatttactttccatcccattcccacaccatgatctgtgtcagatgctcagtgtgtccctgttattaaggagtgactatgggatccaactgcaggaccacaggacactaaggacccatagtgctaccatcacttattcattcatcaatatattgagagctgactccattccatacatggaatagatactggagtgtgaagtagagagggcaggaatactaggatgtagccccctccaaaaatgtgtatagtttcattaaaaataaaagttcttatcaccttatttccacatctctggttcaccaggattgtgatctaggaataaattctatgtattcttacctcttagaatctagcttggcatttttcacgcttacaaaatatggatacatgtagacacataggggaaaaaaatgatttaatactttgtcacaaattatttgttttaagcaattattttaacttttcagattgtatattcagaggatttgtttgctttatttctgggtttgtttttctaaccatatggacagggagaaatcagggtgaggtgatgcaacttcagcatggtgcttggtagagaatatggttttcaatagaatatatgcaagtcaaatgttaataagcccttgctcagctgtatgtattctctagaggaaaagctcgcattctcaccaggactaaagcattgggagctaagggaaataatggcaagtgatgtcacttcctgaaatcactttttgcacaaggaaacaatcatcccagcagctcctttactctcatattcatctggcacctacacagaaaataagatggaaagagctgtgaaagtactacctgggtagaaatgttggaaggggatttaaaggccattctatcttttggccacaaccaaataaattacactggattaaaatagtacaggtcatttggagaaacacagcccaaggacctctacatttctaaggcagaccaaattttgaattaatcccttcttgcttcggaatgatgaccaagattaaatatagaaagaaaggatttaatttcaattttgcaaagactctttcaatagtttcaaaaatatgtctttctctttgagtcttggcaaaaaaaaaaaaaaaaaagttgatctgcaaatgcatattgaaaagcagtgtgctgtaaagacatgctgtgatcctatgaacttctccgaagctataaaatgccagtgctaggtcttgagggaactggcattattcattaaactccctgtagtttgaatcccagtgtatgttttatccaaggttcagagtgaagagaaaaaggaatagaaaacacccattttaacacttttgtcaggttgaattaaggaaaaaaatgatatagggaaagagtctactttaatttgaagataaggaacggagcttcaggaaggttaatatctgctcagaaaacaggaaagagaattagagtaaaaaataatatgtgtctctcctttgatactttttaacttctctgaaaccaaactgtgtttggtttccattttgacattagttaataagtttctatgacaagtctttagcttttgaaacttggtgtacaggattatctttaaatcacagtttcaactcattcaacaatattatgcatctcttttgtatgtggcacactatgtgaatacaaaagcatagacgagagccattttccttatgaagtagacaaggtagttttaaaggaaagcaggataagtaataaaagcattaatacattataagaaggtaacatgtatttatgtgtccaactagtatcaaggcaagtgtgtatgatatgagagaaaaacaatatgaaccaagatatttgggaagacgttcaagcaggaacggaactctgagctaagttcctttcagagttctgtagagaaacagaactaattgttaaatattcaaaaaattttgaattgattgtttaaccttggtaaaccttggtagcttgaagcagaactttggtgtaaaccttggtagcttgaaccagaccacagtggaagaatttatgctagggaaattgacaaaccctgtaaagcaagatacttttaatagagctggtttactagcacaccactgccctgtttcattattaataaaacaagaataatagtatgtgcctgccaatattattgtgaagggttcagatgatttgtaaaatgtctaacatgttgtctactatgtagtcaattctcaacagatgacagccatggttataaatgtaatactgtgaagagactggtcttgttaaaggagcagcagggtgcagatttgaatcatgggtgaagctggcccagaagacagtggtttttcagcaccgctgtaacaaagcataacttcagatgctattcttcataagtcatttttttaaatcgtgaaacaacttatatccattagaacaggagtccccaatccccacaataccagtttgtggccttttaggaactgggccacatagcagaaggtgagcagtggtggagtgaagcttcacctctatttacagccactccccattgctcacatttccacctgagctccacttcctgtcagatcacgggcagcatcagattctcagaggagcacgaatgctattgtgaactgtgcatgcgagggatgtaggttgcatgttccttatgagaatctaatgcctgatgatctgccactgtttcccatcacccccatatgggaccacctagttgcaggaaaacaagctcagggctcccactgattttacattatggtgagttgtatgattatttcattattcatcacaatgtcataataatagaaataaattgcaaaataaatgtatgtacttgaatcatcctgaaaccatcccctacctcctgatccatggaaaaactgtcttccatgaaaccagtctctggtgccaaaaaggttggagaatgctgctttagaagaaagaaaggtcactgaatgatatttaagttttcccataacaggttatgggctctcagttatttctgaagtaaggagaactggtaaggctgctgaaaatgcttacagtgcatttttgaaaaccatttggatgatttgatatcacttctttaactattaacatttctttactgaaagtgatacagacgcttttattttactaaattacttctcaattatttagcttatagtatgatcttaggtaacaaagctaattttatattctcttgtgattattaacctaaatctggtataatgagatgcttcctcccctcaggagcggtccagctgtgactcagctgcatcaaatttatgtcttctgaaattaagacacctggatttgtttgctaaactctatttaaaaactactcagtgaggattctcttgattttgcaccattcacaggaagaaattctgaaagttgaattattggttcccgtattttttattttttatttttttttataaaatcatgataaacagaactcttacttcatccattttgttgttgctgttgccgcattttgctttttcttcctcctttcctctccctcttggcaaaagaatgctacaaaaatataaagattgttgtaatctggggcgaaattatccatccacctaaataatctcctcctgttatctttgatgaatatgtctaacaccattaataagcaatagtttcttataaaaaatgcagccgtttccaagaaaattttgatgcttgacttttggggtattctctcatctgacttctttcaaatgtttgtgaaatcgctgatttggaaatctttagacttagccaataaaagtgaaataatgtaaatggatatggatttgaataaagaatatggttttatttttaagtaaaatgagaaaaacattcaagggctcgtagtcccttagtttcatcacccagtttcatcccaaagctgccatagaagctcctgtctgaaaaatatgcctactctactcttgaaagcccattcttggcatcacggatgccaccaccaaatgccagacaatgttggcaactacagaattgctgtcatttctcattagcaggcatcaaaatgtcctaatactctctgccactatctgggcctgttgagatattaattaaacatgtctttcttgccaagtcatgtgatcaactttcactaggctaggtagagccaagtgagcccatccaactacactggataaagaaatacctctaagaatttgtctgtgaagaggaaaatgcctcccatttgtattactgcaaaggaattcagagctctagaaaagcctgtgtgtgttttctaccatatggctatctgttgctgagttatcccacttagagaatattcaagcatttgatggaaacatatccctactcagaaaatgagctcctctagagtttgaatgacatagatagagatttcctgagataataaaacctgcattggggcaggccagactgattgtcctacaggttcctaaattacctgaagctaggtggacagcacaaactttgttaatttattgtccaaaagcactatttttcttttgtatagttctttaaattaagctgacttaattaagctctgtgtaagagcaaaataacattttctggacttccacaagggagagattctcaataataaggattcctgccttcccacagcatagcagttccaggagagaagtactgggattgcatgcgtattagatgcccttgagtaaggcaagtaggaaactccagacagcagtacttgctgcttggttgttagtataggtgtctactcctgtgtgttacagcacctgatgggaaagcccaagctatgataaaaaaaaaaaaaaaaaaaatctcctctcttctcagctgaccatgtggctgattagccacaaggccagtcatcccaaagggtgctgaagagaagtgggctgggaggggaagcccagtgatggatgatgaaagtgcagtcattgcaaaacaagtccttctcttattgttgctagatccactgcttatgacctattttccgcttttaccagataaaatgtaccatcaactctgtcttgaaacttttgctttcctgcagtgtgattgccacagttccactgaacagaggtcattttcgctaagcttcctttctacagtctaaactaggtttttgagctaacacgtattttagaagtaaaaataatactacagaatgatgcatagggcaaaaatagtatagaggagaaatttattgagaagcatttggattgctattagtaatcaagaaaaatgtttattaataagtaacatttctcctcttcctttatacatatagatgagatattgaaagaagttgaacatagcagaagcatgttagtctaaagcccaagtaatctctttgctatttaaaaattctaaaggatttgaattaggatttcagttcacattcaaagtggtagttttttttcccatttgtcatcaccctatgcttctcatgcactacctaccttaagatgaaataaatgaatatcaggtagtaaattctaccacatgtggttattatccaaggaatgggctcacattgacacttgattaacatcagtttcacatgtggtaataaaaaaaaaattaatctgtgcaaactgtaattgtcatgctgggatcatttagattccagcagtctctctgttgagcagtttaagaaaactgtgttttcattgtactttttaaatgaggaagcccagtggaaaaatcatatttgaatcttgagaaatcttttgctttctaaaagtgcagtaaatgaatataactttgatggttgggaagatgagcttgttatccacagacttaaaaaattaagaataaatatacaagttttttggaggggtaatttagtagatattttaaaatacttaccagccaggcatggtggctctcgcctgtaatcccagcactttgggaggccgaggtgggtagatcatgaggtcaggagatcaagaccatcctgtctaacacatggtgaaaccccgtctctactaaaaataaaaaaaatagctgggcgtggtggcaggcgcctgtagtcccagctactcgggaggctgaggcaagagaatggcctgaacccgggaggcagagcttgcagtgagccaagatagtgccaccgcactccagcctgggcaacagtgcaaaactctgtctcaaaaaaaaaataccgatataatgatgtattaaggttagcaactatgcctaaaaaatgagtcctctgaaatgctaccttcttacacaggtctgcaaccaccccaatttcccaaattttaccctagttctctcccccaagcatgtggctacctactagttttaaccaaagaaggaaggctttaagcaggagggagaaagaatatggagacgttaggagagtgggtggggagaaaaggaggagagagctgcactcttcatctgtatataagatcatgttacttgcaaacagagacaagttacctctgaatggcaaggctgagaacactagtgtttctagctctgtgctttctacagtgtgatttgtggacaaatagagggctttatatgcattgcaagtgaccctgaagataatataaatgcagcttagaagaagtagaaatgtatctatttttaaagtaatcttacttcttaccttagatttaaatatatacttaaggtcaaaaagtatttttaaaatcaaaagaacagtatttttttccatgtaaaaccagagcaagatttttttttaaaaaaactggtagtaagcagaagtgatttcattaatgcctctttggaaacagtttatggataaaattagcaatatgatctatcactgacatttactcttttatcctttatgcagaagggcttttcatttataacaatgagagagattataaatcagttattaaaaccttatcaaagacaaaggcatagacatttttacattaaaattatgaatgcaaaaacagaccagcctggtctcttacaaaccatgaacagtataaacacattgacagttcttatactagatagatcctaaataaaaatgaaatcaaataatactcattcctggaggtatacctcatataagtccctttatgtcatcagcaaccctattgtattgacataagctctctatccactgttcttcttaatgccaccgaccaggtgcttttcatctttgaacacaaatgcctatcccactgcttagtgcttggtaagtattaaatacaatttggggcaactaaactgtaactgtgtctgaatgcacaaacacacacacatacccccaaatatatacacatacctctcaaatgactgtaaagataggttcatcagactcggaacatacaaagcccttgctacataagagaagctttctctgtgggatacagcatcttaaattcttttcaattctcaataagagagaagaactttattttcatttggtaatgttcctgatatatagtacatgatattctttatgccaagttttgttctatcaaaaaatatctgacacttccaaactcattttatgagtccagcattaccctgatactgaatccagactaggagactacaattaaaattacaagtcagtatccctgatgagcatacatgcaaaaatcttcaagaaaatagcagcaaaccaagttctacagcatattccaagaattatacaccaagatcaactgggatttatccctggatgcaaggatggtttgatatatctaaattagcaaatgtgattacaccgtataaacaaaatgaaggataagaatcatatgatcatttcaacagacacagaagaagcatttgacaaaattcaacatcctttcataataaaaactctcagcaaactagatacagaaggaacatacctcaattcaataaaggctgtatgtgaggagcccacagctatcatcatcctcaatggtgaaaaactgaacgctttccctcaaggatcaggaaaaagacaaggatccccactcctgtcacttctattcaacaatgcactgaaagtcgtaagcagagcaattgggtaagaagaagaaaaaaacacatccaaatccaaaaggaagaagttagattttctctgtttgcagatgacatgctcttatagagagatgtccctgacttcaggtggtttgacttacaactttttcaattttatagtggtgtgaagccaatgcaatttggtgtacttcaaattttagatcttttcctgaactagcaatatgtggttcatgagataattcacactgtattaaaaaatagactttctattagatgattttgcccaactatagggtaatgtaagtgttctgagcacatttaagtttggctaggttaagctatgatgtttgctatgttagatgtattagatacattttttacttttggtattttcaacttatcagtttatcagtatgtgaccccatggtaaatccaggagcatctacatatagaaaaccctacagactccaccaaaaaactattagaattaacaagcaaattcagtaaagtggcagtatacaaaatcatacaaaaatcagttttgtttctatacactaccaatgaactatctgaaagaaaaattgaaatcttcccacttgtaatagtatcaaaaagcataaattacttaggcatatatttaaccaaagaggtgagtgaaggatccatacattgataccatgaacatggatgaaaaaaagtgaagacgacacaaatagatggaaagataacccatgttctcagattggaagagtttaacagttagtcccactaaaatatccttatcaatgcaagctatacaatcaaggaatctctatcaaatttccaatcagatgttttatagaaatagaaaaaaaaatcctaaaattcatgtggaatcacaaaagaccccaaatggacaaagcaatagcaaaagaaagctggaggaatcacatactaagtgtgagggaaatgcatatcaaagtcatttgtgacaacatggctaaacctagacagcataatgctaagtgaaataagccagacagagaaaaacaaatgctgtatctatcacttatatagggaacctaaaaaaaaatgaaatgtcaaactcacagaaacagggagtaaaataatagtaaatgcagaagctgagggtagggacaatggagaaatgttgatcaaaaggtacaaactttcaattacaagatgaataagttctggggagctaatatacaacatggtgactacagttaattatactgtattgtatacttgaaatttgctaaaagagtagatctgaagtgttctcacacaaaaaagaatatctgagttgatgggtgtgttaattaacccgattgtggtaatcatttcacaatgtgtgtgtgtgtgtgtgtgtgtgtatatatatatatatataaaacaaatcatcatgttgtacattttaaatatatacaattttatttgtcatgtgtacctccatgagactgaaattaaaaaaagaaagtagcaggaaaagtaggcttcaatatcaacacaatggatttttggacattttgaggcaaggactctattatacacatcagaagagtgtagaaaagcaatagttgagcgagaagtaccctctgtgcttttcctgacagatgattccaaggcataggatgctaagggtgtttgatttctagggctgccattaataaataaccacattcttgctggtcaaaacaacagaaatttattctctcacagatttgcagtttagaagtccataatcaaggtgctggcaagcccacgctccccttgaaatttctaggaaagacttttctttgcctttcactggcttctattgattgccagtaatttttggcataccttgacttgtacatgcctcaatctattctctgcctccttcttcacacagccacgttccctgggtgtttctgtctctgtccctgtgtcagaatctttctctcctttctcttgtaaagacaccagccattggattgagtgtccacattgatccagtacaaattaatcttgacaaattacatctgcaaagactgtattcccaaatacgatcccatcatgagtttgggtggaagtgagcttttgcaggactctctacaccccgctttgccacacctgctcctgtccagcacggagctccctgtgtcccctgtgctttcccagctccgttatgccatcccctaacctgcaccccagattactcttctccccacttttaccacactcaaaatttactttctgtaggctccagtcacattctctttttattttgtgaaatcttgtttgctcactaaaacttaaacggatttctcttttgtaaaaaaaaaaaaatatttttgacagcaattagttctgtgtaatgtctctggtatttatacactcagttaattttttttccaagtgttttacccacagttttttctcccagaaaataaattgtgtaggcctaagttaactattctgtctctctttttgcaaaacctaatagtctttgttgattaaatttttcattttgaacacactctgtgggtttaaagaaccctgaggagaagggagaggagagtatgttaggtattgaattttcattcttcaaaattgcatgtaaggaagatattttatttttcagatgaaaaagctgaggttcaaagttcatggcagagccacaatttcaaaccatttcctgttgattttgtgaaatctgtgcttgtccatactccctcccttctgccatggcatttccaactctcagagcaccaattccaaacagcctggagactgggaagtggttctgagaagttggttttctattggcagctctagtagagaagccctgtcctgtagctcctgacatgagtccccagtgcatcagcctgagagcagctgctgtgggagtaagttcagggtacctctgagaaaagagggggccctcactgacctagaggcatgtatgaaaacctagggctcccaaggggtcttggcaatcatttattctagctacctcattttatggagacagtatataatcattaaaaatgttttagtccgggcacagtggctcacttcggtaatcccagcactttgggaggccgaggcgggaggatcacttgagcccaggacttcaagaccagcctcgccaacatggtgaaacctcatctctactaaaaatacaaaaattagctgggcgtggtgttacgtgcctgtaatcccaaatactcgggaggctaaggcaggagaatcacttgaacccgggaggcagaggttgcagtgacccgagattgcaccacggcttggggtcctgggcgacagaatgagattctgtcttaaaaaaaaaaaaacaaaaaacctctgagaaagaccatatttaaattacattaaattttggagttataatcacattaatataaattatatcgagattgtattttttgtttaaaaatataatttaaaaactatattcatatatatatatatatgaatcagaaagactcatttttccaggcattttgggttagggaaaatctgtcctttgcttccccgaccattttgaatgtgattaaatatgcacacacacatgcacacacacacgcatgcacacactgatgcaaactttagcaagtgacatgagggtgtcttttcacaggataacttttttcatttgattcctcattcataaaacactagtatgatatacatccccacatagattttccccgtttctataaaggatgaagattcaaatgctgcaaagctcactccgggcccctggctcagaaacagttctctcagcactctcctgacattattaatggccctgatgtacaaacccagaataaaatagaattaaaatccaaagttaatttcaagctccattagaaattaaaggtgttgggaaagaaatcaatatttgcccagtgcaaaatgactaaattcaaagcaattaattctattattttgtaacttctaaaaactataaaagaccttcaaacaataaaatgttgccatgcgcacacacatatacaatgtgtgactaaaaataatgagaatgatatccagcagcgacatgcaaaaatctcttttattattttatagccacactatgtagtgtacacactaaagtgtgtcttaaaatagagccaattattccataaaattcgtggctatttccagcaattatcagcacttagttgtaaatctgggagaatttaagggacagaaacaatgcaaaagagcgaggagattaatttaaatggaagaaatgtatctgttttcttaattttgctttctctttttccagcttctttttatgtaatgctatcgatcaccaaacaaatggccttaaacgctgtagttcccaacaggatgaagtatttcacaacctgtagagctgtaggttataatacacataaaactggcactcggtaaaagctttttcctgtcagaatcattgccatttcttccctgtagtgccttttggagaaagtctgagttaacaaatggatcttttccaggtgcagaaagatcagagtcaaatgggtttggatcagatcttgtaacgagaatgtgtcactctttccctccccttgtcaagaaggagtctcttaagaaccggctcaagcatcacttatcattacagcagactggggtgaacagttgtaaaagataatgatagaccaaaccagttcttagctaaggagatgtcatgagccttctgatgaaacctttctctctttgtgatagagatagtcaaaatgattaaggactactagcaacagaggaaggcatggccaggcactaggaccattctaagacccatcaatatgaggaaatggagccatcgttggccaaaggctcgggtccttcaagtttctaaaattttttgtttgtttgttctgtttgttttttgttcgagatggagttttgctcttgttgctcaggttacagtgcaatggcgcgatctcggctcactgcaacctccgcctcctgggttcaagcaattctcctgcttcagcctcctgagtagctgggattacaggcatgcaccaccatgcccggctaattttatatttttagtagagacaaggtttctccatgttggtcaggctggtgtcaaaatcccgacctcaggcaatccacctgcctcggcctcccaaaatgctgggattacaggcgtgagccaccacgcctggcccaagtttctagattttgacacgtccttccagtggctgctaatcaacccctggccctttgaaaagttgtatctttttaaattgatttctttcaaaattgtactaaatgtagttagttgcccggaaggtgtgacttgtttaacctaatgaatcaaagctgggctttagcagttgagccacctgggccactaacatctacccactgtctggttttccacactagctataacaaaaacacacttgttagaccaaattgattttctgctctctttacgtctccaaattactcagctgtttcttccttcctgtgatattttaaaaggtctggggttctagccccaactctgtcacttactgtgggtgtgagctgaggctagtgatttggcctccctgatcctcactcccctctcctgtcaaatgaaaatgattgtatttaccttgtaagttgttttcttaaaagaaaaaaataaaacaatttaaaatgcatgtgaagtggatgttcatgatcagacctattgtagactctccaaagtagcagctgtggacattaccatggatctccattttcctgggtttcccaggactgcacactctctccccgctctgcttccttcagacctactctccagagagcttctggtacctaatattagtgtttgtaggtgaccataagtcaagttagcaaatatgacatataggaaagtagataagaatgcaggggtatgaaaataaggtaaaaatggggagtaacatgtgtttaaaaattgttaatctttctcaacaacatttcttatggactcagctaagtaacccaaggaggttgtctctcttcacccgctcctccccacaccagtccacccttcaacccttcaacgtggctaccatcttctctatatcactggatcgactcttgtcagttacttctatattggcaaattgatgttaacttatataaatgggacatctatattttatagaagttgctttctctttctttctttttttttttttttttttttttttggagtctcgctctgtcacccaggctggagtgcagtagggcaatctcggctcactgcaagctccgcctcccaggttcacaccattctcctgcctcagcctcccgagtagctgggactacaggtgtctgccaccacgcgcggctaattttttgtattttttagtagagacggagtttcaccatgttagccaggatggttgatctcctgacctcgtgatcggcctgcctcgtcctcccaaagtgctgagattacaggcgtgagccaccgcgcctggccactttctctttcttatagtggtttttctttgttttctgtaactcagcagctcttcatttgggttcagtgtagttcaagcctctgcttctcagtatacttcctgggctttttctttagccttgtcctccagtagtggtgctctccagctgtgtcctcaggctttccttctcaacatatgcacttacccttactgtccctaaccatggcatcaattttcatttacatagtgattccttcatccatattgccactctagaacattttgctgggcccattaaatgtcctggtggacagtgaccagcacatagtagaaatgtaataaattattattgaatgaatgatgtctctagatcctagccattatatccctgcatcaagcttggcatattgaaaatcaacttattctttctgccccctgtcccccattccaaccagacttccttttcctcctgcatttcctataaaggaaaaacggtcctttagcaacccagccactgaagccagtaatctagccacatctaattggtcaccaagttcagcatcttccatctctggaatgccatttgtatcccatcttcctcttcaggtcatacttcaacacagatactccccatttctgaataacagcaaaaaccttgcaactcttgatttaagggccttcagtttatccttcacacatctgcaaaagtgagaatttgatgccatgacttatcaggtcttatcaggttaaatccggatattctttggctgtgtccccacccaaatctcatattgaattgtagctcccataatccctgcatgtcatgggagggacctgatgggagataattaaatcataggggcagattttcccgtgctgttctcagcatagggaatacgtctcatgagatctgatgattttttaaagggcagttcccctgcacactctctcttgcctgacactatgtaagacatgcctatgactccttcgccttctgccatgattgtgaggcctccgcagccatgtggaactgtgagtccattaaacctctttttctttataaattactcagtctcggatatttcttcatagcagtatgaaaatggacgaatacaaaaccctttaataaatctccaaagttgtaaatataaaatttgaataaactaatctcacaaaatatgcataatctagttcctgtctttgtatagtttaacctttacccagttcccactcagctgcaggcattctgagcatgctataatgctttgtacacgtctttgtatggaatgcaaactccctcttttacttaattatcattggcatgttcttcattactcagctcaagtctctttgattgcaggaaacattgtatcatcccaaatctgatttagggcccccactctctgttctcccacagcatgctgtgcagaccgtgtcatagaaagagcaatacagagttgtgggatatttgctttttgatgtcaaaaaatatcttattaacttctcataccaaaaaacaggacaggactgatgcaatagttattcaacaaatgcttgtcatataatgaatggaaattccatatatccagcctgacactcccgaaattacttactggtctgacttttttgcttgaaggaaagcagctggacttgggttaaactttcactcttctctttctctgtctcttcccttcattgtgctttttctttctaacctgtatcaaatgagagagaacctgatattagtcacatatttggaaattttttggtatcactgagatttggtccctctcactgtcttagcagttacactttaagctggcttacatatagttgtaaaaagaaagactaggttccccagttaaagaaacttcagggacagaaaagctctcttctgcttgtttccttgcttgtaaagttagtctttgatataaagtttaatccttttatgctgcctggaatgtgctcagaggttttctctgcagattgtttcatctggcagttaattcctgggtacttctgggaattgaaggaaagaggtttttgagttttagttactgaacttcgataccaccagtcaatccaacagttctatgtctgtatggttttttgctttgtttcctctaaatcggtgattcttaaattgtattttatttgatgggcacatgagtaagtcaatacaagtacagactcctgggcaccatcccttctgattcataaggtctataatagagtcatggaatctgaatttcactgggcttatgagaagattccagagcagaggattcgtgccagtgtgactagggaatctgttttctctcttagcctttctatctgatcagaagatgaaacctgtctggggttctgcgtattctaattctttctcttctttgacttcaagttccccagactctgagggctaaaacccagtatttagtggccttttacagagcaaattggctggccattccaccttatccttgccatgtaagccaccagccatgcagactttccattacctcatgatcaagagtttcagtctcttcaccctcaccaggacagaggacatagtcaaggagatccctgcagaatacactgacaaaggacttcagaaataaagggagtcccagttatgaggatagcagacaaggaaatatggtagagcttatgttctgaatcaatcatttcagattctttggtttttacattgaacatgtatttgtgattactacaaatggttccaaaaaaaaaaaattcccaaaaagtaaaagtacaaccaatgccatacaaaatagattaaaaaaatctccaaaagtttaatggttcataagtacactcataaattttgaattattattaattcataattcccaagtagtatgataactagtatgcactttacaaaaggcttggtaggttaatatatgacaaatattgcttggaaattttattttattacaacactcaatttctaaattttagatttcataagtaagtgctcctgtgatgggcctacaaccatatatatatatatatatataatgcttcctcatatatatatacatgaggaagctttagttactgaacttggataccaccagtcaatccaacagttctatgtctatatggttttttgctttgtttcctctaaatcagtgattcttaaattatattttatttgatgatctcatgagtaagtcaatacaagtacagactcctgggcaccatcccttctgattcataaggtctgattcatatatatatgtgaggaagcattatttcccactgttctgaagcagccaagtaagaattaagctattgtgtcggtgcatacagacaactgcagtcctttgcagtttttcgcccctctggctacctttattatgtcagtgacaaaaggtgatacatttagtacatcgtgaataccgacctttcacactctttgagcccctctagcactttttctttttgttctgatcttcatacactatttaagagtgttatcagcaccaagaattcatagagtaatgattccactatttaattcttcatttctttaaacaagtttttttcttcctcaagccgattttcttttttaatgaaaaagctaattatcctttaaaacaacattttttttttttgcattttgcaataaagctaggaagtaatttagtaactttctaatagtaagttaatgagttttatcccagatctagtatcgtggggcatattttttatgtgtacataatgtttctaaactaagcccagttaatattttcttttacatttatcagcaagaaagagagaaaggagactaaaaacagacccatagctccccaaagtgcttaacaggagtatttaatggcatccaatcatacttagtcgctgtgtagatagaaagctctttgcaacaaaacgacaaagatcagacaaaccactatagtagccaccagagaactttgtatttcttatgtccattctgggctgattgtccctaaataagagctaacctattttctctgactttacatgagcaaagaaaatgccttcaaagtgctttctatagcaggaggtacaggtgccaacgtaaacctagataaaagctgtttgtatatttatttgtttgcttgtttttatcacactcagtggcctcgtgatgcatgtaattaccttgaccaaagcataatagtagacagcattaccttggaagagtcttagtaagatacaaactggacacatttttgagagaagaaataataggagttgggtgaaaacatatacagcatgggatcccacctaatgcactttatatcctaaaatagggagctctccacactctcaccatcgccgtgcccacacatctcatacgtgcatgcactcatgtattactaattctgtggtgtcacagtgtccacactcccatttgcagacttgtccttttgagacagttttttggaaccagggagcacttttcttgatagagagaattctaaatttttttgcacaatcaaaatcttcagtactaaatattcacattagcaacataagaaaagtgtccatataaagactaattgtccatacaacagttcctaatgttacattttagttagatgatctacagtttaggtcacagatactcagacctattccagaatctagccatattcaactttcatacatcattttttctcataactaaagatcaaagtagtaggaaaattttcatgatattgcaaagagatttttaaaaatacattagcttaaagttatttatcattaggaacctaagttttattcttatttaaagaaccataaatagaatttaaatcaacatctatcaagatctgtctatcatatcaccttccagaagtcaacactgtaaaactcaaatatgcgtggcttttggacaacaattccatttttagaattgtatagcaagcaaataataagacagagttacaaagatttatgtatgcttttcatctcagcatagttttgaatgatgaaaaatgtgaaaatattttaacatcaatagttgtatggtaaaataaatgatctgatgacatgctaagaaacaattagagttagcaagcagagctatgttgtttgacagagaaaacataagaaacctactctatactaaacagaaaataaaactaaaatgaaaatacctggttgaaaatataaagaaagaaaaaaacataaagtgatatatcaattttaacagtgatattttccaagtaataagagtaggtcatttgaatattttttcatatttttaataaattgtttcagttgaaatcaaatgaaaatctattatttgtataataaatgatacatgtattttcatttaaaaatatttggtaaagagaaactaaagaggaataaaagaccagatgtttagttttactgtattttaaatctgtactcatatttgaaatacctatttgtttgtctaaatgcccgaatggattataatcttcttaaggcaagaggccgtggattgcccttttttttttccattgtacccctacaaaatagtagttgcatgataatgtattatgaataaatgtgtaggtggccttggtaaagccactttctctctttgaggctcatttttctcatctagaaaataaatacagggttctctactcacctcgctggggattgctgtaatgctaaaaggaggcaacacatgttgattataaagccttccatgtatgtgaaggaacattatttttaaccacagtaattacactcatagaaatcagtgaagcaagtgttggattcccatccccaggcttggctcaaggccaaatacaaaatcatgaagcaagccaaaaatacaggctgcacaagctgctcatctgtgcctgccttcctcactttagagacatagcctgccctcaggttccctgcaccttcctgctctatctctacctctcatgtaaaagtgtattcccattaaaatggaaccagagacgcatgcttcaatctgcacccgggggatatgcgttttcaccagagataagaaattatcagacaagaacaggatcagacctggatttttctgttttggaagacacacctgaaatcacacacccctccttcccctcatctgaaggccaaccaccaccacatggtcctttcaccagaggtagagagcactttgacactcagatctctgctggaaatgaaaacaccataaatctactcaagcaaatttcacccctctgtaagaaaaataacacatattattaaaagttatccttgtgttacatgaaaaaattagaaaaaaatacaatgacagtaggctttgctactatatccccataatcacagtcataatgtattaggtactaagaacaatacagaacaaccatattggtttattcagctgtttaattagatcacagttttttggatagatgaaggtataaaatatatatagatatggatattataaatcaatagatgtagatagatttttacatctattttaattttttttctgtttataaataagtaaaatcatgtattttatatatttaaatgtgtatgcattttaaataggtttcaatatttaaatattaccatctactttaaaagtctattatatatttgtttcttgtttttcaagctttttaacataagagcctgaaaactattctaatgaggacaaagtaacagaataaacctaggcacatgcccaagggaatgaagtttaatggactgtttagaaaagcatgaggttaattaggttaagattcttagaaagtgagatttgaactaaaaaaaaaaaataataaggtgttttgctgttggaaatgagaagatcataaaattcactaagaacttatccacagtgagtatagagaagagaatgggccatcctacccattgctgaggccaaaacccatcctggctgcctctctacactcacaacccacgtctaccccatcaactagttctgctctcaatgactctatcaccgccattctggttcaaacaccatcgtcctctgtctgtttttgcagtagcttcctgccttagtcgacctactttcacccaggccctattcactctcatcacagcagccagtgtgattctgttaaaatatgcattctggtcatgtccaacctcatgttaaaaacaacagcctccaaggccctgaactatacctcgatgatcttggcttctactgcccttccccttgtttgctcactcagttgctcacacattttaatcatactggatgtgttgctgtcccatgaacacatcgggcaagcattagattctcagggcatggcgtgtgctgttcttccaacttacctactgcatggcaagatccatcaactccatccagtcattgcccagatgtcatcttctcttgaagacccaccttaacaaccatatttaaaatagtaacctcacttctgttttccttatctcccttatctgctttatttttcttcatagttcattatattctttttttgtttgtttgttttgagacaagtctcgctctgtcgcccaggctggagtgcagtggtgtgatctcggctcactgcaacctccacctcctgggttcaagcgatcctcctgcctcagcctcccaagtagctgggactacaggcttgtgataccatgcccagctaatttttgtatttttagtggagatggggttttaccatgttggccaggatggtctcgatctcttgacctcgtgatctgcccacctcggcctcccaaagtgctgggattacaggcgtgaaccactgtatgcagcccattatattctaatatactgcatcttttgcttatttgtgtgctatatcacctgtctcccgcaattagaatgttaattacatgagttcagggacttttacctgtctattatgtttataattgtctccccatctaaaatagtgtccagaacattagtaggtacacaataaatattttttggattaactacattcatttatttgtgctgggaacagcaacaaaactagtctgaagagaaggggctgaaattagacctacaaaagcctgattcagtagatttttcagttggaaaatattgagtgcttacattaagatagttatggtatgatatactgatactgaaatgaaaggtaaaaaccaaagtaaaatttaagtatagatcttaaaatgaatagccccaaaccatttcttactggaaaatttaagtctgactctattgctgctattatagcagagataagagacttacaaaatctagatgaattaacaaaagattaaaatcatttaaaatgttaggagaaaacttaataaaactcttataatgtgattgccaaaaaatgcacaaatatttccaggaagtgttaaaagttgtctattgctaattatatatttgtacttttttttacagctactcatgtgtagaacaaaaaaatagacaaaattactcaggctcaatgattcactatgtacagtttacaaattaattagcttctcttaattttttcaattaaaaaagtgttaaagcattagtttattgcttatttccgtgttaaaatgctggttaattgcaaaacattattaggggccaatattaaaattccacttacaagtgtcagagaagcaaaacacatttaaagttcatttgcaaatccagcttacctaaatctacttgggataaagcaatactgctgaagtacgtaaccacattctgatgatgtatgtgcaatagtttttcccattagcttactaatgtatgtgtatgagacagagagagagagaatgtgtgtgtgtgtgtgtgtgtgtgtgttactaggattagctctagtttttaacatcataacagaatatgaagcacgatgcacaaaaattcatttataatttataaacactgagcttttaatttcaggtgtttcttctttctagttctctatgtcaatcatatagctagatacaacccagaagcaactctcattcagaaaaccacaaaatgtaattaatttctttcttttcttttttttttttttttttgcgtgtgtgtgtgtgtgacataatctcgctctgtgcccaggatgcagtgcagtggcgcaatctcggctcactgcgaccactgcctcccggattcaagcgattcccctgcctcagcctcctgaatagctgggattgcaggcacccaccaccacacccagctaatttttttttttttgtatttttagtagagaccaggtttcaccatgttgggcaggctggtctccaactcctgacctcaagtgatcttccctccatgacctcccaaggtactaggattacaggcgtcagccaccatgccccaccaagatgtaatgaattcgattaagatttggaatcagtcttgctgagatattcaagaggaaaattgtgaaatgggatctgatgctattcacaaagagttcttcttaatgcttcagaggcagctctgactgttagggttagggtcttatatggcaagtacgaatactcctactcttaaatcttcaatacagcaggcagggagaacttccttgttgaatttttcaccatgtgctaaaaggatggggtgaacttggaaagaaacatccgaacgtcaacttcattacaaacagcaaattgagcagctgtgggagagaaagttcaattgggacataaaagatccattcactgatttcagaaaagctatttctgaaaatgcacaataagtatatagcactggagtagcaaaataagtgtaagtcaactatagaaagctatgataaacaagaggaacaataaacaggacctaagattcattcgcacatatgtaaataagactacagcacaaagtaagggatactctgtcagcattatttggcattggttgttgtttttgttcaaatgtttaatccatgtcccagaaacttaagatttcaagtccttaaaagggacttttaaaaagtctcaagtaacaatgaatggaattaacagttttttagccagtcattttagtgtcttaaaaatagaaaaatatttttatgaagataaaaagaataagaaccatccattgcgtcaccatctagaaataagcactgttgtttttctttttgtttcctttttcttttgagacagaaactcaatctattgtcccaggttggagtgcagtggcgtgatcatggctcactgcaacctctgcctcctgggctcgagtgatcctcccacctcaccgtgtctgttttgtttaagagtatatagttatcaatccttaaagccgaatttcattcttggtagttactgttaaaattaagcatgaacaattgaaagattttacaaagtatatctatcatatacctgcggtgtatcatccttggagaagaaatgaacatacactgaacatagaaacaactaaactttctagataaatggaactaagagactaacttctgtttcaaatgatgacgaatttcagaaagagaaaaaattaagtagaaaaaaaaggagaatgtgagagactggggagagaaaaaataaatgagagaaggtggtagaccactaggatgaagaagcagaagatgaaggagacaggcaagatgctgacctcttagctcagtcaaggtctggactttgggggcctgtcctagcatcatctcttgcagtctagcacatgtacatacagatgctatgagaacatatgtctgtcaaaggccagtgtttttctagatcagaaacattttgtagctcttccggtggacagagttggatcatgtgttctctcaagtatttttatagatttcagaaacactgaaataatcagcactgaacgaatgtagccaggcttgtttctaaccctggattctgtgctttgattttgctatcacgcccctcactgtcaaccaccctgaaaagagaccttataaaaaattatggctgggcgtggtggctcacgcctgtaatcccagcactttgggagggcaaggcgggcggatcacctgaggtcaggagttctagaccagcctggccaacatagtgaaaccccgtctctactaaaaatacaaaaattagcagggagtggtggcgggcgcctgtagttccagatactcgggaggctgaggcaggagaatcgcttgaacccgggaggcggaggttgcagtgagccgagatagcgccactgcactccagcctggcgacagactctgtctcaaaaaaaaaaaaaaaaaaaaaaattatgctgcagtttcctagggctgctctaacaaattatcacaaatgttgtagctgaaaacaacacaaatatgttatcttacagtttgggaggtcagaagtctgaaacgggtctcactaggttaaaatcaacaggaacgcattcctctgggaggctctgagacaatctggtccattctttttcagcttctggaggcctcccgcattcctgggcttagggcactggccgtcatcttcaaagccagcgatgactgatgtaatctttctcacatcgcattgctctggcactgactaccctgcctttctctttcacttgttaagatccttgtgtttctattgggcccatctaaaaaatctaaaataatctcctacctcaagatccttaacctaatcacatctgcaaaatcccttttgtcatataaagtaatttatccacaggtttaagggatagggcagcaacatcttgggaagtcattattctgcctacctcaaacctcaaattgtattctgtgattatttttcaaaggaataaacttggccaggcacagtggctcatgcctgtaatgccagcactttgggaggccaaggtgggcggattgcttgaggtcaggagttggagaccagcctggccaacggggtgcaaccccatctcaactaaacaaaaatataaaaattagctggacatggtggtgtgcctgtcatcccagctactggggaggatgaggcaggagagttgctggaacccaggagacagaggttgcagtgagccacagtcgtaccactgcactccaacctgggcaacagagtgagactccatctcaaacaaaaaagaataaattcataaaatcaaatatttttttactgtgtgatagaagcagaaattagaaagcattatgaccacccacgaatcataaaatctttagtaggaccagtaggttaacatttttcctgttggagggagcgtttctttgatatataaactttcaaggagtcattgaaagctttggaaggcttctttccaaaaataatcttttagaaaaagtctttccaaagaatccagtcgttgtattttgggcaaaatattagaagtatgagaagccagagtgtgaaaactgagttaatattcttatgaacacgaatacttggcagccaatattgaggctgaaaatgcatttagaatgttaatgtatttccatagtatttcagatcaaagatactgaagggaacttaactgcaaattaaaaatagagaatctacaggaataagttacatttcttatagcttcctgtgcaatatcaaatcaagtagagcaagaggtggttcctactttacataatttttctcagaaggatgattttgtttactaccattgccctgtaagtattatgctttcaaggaagctctaacaactggttatcgctgaggttagtgtctctcatggtactcgcttcatgctctgtccattaggtaaatgacatgcaaagatggcttcctctaagtttctgagacacaggtactcatatttaacttccgtggaggaggaacacaggagtgaaatagaaaggtctgcatttggtgtctgtcttcccatccattcctaagagaagatgacataggcctactgcttatcaagagcatttgaccctaatgagtgtcgttatagaaaagttagaacctttctataagactttgtattttactttccagaaaattccaattcactaaactgtccatttcttctcctactagtgtgttattttcagggtgttttcttcctattatagtctcagaaggcccatgctcagcttccgtagaccctgtcctctgtcagtcagtcacttcatttacccctaggttttgactcttcacagatttctggatatctccctccaaagggatagctcttctgttgctaatgactagcatgagggttggtaagtagtgacagtaaaattaacattccttgaccacatgaatgtgagcaacgctttggatcagacacctgatctctgccacaccttccagattaagtcaaaaatgcctatcttggtattcagggtccacccaatctgcctttcctggctaattttccatgtctctcctatgttaaccctgcattccaaccaaatggtctgtttcccattcctggaatccctaggataaattccattaatttgcctgcttcggtgtagttgttcatgccattctccttcctctattgatcatagttccactataattttgttgtaattatcgggaaccaaagaagcatgaccctttcttctcatacaaggtttggatcaatttagaaataagatgcctagtagaaaaaagctggccatcaaaatgtctgctttattacaataaaagcttatttgaaagcagtgcttagatctacctacagtctaggcatactgctaatattactgtctatgcaaaaactgaaatcccattccgtggaagtctcccctggcaaaggaagagcctgccccaaggtgtttcccatgtggaagatgcgagaatattgctcctaggcagcctgaaatggagaatataagctgctctgatcaggtattgtttcttcttctaaattcacaaaatagacgagtcattctctgcctgtcttcactcgccaggatcagtgattttgaaggtgggggtcagggtgggagtagaggaatatagagagaggcccaaagtcaccttggctaaagtccctctgtgtggaaacatgagaccaggcgcttttatgaggctttcttgaatatgcttatctgtgaaacataatgttttcccctttgtgctcccaggtttgtaggttatatccctcatgcagaactgagagagtggttcagctaccaaataccatctgttagtctgttccagctactgtaaccaaatgccataaactgcatggcttataaataacagaaccttatttctgacagttctagaagctgggaagtccaagatcaaggtgctggcagattctgatgagggtcccctactttctggttcatagatggcactctctcacaagtgtgctcatgtagcagaaggggcacaaggagtatctctgaggcctcttttatgagggcactaattccacctgtgagggctctgccctcatggcctaatcacctcccacagttccccacctcttaccaccagcttaggggattaggatttcaacatatgaacttggaggacacacgaatattctgaccatagcatatacttactggttttttatttctgattttaattggtgcttaaaggaatatctaggtattcctaataactattatccaaaccttccaccaatattttcaataaatgcctggggaacagaaaatgaatgaattaaagtatctaccaataatattttagaaaaaaaacctaaaatttgcaccttcctttttattcacaatatgattttcatatgtaatatttagaattattaccaaaagttgtagcagagcctataaattaaaaaaaaatttcaagggagcatattagaattaagcagtaaaatggtagaaacaaatggcttggtgggataaggagcagtaaacatttttttgcatattctccagttttacaaatttgccatcttcacattttgggggaaaaaagtttgaaagaatgcctttttaaatccattgagaaacatggatagctgatgctgtgcccatactcaaacttcaaaattttctggcccagcaaaaaaaaaacaaaaaaacaaaaaaaaaaaaacctactaaaaaataatagtttattgaagacaagaaaaaaatattactctgccttattcatatgcctgggaatacaatatatttgaaatgtattatttctaaatgaataacaaacttgtaaaccaacacaatcaaatgaattcattttcatactagttatgtgttacagagcaacaaattactccagattgtagtagcctaaagcaagaaactcattatttcacagtgtctgtgggtcaagatttcaggcacagcttagctgagtgcctgtggcctgggtctctcacagtcaagatgcaatcaagatgctgatgtcagtgagggccgcactgatcataaggcccaagagggtaaagatccacttccaaaatcattcaaatgctgctggcaagtctcagctctttgctagtcatcgactgggcacatctgttctttctcatggagcctcgtcatggggctgaccacatggcatcccggttcaccaagagggagagttctgacacagagagaggagacagcgagagagagaatgaatgcacaaaacagaagccacagtcttgtaatagtctaatcatggaaatgacatttcatcacttcaccgtattgtattctttggaagcaagtcactaggtccagcgagtctcagagggaggggattatacaaaggcatgaataccaggagttggggatcctttgggatcaccgtagaagctttcctacatatccttctttcctaccttgtctggataagttctgtctgttcctggagacagctgaagaatttcctcttccaggaagctccctccacacagctgagcctcctcctctctgcttctgcagcagcttgggccccctgtatcagggcatcctgaactgcacaggtgccttgtgagcacctgtctccttgcgtgtctccctcttcgggctcttattcctcaacagccaggttcctgtcttactcaattcccatgcctagttcacagcacagaccgtgtgctatgtacagatgtctcgtatggagctataaattataattgaacataacagaatttcattcacgttacctgcagaaaataaatactgcggtgaatctcactcacttgcccctaatactcctctgcaatatttaagcacggaggtcaaacagtttcctccgtttgggaacttgatatttaatgaaacattttatgagtccgttgacattgcttacctcagctgcagttccacagatgacttcggaatgtgtgaaatagatctcttattcttcactgataaaacttcgggtcagactctcacacaactgcacacatggtagctttgctccactcacaccttgtctacagcctagatgtttgcaaatagtgctttggtttttctttaaaatatccttttgctattactatatatgcccactgctttgttcagttgaaaaatagcgtggctagccgggcatggtggtgcctgcctgtaatcccagctactcgggtggctgaggcaggacaattgcttgaacccgggaggcggaggttgcggtgagccgagatcacaccattgcactccagcctgggcaacaagagtgaaactccatctcaacaacaacaacaaaaaagcgtggctctgttatgccctggcactgtgctaggtccccaacattcacagaagactaaaatataatttctaatgtgggagacaaaggtttataagccaaagagacacaactcatcagctggattttgcactgtgacaagaactgacttagaggagcgtggctgtcttctaattcagggactctggagggatgtgtaactaaggttcaggtcagcacacccaatgcaacatgcatactctgtgcagaaagtaaattgaaaactctgcttgagggtctcagtggacctcaaagcagccctgacattttcttgtaagttagtgcagcataggagttccaattctgcgttcatcctccacagtgagtccccaggagagggaccagagaatggagtaaaaacaaagggaagggagagaaaccacagctctagtggtcacaatgacaccaggaccagtagaagcctgagtcatacaataatttctactggttcagtttctactgaataatttccaccattaaaaatgactccaagcacttacacatgggtgaaacctagaaagtgaaacaattgcttgttatatcttgttagcaggcaaagaaaggatggtgaaatcagctgttggtgaaattctgacagcagggaaagtcgggggctggcatttctggcaggcatgagagccacaaacgggtgacagaatatctcaagagacaatctagccttattcttaatttttgcttaacatatttgttttgacataacattctcatacatctttaagttgagaatcagaaacatgtctttgttataataatattgttgatgtcaaagaaacacagagcatatgctgtcttaggaattctaaatggcaaatgacatgtgtgtctgtataacaaagacaaggagagatagagacaaatataaggagagaaatgcaaaccaactctcaaagtccttaaatcatattataagtgggcaaagacaaggaaagacagaaatagagacaaatataaggaaagcaatgcaaaccaacactccaagcccttaaatcatattctaagtggataaaatgtcacatgtgaaagaagtgagataccagatacttgtgggaactaaaaatggttgggcgtgtccagagcatataaagaatgggcagcagatatagttggatgggtaggcagaagctagtgataaaatattggatatcttaaaccaagtccttgaactttattctggaagattgtgatttaatggatttaatggggctgtacgtcttaacataagaagggaagattatgttaagaagccatacatagggaaaaaataaattctctcggatcaagttacttcagtaaacatatttactaactgtattaatattatgactctttcatattccgatatgttgtttcctaaatttattttccaacagaaactttttcttggggagcatgggtttcaggatctcaaggagccagtagtccaattgttttagaaaatattgttaggctgggtgcagtggctcacatctgtaatcccagcacttcggaaggttgaggcaggcagatcacttgaggtcaggagtttgacaccagcctgtccaacatggtgaaaccccatctgtactaaaatacaaaaattagccaggtgtggtggtgtgtgcctgtaatcccagctactcgagaggctgaggcaggagcattgcttgaacatgggaggaggaggttgaagtgagccgagatcaccccactgcactccagcctgggagacagagtgagactccatctcaaaaaaaaaaaaaaaaaggaaaagaaaatattgttgtggaaaaacattgcaggaatgcttgaatctttggcatttttaaaaaatctaattcacagtgtgactttgggacaaataagttcatttgtttgggctttctcttgtggactaaggaggtagaagaaaattaagcagtttctgggatcccttctggcagtatattctcctagtctatggaaaatatgctataatcagcctgtctggaatatagatatcaagctcgaggtaaagttttactcgtgaggattaaatcagtgagaagtagcatatttaagaaaaaaatatacaatcaacttgagcactctaataatggtttagtgctcattgcttgaaggaataatttttgacaaggtcctgattttaaaggctaatgttcattttttgcctcgaccataagtaagagctagaacctgtagtatataggtcaacagattctaaaatatatttcagtatgtgctcaccaaatcaattagattttttaagtgaaaatgaaaacctctttgagttcagtcctaggctagctggtaaagatggaggaatcatgtgctcatgactagtcctcttccaccggtatgtcaagtattaagagaaagaagaaagacgtttccaaataacttgggatttggggactttggcttaatttgtacttgtatttgtttccttagactataagccacggattaagtttttctgtcattaaggcaccattaactattagaacaggttaacattaaccaatagaacaggtatacctttgatttccatgaattatggaagacaggcatttctttttttttttttttttttttttttttgatggagtctttctctgtcacctgggctggagtgcagtggtgtgatctcggctcactgcaagctccatctcctgggttcacaccattcttctgcctcagcctcccaagtagctgggactacaggtgcccaccaccatgtatggctaattttcttgtatttttagtagagacagggtttcactgtgttagccaggatggtctcgatctcctgaccttgtgatccgcccacctcggcctcccacagtgctgggattacaggcgtgagcaactgtgcccggccaagacaggtatttcttttcatattttataaattagaaaaccaaggtttagaaatcttagagagcatacccaaggtcctaaaaagtgaaaagctgcaaaattggaaatgcagcttaagtcctctcagtatgcgcagcgttatacctcattttctaaaagatagcatttctcaagaaaatgtatacatactgtatgaaagtccctgtaaataatgcaaatgcttgttgaatttttaaaatgtattctgaaactcttgtcaaaataatagttagtttttaccaagtagcatcagtagccacattacatagcagaatttaaattataatggcttgaatcttcttactctttggcacaggtgagaccaggcaggcacactagggaggggcagatgtgagccgtgtaactatctcattcccttaggaagccctttttacaaaagcaaagttggcttctgtcatagttttgattcttctcaagtcagattctgagattaagacccaggctggcctgagactaggagaaggattatttgggaggttatcctggaaagcccaagtgaaggagtggagataataagacaggagagggaggaaagcaaacaaacaaaaaaagtgcattgatagggagaaactgctgctattaattgagctcaatcccactggagagtctctgagaaaccttttggtacgtggggatgctgggacgttattcactgactcctgtcctgtgttggttcagggtggactctaaggatattgactttcacacacttccaggttgcacctatatgtggccaagcaggctccctttgagcccaaggaagtccatgaagagacataagtttctgaggtgggaagctgtttactctaaatagtcaaactcaattgtggctgaactcagaagaatatttaggggagaaaaatacatgaagttctatttcctcattcacagggatcgtggcataaggcagactgcatgggttagggtagtttgggctgccagtaagtgtaacattctctgtgcgaaggccacattggttggttttctaaggatgcaggtgtgtctcatggcacaggaggccagagaagggctcagaaaggctgcagagcatgaacagaaccttactcattctgtctctcacttggtctccctcagtgtgctagctttccctctctcctttacacacaacactcacagacacacatgcacacacatacatgtacacacatgcattcacgcatgtgtgctcacacacagactagctttttctgtttttcttgtacatcttacatgttcctggtttaatcataagacaaatggcctctctcttctggtaacaattttatattcctggtcaagggagctaggttggcccacacatgagagggaacagtggaagtaggatgtgtaatgcccagaagaacaggcatcggaggagagcccaggagttgattctatatgtaaatctgttataataccaatccgaacaagctagtattctatcaaatagccaaatgcagaggtaagcaggaagtaagtaatatcttttgtgattttttaaaatgacacacagtagatgagctcagaacatatacagtacagtagccactgggcaaccattagataaacaagaaaagagccagaccatggggatgaaaccatctttaatcatggcaagtggaataatgtgtaaaaaagttatgctaatcataaaatggaaacgatacatgtccattttagaatcaaatggcacagaaaatatgtgagcatatcagcaccatctatctacattatacccttgagagcttgtagattctgagtttaacagcaccatatcatgaaaaatgacactggacaatttggattgtttttataccatgggtctcagtgagaaagtcagctttctctttcccaatgcaaataaagattagcaaatatatttaatatttatacctgttctggtgattcattttggcttttgaaagtgaactccaccataaaaagataaaaaccaatcttccttttctcattccttccattattcattcatttattgatattactatattataggcactgtgccactctctctgtagaagcgcctgacagtagaaacaagggcttcatcctcctggctatgatcatgaggctacaacataacactgtggctttttgagaattatttcacagcctatttccagagcaaagtaacaatgctgttttttttttggtttctattttcttgtttgtttgtttgtttatgaagtcaaactattatggtgatgttaccaacttctttcaaagcagaggccagggaatcaaggacgttgaggcttaataaaataaaagcaaagtatgtttgtatatttttcatgtgttaggactacaggtttccagaaaataaacctttagtgcataggcaattttatcattagagatttcaaaggggatatgcatttatcgctatcaacagagccggataaaaagatttttttctgactatttccataatgttccattatgtttttaaacatgaaaaatttattccaaaggccaggaaatcacaggactccaccaggtgtgataaggtcccaatctaataaaagtttaactatctctctggctattagtgtttatttattcaagaaaggtccagaatgttattttgaatattcagtgtattatcaataatcgtggggattgtgatgacagtagtggcaatgacaaaaataacatctgtattagtctgttttcacactgctgataaggacatacctgagactgctaagaaaaagaagtttaattggacttatagttccacatgtgtgaggaggcctcagaatcatggtggaaggcaaaaggcactttttttttttttttttgagacagagtcttgctttgctgcccaggctggagtgcagtggcacgatctcagctcaccacaacctccacctcctgggttcaagtgattcatcagccttccaagtagctgggactataggcgtgtgcctccgtgcctggctaatttttgtatttttagtggagatggggtttcactgtgttggccaggctggtctcgaacttctgaccttgtgatctgcctgcctcaggctcccaaagtgctgggattacaggggtgagccaccgcacccagctgaaaggcatttcttacatggcagtggcaagaaaaaatgaagaagaagcaaaagcagaaacccctaatagacccattagatctcatgagacttattgactaccacaaaaatagcacaggaaagactggcaccctggattcagttacctccccctcagtccctcctacaacacatgggaattctgggagatacaattcaagttgagatttgggtgaggacacagtcaaaccatatcattccgccactgactcctccaaatctcatgtcctcacatttcaaaaccaatcatgccttcccaatagtcccccaaagtcttaactcatttcgacattaactcaaaagtccacagtccaaagtctcatctgagacaaggcaagtcctttccacctatgagcctgtaaaatcaaaagcaagctagttgctttctagatacaataggattacaggttttggacaaatacagcggttccaaaggggagaaattggccgaaacaaaggagctacagggaccatgcaagtctgaaatccagtggggcagtcaaattttaaagctccaaaatgatctcctttgaccccagatctgacatccaggtcacgctgatgcaaggggtgggttcccatggtcttgggcaactcctcccctatggctttacagggtacagcctccttcccagatgtttcatgggctggagttgagtgtctgtggcttttccaagttcaaggtgcaagctgtcagtggatctaacattttggggtctggaggatggtggccctcttcttacagctccactaggcagtgccccagttaggactctgtgtggggactccaaccccacatttcccttcctcactgccctagcagaggttctccatgagggccccatccctgcagcaaatttctgccttagcatctaggcgcttccatacatcctctgaaatctaggcagaggttcccaaacctcaattcctgacttctgtgtacctgcaggctcaacaccacatggaatctaccaaggcttagggcttacaccctctgaaaccacagcccaagctgtacattggcccctttcagccatggctggagaggctggtacacaggacaccaagtccctaggctgcacgtagcacggggaacctgggcctggcccatgaaaccactttttcctcatgggcctccaggcctgtgatgggaggggctgctgtgaaggtctttgacatgacctggagacattttccccatggtcttggggataacattaggctccttgctggttatgcaaatttctgcagccggcttgaatttctccccagaaaatgggtttttcttttcttttttttttttttttccgagacaaagtctcactctgtcacccaggctggaatgcagtggtgtgatctcagctcactgcaagcttcaactcctgggttcacgccattctcctgcctcagcctcccgagtagctgggactacaggtgcctgccaccatgtccgactaatttttttgtatttttagtagagacagggtttcaccatgttagccaggatggtctcgatctcctgaccttgtgatctgcccgcctcggcctcccaaagtgctgggattacaggcatgagccaccatgcccggccaggtttttcttttctatcacatagtcaggctgcaaattttccaaacctttatactctgcttcctttctaaaactgaatgcctttaacagtacctaagttacctcttgaatgttttgctgcttagaaatttattccgccagatgccgtaaatcaactctctcaagttcaaagttccacacatctctagggcaggggcaaaatgccaccagtctctttgctaaacataacaaaacttacctttgatcctgttcccaataatttcctcatctccatctgagaccacctcagcctggattttattgttcatgtcactatcagcattttggacaaagccattcaacaagtctctaggaggttccaaactttcccacattttctgatcttctcagccctccaaactgttccagcctctgcctgttacccagttccaaagttgcttcacacattttcgggtatcttttcagcagcgccccactctactgctaccaatttactgtattagtctgttttcatgctgctgatgaagacatacctgacactgggaagaaaaaggaagtttaattggacttacagtttcacatgactgaggaggcctcagaatcatggtggaaggtgaaagacacttcttacgtggcagcagcaagagaaaatgaggaagaagtaaaagcagaaacccctgataaacccatcagatctcatgagacttatttactatcacaagaatagagtgggaaagaccagcccccatgattcaattacctccccctgagttcctcccacaacatgtgggaattctgggagatacaactcaagttgagatttgggcagggacacagccaaaccatatcaatatcttacttttgtattaaataatatgattcctgaagtagttactcatatactgccccatttatttctcataagaactctgggagaaaaaatctatcacctctgttttactgatgagtaaatgtagactgaaagaattcagatgatgtgtaagagaacacatagattataatgacaaagctatagctggaattcagtttctgtttggggatgttgttttgttttattttgatcttagaaaaaactaaaagttatcataaaagactttattctaactgcaaattcaaagataatgtttattcatgcctaggacaaaatttctattaacaatcaaatattacagaaggttgtgaatttttgatgacctgattatgtttacataagtctctaccttttctaaacctcataaatatgaaacctttgggtgaactcttcccagaactgatttccataaacttactgaaaatgagtaggaagaaagagctcaagggacaagtacttattgtgtatactctttagtgatacagaaataaaagaaaagttaaatacctatatttataaaattgaatcttttaaagtcagctgacaggtcaaaatgcaggtaacatttttaagcttcatgcttaaaaaaataagctttatttaaaaaaaaaaaaatacttacttggagccaggcacaatggctcatatgtgtaatcccagctactcaggaggctgaggcaagaggatcacttgagcccaggagatcccatctcaaaaaaaaaaaaagcaccttactttttacttcattgcctcagtgatagcagaccaacagggcattggtaagaatagttttaactatactcacaatcatatactggcttcagttgtactagcaacagttaaaattgaagacacattaagcatgtaataaatgtgaactatcaataagtgaaaccattagaactagtattaaaccgtttcattcttaacatcctttacagataaagaatcagagactgagagagcttaataataccactattcagttagcaagctattctgtggtttaaagagatcagtattgcctttaactttctggcttttagaatttacgcaattctctatcaacatggaggctcaacctgattttggggcattgtgtaagccagtagttttcaacctggagtgattttgacccccaggtgacatttggcaatgcctagagacatttgtgattgtcccatttggttggggttgctatggtatctaatgggagaggccagtaacgctggtgaacatcctacaaagcactgcagagcccctggcaaagaattttccagcccaaaacgtcagtggtgctgaggttgagaaaccttgatatagccctctaagactgaatattaatgaaaatgtttatttaaatcagtttgtatggtcccagtgccacttagaattatatttcttaacaagttagagctcaatttcctctgcccaggcctccttaggatacagaagaataagccagtagtacccttacacggaacaggatagggcaatcatatgattctgaatgccaaggggactttcagattgatggtttcgtaaagtgactgacaccttggacggttcccaagaaaattactaaaacttgagtcttttgcaggtatgcaaaacccatgaatttcataaaaaataaatctttatttcaaagatgggacttttaaagtttaaagtggccttcgggtggagaaagaactaggaatcaaaatttcaatgggcaataaaaacaagtgataatttcctttgattctcacaatcaagatgaagcaggattgtgataagagcttagcatttctatccactcgttgaaatttatcaaatgcctctccctgacttctcgcccttacactgaagtagatatccaaagacttcagatatatacactatggacaagtatttcccctcacttgcagaaattcaagtggcaccagcagtttggagacagaagtctcagtgggcgcaaggaagctggggtctggggcctgactcttccctgccattttggtgccccttcccgcctacccacgccctaccccaatgtgtggcattatccagggggttattaaatattgaaatacagcttgacaaacatctgataacaataggtggccaaggccgggcgcggtggttcatgcctataatcccagcactttgagaggccgaggcggatggatcacctgaggtcaggagtttgagaccagcctggacaacatggtgaaaccccgtctctactaaaaatacaaaattatctgggcctgatggcgggcccctgtaatcccagctactcaggaggctgaggcaggagaattgcttgaacccaggaggcggagcttgcagtgagtcaagatcgcgccactgcactgcagcctgagcgaaagagtgagactctgtctcagaaaaataaaaataaataaataaataaataaaaaggtggccaccagctgtgtcaaaatcaactagttaaaaggtggaaattaaatatgacagtggaaaaagatttctagttggagaatgaaaacttcctaaaatctaagatggctgccattaaatgatattcagattcttcccgggttcttgcttttggatgaataaatggctttttcttcctccaaagttctaatctgatgaatgtgtaatggagataaatgttttggaaatatctccatttgcctggctcctcggtgtctctgtgtaggactttctccccactcaggccaagcttccatctgtgagtggaagatggggaggaggcgaggaccgcgaaggtcacaataagaatgcaaatacagcagtaaaaacagtttaatattcaccctctgtcagcaaaaataggctttcctagtctgcagcaatgtactggaacagacgtaaaagacaggcgttgccaggaaatagggatttactaaattcctttatattcccatttaatatatcaagaggcagtcctggtatccttgatcatatagcatttcccaacaaggaggttagaaccagacaggaagaggagagaaatccacacatactcaccccagtaggggaagaaacaaatctctgaagctctgagcacttacatgactcaccgtggcaggaactaagctacccaagacaacttttaaaattattgcatccacagagtttaccaaatgagtctgaaatttaacatgtttcttttcccagcattttaaaatcaattcctcctttgaaactcctctccaattactcttcatctgtataaattcaaatatattttcattcatttactcattcaacaaatatttattgagcatctatcacgcacagggtgctgcgaatgtgccagtgagtaggtacagataaagtccctgccctcttgaaacttactttttagttggagagaaaaagaaaagtaaatatcatttctggctgtgataaatttcatgaagaaaaacaaacaagaacttcctggtcctcgtgctcactcccttccaacagttttgggggacaccaaagggacagagaggagtcaagccccagaccccagctgccttgtgcccactgggacttctgtctccaaaatgctggtgccacttgagtttttgcgagtgaggggaaatatctgtccatggtgtatgtgtccgaaatctttggacatctacttcagtgggagggagaggagtcctggagagggctcagtacatttcaaggtggtgagagcagtgctaacacgcagcgttctctgacttcctaatgtacctccctctctgccatcagactaaaatttttcaatagctgcttgatgcaatcactttctttttcaagacccgcaactgctcatactgcctgatgctacctcccaggccttgaacatagcttcaaataatgtgtttaacctatgcctggccgtaaagcctcccctctcaccacgccacctcttctaaagtcacataaaaatcccagttctctgtccacacatctaagaatggacactcctctgtcttctcttccctatctttctaaatctgacccttttattaagattcaaccagtttcctgcctgctctattccattcaacacccagaccacagtgatacctcctttgtctaatctttcacaatacactttagcacgttacagattcccaaatgtggaaagaaccatgctggtcttttagtctagcattaaatacaatgtgagtaacacagttataacctttctaataggtagtctcagactttcacactctttcctaatgtttttcaaataagtacatttttaaaaatgcaaatacacagtggtaaattaaattattttgattattaagcattcataatcataaagctatgaataaatctgtatgcttggaactcttatataatcgtaaaagaaaacaaacttaaaaattatattcaaactgaataacaaaattcattcattccaaatgatcaacattaatttaatgtgacatgtaatattttgctaaagtaaagtacctattctcaatgtaaatgtggtattggctactatcaaatgcaatatgtaatagtggggccttacttacctacaaaggccatctctgtcattttttcttaaagaaccttaaaaaaaaaaagttgtagcttcttactaaagaaatctccaatgctaacacaatataagcgtgacttaattacagggtgataatctagatcatgtggacttttcagcccattaaaaattaaaatgaaaaatctaaccattttcaaagaaacgcacatcttttatcatatgccttcatataacaagggtccagaaatccatgttataaaggtttgtactgattcaggtgtttatattttgactctgaaaatggatctatgtaaaatgtgctgacaaaaagggctatttttaagttttgtgcatttttccttatagtacctaaaaatgcatgtagcacatgctggatgttaactaaagattccttgaatatattatctctatttattttatttcttctgatgtgaatttgaaaaaacatttatttacagaccactaaaaatctcccaggaagctgagttagtggtgactgtttgattctaaccttctgaacaaatgttttcatgaactccatgaagctttttaataaacttactcctcacagtgatgcaagtcaaatttaagacagaagaaactaaacgttcatcggtataagaaaatctaagtcaaggtggccaaaaaatcaagcaatcttttaagaatgttgaatcaaatgtggttgttggtgaatgaaaatttcttctattgcagacaattatttgaagggtacatctttttaatactatttccaactgtctcctagagtgatagtagccctgttaaacaattagtaaaacaaacaacaacaaaaaacacattaggccaagtgcagtgactcacgcctgtaattccaactctttggaaggccaaggaggaaggatcacttgaagccaggagttcaagaccagtctgggaaacatagtgagacccccttctacaaaaaaataaaaacttagcccatgaggtggcacgcatctatagtcccaactactcgggaggctgaggcaggaggatcgcttgagcccaggaggtcaaggctgcaatgagctgtgatcatgccactgtactccagcctgggaaacagagtgagattatatatataaaaaaaaatccctcctatctttgaaattttcatagagccacctgtagtttggatgtttcccagggaacacaataaaaacaaattcaataatcctcaactaaaaggcctgatatcatgtttatgccagttttttttcctgagtattttaactttttttctctacttagtttcatcaattaaaggcttattgttaagggagaaaagcattaggacccctagtaagatgctccagggagtgtgttttcagctcaatgtaagaaaaaaatttttgaaccgtcagtactctttgaaactctgtttattccaagatagtgaggtgtctcttaatataacagcttatacaggggctgaatgatgccagctttgggcttaatgttgtttttaggttatctagacagttctgattttagaatgttcataagttaggtctgaattaataagccaataggttcttatttcaaaagaatatatatatacacacatatatatacatatatcaaaaatgtgagctaaattcccatttatctttagtattctccatatctctttcatttccagagtaatggtccttgggaagataatagctagcataatgagacctggtacttacacagcactcaataagtacaagactctctaaatgttcattcctcacaaaactctatgagatacattatagtgctattccccttctacagataatggaactgggacactaaaggttaagtgatgtgctgatacttccaaagctcataaacagaagagtcatccagagccaaactattttggcttcaaagtccaggcacttagacagtgacgctatccactcactagtaccttctggagaagccactaggatagtctgagaatattactggactactaaacaaattgagattcttgaaagctgaattgtgttgtgtttttaccccatcatcacaaacctttacatttgttcagaccaggaaaataaatgtcagatgccaatgtagtgacactatcaactcccaggtgtaatcaagtagagactgagatccctacaccaagtcaaaaacttttatttctttgcatactatggaccatggtgtcaggaataatcacaacccaaagaatcagggaatacagaattttagagctggaagcatttttaggaattgttcattctttctttgttattacagaaatgaggatactgacttctactgagaggatcgtatttcaagaccatgtgatggctttataactgctctttctgactctactgttaactctctcatgtccaggctcataccagccaaaggaaattcgtaataaaatttgatcctctctataattgctattcctgattccactgttaactctctcatgtctaggctgataccagacaaaggaaattagtaataaaatttgatcatctcattctgcttctttacactccttcaaatgttctgcattactttgagacttaatcaaagtccttcagttaaagcatcagttctttgaagacctggtccctgattgtctgcagtctcatcagctcctacttgctcctcttgaaatctggactccagtcactctgagtgtcactccagaccccccagaacatcacactcttacctccatcctttacacatctctttccttctactttcacagcacttcccctggactcttctgtctgcctccacttcatttttcagaatgcagcttaatacctccaaagaaagtcacctctaacccagaggtcacatttgttctgtttagttattcaaactcccaatttaaacaagtctgcctatattgtttcctaacctatgacagatataaagagtaagttatatttctgtgcattaggatacaagaagagcaattagaatttgcacaatgcaacatgacatctccagtaacaatatattgcaaggattcactacttataaaaagggaaacaaggagggcagatcacaaggtcaggagatcgagagcatcctggccaacatggtgaaactccatctctactaaaaatgtaaaaataagctgggcatggtggcacgtgcctgtaatcccagctacttggcaggctgaggcaaaagaatcgcttgaaccggggagttggaggtcgcaatgagccgagatggtgccactgcaatccagcctggtgacagagcaagactctgtctcaaaaaaaaaagaaacaagttaatgaaacaaaattttctgagatcatttggtaaaggtgtcagattggtgcagcgtaatccagtgattgatgtaggtaattttgaaacctgagtcagcaagaaatagcaattatatttaatgtaatatgatgaaggaggcagaaaactgcaataacttagaatgatttccactaaagatacttaaaataaaatgagttttagtgcttatagcaaggaaaactccatttatgtttaacatctacttcttttaaaaatgtatacgatatagggggaagatggtaacagttagaacacccaaattctggtctggtaattgacactaaattagtgagtgactttgagtgagtaagccatatgatatctttgactcttagtataatgcagtggctaggaacaggggctataggctcaaatctcattctattccattactttcaagctccatagccttctgttactttaattgctctaagcctcactttcctcctttgaaaatggaaagaataataccttcctcataggattactgtgacaaacagaaggcacaacacttacaaaacactcagcatagaatatgacacataggaagagctcaaacagctgttgttgttgttgtcgtaatataagtagttacagtgagggagatagatcacatgctctccgaggtcttctcaaattctaaaattctgtggttctatgaacaactcgctcccaaatgatgtcagataaatgagatctcactgtatactgggcaataaaatcaatgtggtcaattttaaatcgtaccctgtaaggtaaggttgagcaggtcatgaattattcaaaactttggttacactcaatatatttctatttgatcatggaatgcatagaactatttaaaagagcatttttaaccttctcatattatgtttaatgattaaaatgagtttgatctttccgtgttcactaagggaaaagaaatggagcaatgctggatagtttatatatgtgccccacttaatcattagcgatttaggtgaaatcatcgagcaactttttgggtaataaaaaatgcaagcaggatatacagttttggcccagataacagacatgcctataaatgagagccagtggcacatcatctccttatgaagctttttcagaatttcaggtagttcaggtccatatgtgctttgaaattctaagggtgagaagatgactatcacgtgtttttccaattatatcttaattttcaaaataggcttattgcagcattgatgtctaattagagttgccggacacagtggctacagtccaatgctataataatctaattaactaaactctccacttatcatgtaagtgcctcctcacctaccacacacttcaccatttaaagtgatatccttttcctttcttcttttttaaatgaagaatttgttcagggagacatttggattgttcagtggtaaaaaaaaaaaagctccaaaaaaaaagcaaataagaaagtaagagtttgtactggacagcagaagtgacatcacctgggcaggcagagcacctgttgaaatccaagacttcatttacggactagctgtgtgactttggcaaattactaaatctccctgagacttagcatctttatttgcaagctgggaataatcggaggaagttaactgagaagctattgggacttaagcttcagggccttttatttgtgtagggcatatatgttcacatagtcatatgcttatgttaagtttacaatgttaagataccttaactgtgactagctaagagctctgtctctttcagtatgactttcttccatcacatggtgaagatctttggagaaaccttgaacaggtttggtgtcatgctaagggaaagttgagatccataaatttgtgtttagtgacaatatttatgtgctctgaagttatttctctatattgtcacatattgctaggcatctagtgtaggaataattttcaagtgcactcccagtgcccatgttcagacctacatatgtatttgtatttaaatatttcaatcttttcttaaagagagattccaaaatgacattaaattcaagctccagaaaacctagattttcctttggggataatgatatgctgagaccagctcagctggggagaccctaacccagcagtgctagaggaattaaagacacacacacagaaatatagaggtgtgaagtgggaaatcaggggtctcacagccttcagagctgagagccccgaacagggatttacccacatatttattaacagcaaaccagtcattagcattgtttctatagatattaaattaactaaaagtatccctcatgggaaacaaagggatgggttgaattaaaggaataggatgggctagttaactgcagcaggaacttatccttaaggcacagatagctcatgctattgtttgtgacttaagaatgcctttaagcggttttctgccctgggcgggctaagtgttccttgccttcattctggtaaacccacaaccttccagcatgggtgttagggccattatgaacatgttacagtgctgcagagattttatttatggccagttttggggccagtttatggccagattttgaggggcctgctcccaaaaatgacacctaccttatactatttctatgaagattaatgtgaaagttttttcctactttcctttgtttgttctgttttgcattctcattcttattctgaacaactctataataaggacatgaagattatctaattcagagtttttatgttttattcccaagcacttctaccccctcaaataaaaccataggcgtgatcttgatgcatgtaataagccagtaattgacagaatttatatgaagcttaaccctcactgtttgggtatatccatctctcatttctgtaaatctccaaagaaccatggcgagcctcaggattccatacgctccatttgaaaacccatgatttaactcaattccctctttttataatggaaactaatttcagagaggctaagtaacctcttgtcttcccattctatgttcaattcaccatatcttttctgtaggtttatgatagcaaacaattgttattatttattagttttaaacacaaagctacctgttttaaacaaaacaatttataaatattcttcatgtcatggaatatttattctagaggaattaaatctttaaatataagtgtttccaaactggaagaaaatacagaagactacatgtacaaatgaggctttgaggtaacctattaccaaagccatcagagatctgtaaaaatctgaaacttttgtgtgtaaatgtacaacatataatgttgttctccacatactaaattggcaaattatgtttgcaacagttatggcacatacaaactgctcttagaaatataaattatgcaaagaatgatgactcagaagcccacagaagagcacatttcaatggccccagacttccaaaaaaaaatttcaggctcctggtaatgagagaaatgcaaattaagtagcaatgaagctctcacttcacatccatcagagtggcaaaaaattaaaagtgataataactactgttggtggggatgagttaaaagggtactttcatttatttctggcaaaaatgaaaattgttataggctttcagaaaacaattttgaaatatctattccaataaaaaaaaaatgcaagtcctctttccagggccacagcatgactttcatgggccctagaaacttgtgcctgtgttgtcttctttctctattaatattatatatatatgtgataagatttggctgtgtgcccacccaaatctcatcttgaattgtaactcccataattcccatgtgttgtgggagggacctggtgggagacaattgaatcatgggggcagttcccccatactgttctcgtggtagtgaataagtctcacgagatctgatggttttataaggggtgtccggttttgcttggctctcattctctcttgcctgccaccatgtaagatgtctctttgctcttcctttatctttccccatgattgtgagcctccctagccatgtggaactgtgagtccattaaacctctttcctttataaattactcagtctcgagtttgtctttattagcagcatgagaatgaactgataatacacacacacacatacacgtactcatagacatatatatgtatgtatacatatacagacagaaaatatattttatgattgtgttggtgtaaagaggaatataagtcaaactgaatttattattactggatttactttttcttaaatttttaagataaaaatattccctgaatccctaacatcttgtgggccctgggcacgatgccttttgtgctcaacaatacaagccctaactcctcactcagaaatttgtctactgaaaccagaactttagtgatgtttactttcagcattttggtagtagcaaaaactagacacaaagtgaaaaccttcagtgggcaataattgagtaaatttggttagtatgataccattttagaaaaaaaatgtaagccaacacaactgtgtgtatgtgagttgtctgtgttagttatctattgcaatctaacaagcctccctaaaaattaagtgcttaaaacaacaatcactttatttacccatgattcgaataggttatcagtctgagataggctcttctgaataattctttgctagtcttccatagggtaattcatgcagctgtagtcaaatgacagcttgcctggggctgggcagtctgtgatgtccatgtccttccacacaagtctgatggttagtctgttcctcagctgggccatatgctgccagcaagccagcccagctttcttcacataggtttgaaaagcaacttttaaaacctaaggttgcatcactgatatgatttgactgtgtccccacccaaatctcaccttaaattgtagctcccataattcccacgtgttgtagagggacccagtgggaaataattgaatcatgggagacaatttcccctatactattctcgtggtagtgaataagtctccaagatctgatggttttataaggggtttcccctttcacttgggtctcattctctcttgcctgccgccatgtaagatgtgactttcaccttccgccatgattgtgaagcctccccagccatgtggaacagtgagtcaattaaacctccttcttttataaattacccagtctcaggtatatctttattaacatcatgagaacagactaatcaaatcacatttgctaatgtctctttaatcaaaacaagccatatgatcagacccagaatcatggtgggagggccctgacaagagcacagatgagaggaggtatgattcattaaagaacactactgtaaaattctgtcaatgtgtgcaattgcatatttatgtacacattatcatgttggtatggtaaagatcagcaggaaaaaaagaaaatggaactattaataattttattcagatagagtgaagttacttactgtttaataacagtttatattacttatatattaattcattaaaagctgtttatcaagtgcctactctatgctagatgagtgctgagtatagaacaatcttctggaaaagtgaacatcaagggacatgcccacaactaagaccgtttacttagttattgtaacaccatcttttgaggattaaaaaaagtagatatgtacttgtgcatcataatttcttagcctaggacaaatgctttattacagttaaatactcaatatgatttgtgtgaccccttggagcttgggtgaagccagtgtacagggaaaggagaaaagccaatacaacagtgcattgtcaagttgactgtggtcagttgagtcaggttttcagtcccagggcagctccctgaggaaacctctgaaacacatcgcagatctttctgcccaggagtacacatggatgaaactgattctcatcccctttgttcgagtgactccaagggcattgactttaccagatttttggcatatgcatgcatgaggccacatcaatttctgagactaaccctgctctgcagtatcaatgaaaccctcagggcaagaagcaagaggaacagggcagatgctgtatctgtgattagctaatcaaaacctaggagacattggttaccacagcagtggctgcagtaagaggtggggccaaaaggatataaattagtatacaagaagtgtctgatacagcccaccccttgcagaactgagacttgctcatgtcttctctcaagtctaatctgtcataaagtcatcttcaatctctgcaaagtttcaatacaaaagattggcagaataagtgataatccctgtattacagctgaatccaaggcaataattgatattatttatcctttccttcaactcatcctaagccagtatttcagctggttgcttgactgatgcagtgacccagactttcatctcctggagatctaggtccttagttaccttgctcttcaccagccactaatgctgcggttgcttaatcaccattaacactgagcacagaagcagcaacaggtattacattcaatcccctgggctccagacattcttctccctgcctgctagggggcagcagcgctgtctcctcagctcattcagataagctacctttgccagaacagtagtaactcctttctttgcttgatggtccactggcatgaggagctttgtttttgtttttatttttgtttttttgttttgtctttatttcttctaaacacacacacacacacacacaacaacaacgggatacatgtgcagaacatgcaggtttgttacataggtctacgtgtgccatggtggtttgctgtacctattgacctatcctctaagttccctccctgcaccccacacaccccaacaggccctggtgtgtgttgttcccctctccgtgtccatgtgttctcaatattcaactctcacttatgagtgagaacatgcggtgttgggttttcttttcctgtgttagtttgctaaggatgatggcttccagcttcatctatgtccctgaaaaggacataatctcattcctttttatggctgtgtagtattccatggtgtatagtgccacattttctttatccagtctatcactgatgggcattttggttggttctatgtctttgctattgtaaatagtgctgcagtaaacatgtgtgcatgtgtctttataatagaatgatttataatactttgggtatgtacccagtaatgggactgctgagtcaaatggtgtttctggttctagatccttgaggaattgccacactgtcttccacaagggttgaactaattttcattcctaccaacagtgtgaaagtgttcctatttctccacagcctcaccagcatctattgttttctgactttttaataatcgccattctgactggtgtgagatggtgtctcattgtggtttagatttgcatttctctgacgatcagtgaatttgagctttttttcatatgtttgttgggagcctaaatgtcttcttttgaaaagtgtctgttcatattatttgcccactttttgatggggttgtttgattttttcttataaatatgtttaagttccttgtaaattctggatattagacctttgtcagatgggtagattccaaaaattttctcccattctgtaggttgcctgttcactctgatgatagttccttttgctgtgcagacgctcttcagtttaattagatcccatttgtcaactttggcttttgttgcaattgcttttgacatttttgtcatgaagtctctgcccatgcctatgtcctgaatggtattgcataggttttcttctagggtttttatgattttgggttttaaatttaagtctttagtccatcttgagataattctgtataaggtgtaaggaaggggtccagtttcagttttctgcatatggctagccaattttcccaggaccatttactgaataggagatcgtttccccattgcttgtttttgtcgcatttgtcaaagagcagatgcttgtagatgtatggtgttatttctgaggtctctgttctgttccattggtctatatgtctgtttcggtaccagtacatgctcttttggttactgtagccttgtagtatagtttgaagtcagatagcatgatgcctccacctttgttctttttacttaggattgtcttggctatttggggtcttctttgattccatatgaaattttaaacatttataattctgtgaagaatgtcaatggtagtttgatgggaatagtattgaatctataaattactttgggcagtatggccattttcatgataatgattcttcctctccgtgaggatgaaatgtttttccatttgttgatgtcctgtcttattttcttgagcaatggtttgtagttctccttgaagaggtccttcacgtcccttgtaagttgtattcctaggtttttattctctttgtagtaattgtgagtgggagttcattcatgatttggctctctgcttacctattgttggtgtaaaggaattcttgtgatttttgcacattgattttgtatcctgagattttgctgaagttgcttatcagttcaagatgttttggggctgagatgatggggttttctaaatataaaatcatgtcatctgcaaacagagacaactggacttctaacctgcggagctttaagtgaccaggtcacagccattctttgaagtaaaggggaacccatatacttgacagatatggtaagaccaatgcctcccatggcaaatcctgctgaggtctataaaaagtagtcaccacagcagttctggtataagggatgagtcaagggatttgaagcagtgggctcgatgtgtctgatatagtaatatgtaatctacatagaggagttaattatccacaccatgtcttcttttcttcccccatttcttatcacatacaccctggaatcagagctatttatttaaataacacacgcattatatttgaattatttggttgcacatgctgtataaagcaatacattatttttattagaatgtcaatgatcatataattgtttgataaaaatttttcttttatggaaattttctctgaggggggaatatcacaattttcatagaaggatttagaagttgcactatataatgagaaatgagtactgcagatccttagcaaatatgactttattcttccacttttaacaacataaatgccttggaaaaaatcactcaatttgatcatgattgaaattcccggtggaaaaatatatttgggatttgttaattatttttcagtggggttctcttttttgagagagctgagtgatatggtttgactgtgtccccacccaaatctcaccttaaattgtaataatccccatatgtcaagggcagggccaggtggaaatgattgaatcatggggtggtttccaccatgctgttcttgtggtagtgaataagtctcatgagatctgattgttttataaataggagttcccctgcacaatctctcttgcctgccaccatgtaagatatgcctttgctcttccttcatcttccaccatgattgtgaggcctccccagctatgtggaactgggagtccattaaactatttcctttataaattacccagtctcatatgtctttattagcagcatgagaatggactaaatacactgagcatgagtggaagaaagtctcaaactgaagtgaagaaaaagggaaggggctgatgtggggagaggagcagtccctcagcagcaatgtcaagttcatttgctttgcctctggccactgaggaaagacaatgccaggcaactgtagagctgggccagcaccttctgaaacgatcttgttccccaaataaccacaacagatattatatagcaggtaaactaacaagtaaaggcagaagtgaaaaaaattgttctgtgaaaatatatgtactatatgtacatatagatatagtatatacgtttgtgtgtgtacttaaaccacaatgctgtaagaaatcataaatttatctgaaaatactgggtaaggagatagtatccataaaaaatactattcccatagaatttaaatattcagtgagctttcactgactaacttgcatacaccaggcactgtgctatcaggtatggatgtagcaaaaattatgatatggttcttatgtgcattaaggtaaacattatccagaaatatgtaggctttcttgttttcttaaattagaagacaaacagtataggtttctcctgttagctcaggtatatcattatcaggttcaactattctagcaggtggtaataaattgtttttcttctcatgctgtctgctgtaaataggatcaataaagtcagaataaagatcacaaaaactttcattacagtgcgaatagtttaatgcagcagtttctatgtgcctagattttggcagatgctttaagattctggaatatttgaaaatattattacttctctggtccttgattgtgtaaggaatgctgaagttattgactccttaatctctactgaaggggcttactttgaagactagcaatttcattatttgattctgattctgagatgactttaacagaatctcaagcaatgtaagccacatttagcaatcatagcaatagtctgatatttttgaaacctgtcctattataaaacaagcctacatttatataatcctcatatctcaaaagaagttggagaaagccactgcctgggaagttccttatcctgaacctaaatcagatgctaatatcttgttgctgcattggttttaacagtagactctcaaggatgctaatatcttgttgctgtttcggtttgaaaaaagactctcaacttgtattcatcgatgggtgttctctatttcttaacaggattatctatatttgaatcttcttttaactctgactgaagagctctgaaatcaccaataatgtcttcattactacatcaatacttaaataatggacaagaaattataaaggcttagcaaagacattcagattattatggccttttgaaatatgcaccataaactattaacttagagtgcttggccaaagtaaaacttgaatatcccatcaaattcctcatttttatgagaaaatttatactcagaaaatttaagtggcaaataatccaagtcatatggactgtaagttacagaaccaagtcacaaaaaggagttctgattcttgatctaaaagtcttcccactgtgtccttctatggccttcagttttgggcggtgtattttgtttgttttttatttgagttatatgcgagtttaaacacaattctttctgctatgggaaacggcctgtttcattttcaaattttgaagctcacattttttaatggtttattttttcattaaatttaaaaggctttatttaacaattaaaaatcagtcctattgcctcattcattgaattccataaattacagtaaaacattttaaagctgtaaattagtatacaaacgtagctatctttttattatttgaatcatagaatgactttaaatgactaaagtttgcatttagaattaacactttttaatttaaaaatctgatttttcatttaactgtgatttgtttagctaaaaacaaatggagaatttgaatttctttactccattttactttcctcaacacacacacacacacacacacacacacacacacacagagatataaataagaaaaatctacacttccaagagtcatttccttagtgaatcacatccctcacttttctccacactgtccttcaacaatgagaataaaatacgccttcttcctccataatatcagtagaaacaattcagcacaatgtttaaacaagtgttaggaccctgtagccagaattcctgtgttcaaatcctggctctgcctttttctaggtgagcaatcctagacaagttaactattaaataattgctttgagcagatggcagtgacagagcccttgaagaatagctctctctccaggccagcagaagaaaaatgacagtgcaagacacaggataggacagtcaagaggcaaaaagaaatacaagctaagggcacagaaatgaagagaagaatgtttccatgaggagtcagccaacaatgacaatgtctactaaactcctagagaatgagaacgtagtgaaagcccagggtaggtatcagtgacattcttgaaggtgagacagcagtgataacattctgacttgaggggctaaggtgtaagtggtgaagaagcaggagttcccctagattggacagggaaacgggactagcatgtagcacgtgtctacctgcccttgaatctaagatcgcagagaccagtgcagatgaatagagaagatgcagccaatggaaaaaagagaggaggtaaatggagaaaaccattaaatgatctcaggacaagcatggaatcacatggttctggggaggaagtgtaaggaaagtccttctcttgtcttccttgcaacctcctattcatcctataagacttagcataaaaccacttcacaaataaagtatttccaaactgtcctaaatcaacttatccagtttatttttctaaagtctctgagtactttgttttataatcttttataacatctaacaaattatatatattatttagttaacatgcctgccccatgtattacatagcaaattccccagagctaggatttatgacttttttacttttttcttcctagggcaaggtatagtgttagatactactaccacattagtaggtgttcctaaaataattagcaataagaaaggggctgaggtggtggtttgcgcctgtaatcccagcactttgggagggccaaggtcaggtgtaagagaccagtctggccaacatggtgaaaccctgtctctactaaaagcacaaaaattagccaggcatgctggcgcgtgcctgtaatcccagctaccaaggcaggagaatcgcttgaacccgggaggtggaggtttcagtgagccgagatcgcgtcattgcactccagcctaggcgacgagcaaaactctatctcaaaagaaaagaaaaaaaaggaaatgagagagagaaggttagagatgggaatggagactcaggagatgcagcaacataagcaacctctataggatctgagcaagatgaactggatgctaagcttcttcgtccagacccattaaattgaggaagcgtgtttgtagcatgcctgttggattttgtaggctttctctccttcttagagttttctataacctaatagtaaccctgaataaaatacaagtagagttgtttaggtttagtcatgtaatacaggaaaatttgatatattgtggagtgcaggtcaaagaataccaagaatggatattgaagtctccaggaaatatggcaatcacagtgatacaggggcaaagagtcctggttttgtgactggcattgcaatagtatggattatttttttttttctttgaaacagtgccttgaagccaatttatagagggatttgggaaggatcaaacaaaagaaaaaatgggctgggtatggggaagggagagagtagaaatgaaataataaatgtagatatactctggctttcagaaactttttgaaggacttatcaagtaaaagaactacaagctattgtaatttcaacaagaaattgaaactttgtcttttttaaaaaaatcctaatttcctccctccccttgaggcttggacaggtaaataaacccattagggggctataatgaataacatctcatacagaaattatatgcagggaaagatcatgacacaatattagcatacagaatatctgtttttaaatccacattctctctaccatcttcatttgctgtgtgctgataatgagacaatggttcctaagggaaataatgtagtttactcagggtattcattcaagctctaaaaaaaaaaaatccaaacagacagagaacatatgaggttaatattcaagtgttaatgaggacttaggtattgtgaagcttatattgtactaattaaaaataattgcatggtcctagaattagagagctttcactgaggagggtctcaaggtcattgccgcctctctggatttccaacttggctgtgcacaaacctcagtggttaccttaacaggaataattaggttctgggcaaacacattcctgcaaccaaattcactagagtctgttgagataaaaaagtcagtttcatggtttctaatgagaattacctctttccaatatagaaacttatttttgaaagcaagattaggatcagaaggtggtttcatggttaaaaagggagcagaataaggagggccccagagaccatcctacactgaacaataccaacccagataagccccatataaactatatcgccgctatgcctacgttttacatgaaaaggcttctttatccattcaagggtagaaattcccagaaaaccaatccctcattttagcatcttataacctggtccctacagcaagtatgtacaagtatatagtaagcatgtgatcgcctccagtataaaagagcagaaaggtgagggcattcataagcgattgatggatacgcaaaatgttatattacagcatttcttatcaaaattagatttaaaattatttcatgctttttcccagtttcatatcaaatcattaaaagtgaatatttttccctcttctgtacagtcaggaagactgcttatgatgttccaaagataacctttatgtatgtgctcagctttgacttatgagtaagtttctcacatgggttaatacccggccacttctagtgatcctcatgcttttcaaggtcacaacaggaaggatgtatatttcaagtttaattgtttctctcaaagcacgaggagtagacaggtgtggagagagtcttcctcagctcatcagcgtcatggaactctagctcttctcctagggaatagggcctccttcatgtttctccccctaccctatccattctttaatcgatgctttatttcccagcaattcatgcctgttacttgtctttactcttaaaccttttgcttttctctttctgccagcattttggcaatcctgtataggcctgcggccacgtctgcatgtaagcagagagcagaatttctgctttaacagaatttctctgtcacatcgtctgcttgggccatggtgtttcgtattctactggtagacataaccttcaaggctatgtggacctttaaagtcagtatgaaaatttgacttcattcttccgtctttctttattattctgcttaatataccttgtgttcatccacaacactggaagcacattagttgcttaataaaagttattctttaaatagagtcatcatttttatatagttgtgatattatttccatacattatttatataaaatcatattattttatatagtttttatatatctgtgataaaaataatgctccccaccagaggttcatgtcctaattcatggaaccagtgaatatgtaactttatatggcaaagggactttgtgcttgttaagagccttgatttgaggagattatcctggattatctgggtggctttgtgtaatgacagagctccttaaaatagtcagagaaagagactatgaaagcagagagttgcagtgatgcagcaggagggaaattccacctaattcctagctttgaagatgggggactgagatgatgagcccaggaatgtgtgtggcctctataatctggaaaaggcaagtatatagatttcccccctagaatttgcaggagaaacacagtgctaccaacactttgaatttagcccagtgaaccccatttcaaacttctaaccagaactgtatcattattattaacagaatcatcatctccagaactgtaagataaattggtgttgttttaagtcactaagtgtctgtcatttgttagagcagcaagaggaaactcatacaatagtacttcatcattttccatgataggtaatacacagacaacattcattcattgtttaatgaaaatgaataagacatttagtggctgggcacagtggctcacacctgtaatcccagcactttgggaggctgaggcaggcgggggtcgggaggctgaggcaggcgggggtcaggattttgagaccagcttggccaacatggtgaaaccccatctctactgaaaatacaaaaattagccagacatgttggcaggcacctgtaatcccagctgcttgggaagctaacgcaagaggatcgcttgaacccgggaggcaaagattgcagtgagccgagattgcaccactgcactccagcctgggcaacagagccagactccatctcaaaagaaaaaaaaaagacatttaggacttgtcactgtctaaatttttgcatgctatgaaattcaatctgatatgttcagtagtaatatttctgaatagctgatattatgaatatatagcatgagaacttttacttgggacttggagttgcaacagagaaaaattactttacaaataaatcaatagacttgatgagtctatttattttgccatcaacccaattacctttctgttcttcagcagtctactggcaaaactcaattatcgacaatggttcagacccttctgtttcttcagtggctgctgccttagctcctgtgttctgtcatctcctagggcttaatgtgcaaaaattgtgcaacccagctaggactccactgggtgcagagctaactggctgaggcatgcagggtaaatactgtcattagctcattctctgcataaaaaaatgaaatatactcaataacttctagtttttgaagtatctgattttatttaatcttcacaacaacttggtgaagaaggtattactattaggttgctacaaaagtatttgcagtttttgccatgacttttcatagcaaagccgcaattacttttgcaccaacttaatacctcaattttacagttgaaaaaaccacgttagggagagtatccaggcggtaaatgacagaaaggagatatgatctaaaatttcttaattctttattcagatgataaaactaatgtgactttgctctatcacagctattcttgtcattttactgcagtgtcaaaattctagatacatatttttaaatgtattttaaagacaaaataacataacatatgcacattataaagtgatgtaggaaatttaaaaatctgtgaacagttttaaatcacccacaatattactgctgaaaaataacacctcttactatttttatgtatttataaacatttttctgtgtatttatatatttcttttgacattatggttttgcatcccattccattttatcatatttccagtgaagtgaggtggcattctaaccttatcatatgtacaattttactgtattgtctttcagtaacctacttttgctggatatttaaatataaataaaaattagtctaccttgaatttaccttttttcaggatgaaatctatgcttctccaaatgcagtctgaggacagtagtgccagcgtcatttgggagcttgtcataactgcaaattctctactgagtccaagtctttggggtgaaatccaggaatttctgttttaataagctctccaggtgtttcacacatgcagaattttggactgaagtgtttggttttctgtaagcgttgatgaggcaaagcagcttaggcctattgtaggtgaaaggcaagcacaataattgttatactttgaagaaaaagaaaacttttttccttcgttcgttctttccttccttccttccttccttccttccttccttccttccttcctttcttccttcctttctttgagatggagtcttactctgtcacccaggctggagtgcggtggcacaatcttatctcactgcatccttcgcctcctgggttcaagcgattctcctgccttagcctcctgaatagctgggacaacaggcatgtgccaccatgcccagctaatttttgtatttttagaaaagaccaggtttcaccatgttggccaggatgctcttaatctcttgaccttcagcccacgttggcctcccaaagtgctgggattacaggcgtgagccaccatgcccggcctaatattttttaaaaatgtctgtagagatggggtctcacaatgttgcccaggctggtctccaactcctggctccaagcattcctcccacctaagtctcccaaagtgttgggattacaggcatgagccaccgtgcccggcctaattgttaactctgactgagaacttttgtagattgagaaagtggctggtagtatattgtagataaaggccacaccagaaagggtgagtgtgaggtaagcgagctcctgtggggaatttgcctgaccagagcacaacattcacattggcaagcagctgaagccaagaaagacctgttaggataacccaagttcttgtacacatagatgaagatctgtgatataatttatagatattgaggaaacattacacattatttaacataaaagtgatgtttcataactagaagaacattggttaaaaagcacactttagtgagaagtgaggagatatttgggtagaacaaccaatgaataaggtgagtgttgtaaacaagataccaaatgaaagacaatgataaggagttttggcagaagaaaaagacaatgatttattactaaatattataatggaaaagaaggggaatggtttcaatggcagattggacaaagggactaagaggaaaactagaatttgaacctgacatcctggtttctcttgagctatacataccaattttaataatctggagagaggtgtaaaaaattaacaaaacagttttattttcaaagattgtgagtttagtttactcttaactcctctgtattcctaatcacctacatccagttggattctatgtcttgccgatcttaaaaaaaaaaaaaaaacatttgaggccaggtgcagtggctcacgcctataatcccagcactttgagaggccgaggcgcagatcacctgaggtcgggaattcgagaccagcctgaccaacatggagaaaccccgtctccactaaaaatactaaattagccgggcatggtggcggatgcctgtaatcccagctacttgggaggctgaggcaggagaatcgcttgaatctgggaggcagaagttgtggtgagccgagatcgcgccattgcattccagcctgggcaacaagaacgaaactccgtctcaaaaaaaaaaaaaaaaaaaaaaattgaatcagtcctatttactctattctttgtcatattgctttagtttaagtactggtaatctttcaactggcagcctatagttgaaacagcctaaatactctttttaccttttgaattacttccctaaaacctattgcattgctgcacagagttttcattctgtataagttgatataaaacctatattgacttatggcatcttcctgctaaaagtttaaaaatacttttcctctgctttttattgtactgttttacttggtatgacattctgaattagagcagccgtgtagtttatcatctgaatgagacccttgggacattgaaagtgggcatattaataattacactgggacaaaagttgtctgggctttgccgagctttctagccccatcctcttctaagagcagtttacaaatgagcaataccaaaataattagtgaacaaacacggtttcgaaggtcttctatccgtgttgttcacagctgtatctgcaatgcctaacgcactgctcagtgcagcatagttcctcaataactatgtgcaaagggaggaaatgagggagggaggcatggaagaagaaatgggtagatcaaagaattttagaaagcttgaatctagtatgctgttgtttaaatgacatagagttgaaggtctaacatccttggaaagaggaaggcatagaaagccaaaggaggcacagagaacttggtagaggaaggttaaaaaagggaggtcccagaatcagaccacccatgaaactgactttctgattccaaccaggctctagtgaatttgactggagaaacaagtttttccagaacctaattattcctgttagagtaactactgaggtttgtgcatagccaggctggaaatccagagaggtggcaatgaccttgagaccctcctcagtgaaagctctctaattctaggaccatgcaattatttttaattagtacaatataagcttaacaatgttttgtaatttattttgtactattttatagtttaacacacaacaacccctaaggagtgtaattcaagtgcaacttacccaaagacttcactgcttttgtatcaggttgacatatttttaccgaaaacatatcttagttttgtgaagaaaactttcacattcttcattaattcctgggcagagctgtttaaaagaaagttttgtcagtagcattttagatgttctaactacaaaggagatatgtaaatgtccgttttgtacttctgaaaacaggtgcagtctcagtgagaaaaagaaaatttgtcatgagcactggaataaaaagggaaataatgaataagaacataatttaattacatgaatgtcagccgtctacacaaactagatttgatgtaattaaagcacctggaacaaataaaatgaatcaaggaaatctctttcctttttttgagaaaggaagattcaaaattacatactatttatggacaacttgtacaaactatgcaaaaaataagtgtgcatgtgagtgtatgtgtgtgtgtgcacaagagagaggcagagagagtgaagggtaatttttcctggcctcttagttcataaccaacaaagcagccaatataagttttttatagtaaggggataatatctataaataagtagaaattaaatattgttttcaatgatcatgagccccagtaaaataaaaattacatttatttaaggattgattattttagtcttttccccaacataaagtcataccaggagcttgctgtctttggtaggtcaggaatgcttatagagaaagaaacaaatcatgaatttaaatttagagacaaagaacgctctttccaggaagaactactcctaactagtggtttgctagcattgcaatatgccactgggacatttatctggggagccatttgttctgtgctgtgcttatgtaggatattttgtttgttctagctatctacgagccttcctgtgaagcctacaaacacctaggacagacatcaaattattactggatagatcctgatggcagcggacctctggggcctctgaaagtttactgcaacatgacaggtaactgtgtcatatttatgttttatgaagatgcttttctatatgtcacgaataagtagttccaccaatggtttgtttctttggtgctatgtttttatcacaacatctaatcagcaacatattgctggatttgttagataagatgatgaaatgtattattagagcaataaaacattttgacactgtgcttttcaaaaagttcatgtttgatgtgaacaattaagcatcatttttttaaaatcagcatgtagggggaaaaaaacagaaagtaaagttgcaaagttcagcccaaagaaagaactagtaacctagattagggaaatttagcatcactgctccaatattctcactgtgcatgctagaggaagcttttagatcgtgacagaccttcctcgattctccataatgatagaagaaatctttctaagtcctgaaatcccattctgataatagcaaaaattacctgaagcttttatgaaatatatttgggcttttcttcttgggaagaggacctagtttttctccacttccatgtgaaatgagattatgggttcttgtcaacttccacaacaatgtgtaaaatgtgcagatctctaagataagaacagattttccatcagacacttggcaatatcttacgcttcaaaaatccagaggaaggtgtgaggtatgcattatttactggctccagcaaaagaccagcatttgatgtgaactcctgggcataatatgataagggtaatgataataagatgctactgatggtagttactgagtgtgactgtttaccatctgtcaagtatcatgacaaatcctttggacagacacttgagtttacatcctggcttcattaatcaccacatgtgtaatattgggcactttagtaactttgctaaattcagtaaacctcagaatctttatctgtaaatgaattaatgagaatacccacctcatagcattattgtatgaatacaataaggtaatctgcatatggttcttagcttattgtctaacacacggtaaaccttcaataaaagttattggatgaaaaaatttaaaggctttagtagttaaataacttgcccatattagaccaggtgtggtggttcacgcctgtaatcccagcatcttgggagactgaggtaggtggatcatgaggtcaagaggtcgagaccattctggccaacatgaggaaaccctgtctctactaaaaatccaaaaattagctgggcttcgtggcacacacatgtagtcccagctactcaggaggctaaggcaggagaatcacttgatccctggaggaggaggttgtagtgagccgagatcaagccactgcactccagcttggtgacagagcaagactccatctcaataaataaataaataaataaataaataaaacttgcccatattattcaggcaaattcaaactgaattatatgcagcccatggatcttctggctatagttcagaaccacttatagagttttattttgtctttggttttgttttctatacaaacttcttggctccacccctgcagactctgattcattatgtgtgaagtggaaatcagattgtaaaactagaactgaaaaccatgaatggtactctaggcaagcagacaccagcgaggaactctcagcagtatcaggaagccaggcatggtacagaatgaaagggaaaatgatgagggcatcagtgtagtatggaagacatgtggagaagataataaaatggaagctgaccagcctgggcaacatagtgagaccacatctctatttagaaaatgtcccagctacttgggtggctcatgtggaaggattccttgagccccggaggttcgaggctgcagtgagttgtgatcacactactgcactccagtctaaaagagtgagacctgtctcaatttttttttcaaaatagaaataaaaaaataaaatgggaactagcgtccccctaaatttctaaatttcccctagaaatatgcaagatgctagctcccagtttaatttttttttctattttgaaaaagaactttaggcatgtctcagagaaggaacacacttaccagagagattaatctaagagttcactgacagctggacttgtcaatgcacttgaattcttttttatataccttcatttttatctttttagcactaaaatattaacctatgataacttgacttaatttataagaatctcgattctggtttctcctaatatatgaaaatatataatacaattaaagtctattcttaacctcaagggaaatcagggcatcgtggcttggactggacaattaagaatttattttagttattttcttaaattcatctcaaaggaaattagaaaagaaaacaaaactataatatacataattctcatatcaaggacacacacaacacacaggactagtctactctcaggagagcttctcctgtgcattgaaccctttgctcagaaacatatgtcttatcttcatcaatatctcccttaaacagcatggctgcaatttaactcagcacttcaaatgacttctgagctctaaggagcagaatacaactttttgcaagtagaattttttttctattcattcaagatagttacaaacatcagtgtgttcaaggacccttgaagaatcttgccttacaggccagcaggcacctttcagttctttgccactaaccaacccttccttttcctggaaagaatgtggatttaacatcataaagagagcatgatgccacaaagcttggcttgggctattccattttcaagagatacatgttaaagaagaggagggagtaacagcatgaagtagtctataaagtcttgatatgtaactctatgtcatgaaaaattataaatgctcccctaaatccgaagtataaaaggaggcaagcactcaaaaaggtgaagaagagaaatgagccatataaatcaatcccccagggcacaagagagattggcttattccaaagaactgaaatcccagtggctggaacatagtgagcgtaagagagtgactcaaaataaagcaggggaaaggtgggtgggggcaggccagagcagaccagccataaggagtgtagggcagaaaaaagtgcgcttttttttattattatttttcaattgcagtgggtggtcgtctatggaaagattttaagcaggaaaataagatcttgattgcattcatacatctaccacttgggcttctataagagacagcatgaaaacattgggaccagctctgaagctattattgcaaaagtccaatgaagagatgatgctcccttgaactagggtagggatggtttaaagtgatgagaaattgatacatttttagatctgttttgaaggtagaattgacaggattggtaaaagtttggatgagaatgtttaaagagagacagttatcaatactaacttctcaacatatggactgagtagctggatgaactttagtgccatttaggagaagtggacaattaagggtaaaacagttttaaaggaagctcaagaacttacttttgacctaattaaatgtgaagtgccatgtgccatctaaactgagatgcaaattttacagttgggtgagccccaaaagcctgattgggttagagatataaatgtgccaattattagcatattaatatatgagaattgataatatcatttgggggttgatgtaacagagaaacagcatctcaggaatgagctcttagaaactcaataggcgggacacgatgactcacgcctgtaatcccagcactttgggaggccaagacaggtggatcgcttgagcccaggagttcaagaccagccttggcaacatggtgagaccctatctctaccaaaaaaaaaaaaaaagcaaaaacaaaaactagctgggcatggtggtgcaaacctgtggtcccagctacttaggaggctgaggtgggaggatcacttgagcctgggatgtcaaggctgcaatgagccatgatcacactactgaattccagcctgagtgccagaaaccctgccaagaagaagaaggaggaggagtaagaggaggaggaggggtagagggagggggaggggaaaggaagggggagggggaaggggagaaggggggtggggggatgaggaattagtccgttctcacgctgctataaagaacttccctgagttcgttctcacactgctatgaagaacttccctgagattgagtaatttataaaggaaagaggtttaattgactcacagttgctcatggctggggaagcctctggaaatttacaatcatggcagaaggggaagcagatgccttcttcacaaggcggcaggagagagcatgtgaaggcagaattgtcaaacacttataaaaccattagatctcatgagaactcactattatgagaagtacatggaggaaactgtccccataatccaatcacctctcaccaggtccttccctcaacacttgggaattgtggggattacaattcaagatgagattcggacagggattcagagccaaactatattactcaataattcaatagagagagattagggttctcgtgttaaaatatttaataagtgtttggaaaaatatacataattgagggtaagtagagaaaaagtgtctgagagcatttggggggcaaacagatcatctgtgtggaggttaaaatgactgcttggatcctagagaatgacagaaagacttggagaatgaagagcaacttggcatccatgcacacatatacagtggatgtggtggtgccacagacgtatggcaaataatagccactagaatgcggggaacatggtatggccaggaataatgaaccttctaaggatgctgcatagacagcataggggagccatggattgagctacatcctaggcaattagggggtgttctaaatgacagagcatttcaagcactgcataggacaccagcaaaatcttccccaaaacggctgactcatgagctgagtgttgaagaacaagtgggtgttatgcggctgagaaatcaggagaaggaaaaataggtcaacttacaaaatgctttgtgtaggatgcaaagcagttgaaagtttgtcctgaggtgaaagcaagcaatggatggtttcaagcaaaagagtaatttaatcaggcattgtatattaaaaacatcactttgacagctgtgaataatattctccaaaggacacccagagataagacagggaaacaagttcgaaagcccccgtagtaatgcagaggttgaaaatggagacttaaagtagtggcaataaagtaaaagaggaggagattgatttgatgggtatttaagaagaggagttggccagaccgttcctgatgagacagagaaagttgaaaatggtaaccacatgacatggagcacagaggagcagaggaaaactaggaaaagggtaagattctatgttgctttgggtccctgtaattcaaccaggtaaagttgtcctacaggcagatgctacgcaaagtcactgtaggaccttgaacacattaaaaaaaaaatctttggccgggcacggcggctcatgcctgtaatcccagcactttgggaggccaaggtgggtggatcacctgaggtcaggagttggagaccagcctgaccaacatggcgaaaccccgtctctactaaaaatacaaaaattaactgggtgtggtggcgcacacctgtagtcccagctacacaggaggctgagacaggagagtcacttgaacccggggggcagaggttccagtgagccgagattgtgccactgcactgcagcctgggcaacacagcgagactccgtctcaaaaaataaataaatataaaataaaaaaatctttgtctcgggtttcttgtaaataaagttcagtaattggaataagttgatatcttcactgcctttccttcaaaaaaaaaaaggaaaatatttccattgttaccatgagacatgaaaaaaatcactgcttgcagtcaaataatttagacagaggcttcttatctcaaacaagcttgaatttactatttcttgctaagtttgacataaattgactcttcattttttatcgtaaggcagtagttctactatgtaattcttctgactgtctgcagctcagagctacatctcttggaaatttagaaattagggggtgtcctaaattatagagcatttcaagtgctgcacagttgatgacattgaggagagaagatttttcacagaatcctttgtagaaaaatttatcatcctgtgaaagccaaagcctggtttctttttttagatcttagggtacatgataaaatgtgatcattgttagcctcgccttccttctccatttttatgctccctctgaaaatttggtgttaaaacttttgtgaatataaactatcttatattttcagtatcaacctcttttaattgtatatttctaacatttcagcttttcatttccattttcttcaggtgttaccagcatcctctccctagataccctgaacctttgtatttaaaaggttctttctgctttcacttagttctttctgctagatgattaatagtaacaatagtaaataatgctcgatccagccattattcttgaaactttactgtctatccttaaacctaagacaatatttttcttcatcttctatcctctaactcattttctccataactccctttgcattcatttttttcttaatttaagcaagcatctgtgctctagtgcgtgaagtttaaagtccaaataaagtactcctcttgcattcttcctagccctggttttgtagttttatcaaaaagccattaagcttgtttacataatttgtgctttataaagccccaggatttagctgatcaaattctattatcctctctaatagtgaaagctgttcgtgtctttttaatctaatatttatagagagcttgtaacggaagtttctaagcgcttgcactcagtattagtatcgtatttagtattatgtttctcacaagttttacaagtacagtgtgggcaggaggaaatgggtcactgaggtggtggacttgggctccagtggagagtatcataaacccacccacctccacctccccctccccgtgtccacaaagcaaaacagtttctatcctatagtacagtcatgcaccacatagtatttcagtcaacaacagactacatctagaatggtggtcctataagattataatggtgtatgtttactgcaccttttctatgtgtagataggttatatacacagacaccattctgttacaattgtccacagtattcagtacagtaatatgctgtacaggtttgtagcctaggagcaataggctttaccgtacagcccaggtgtgtaatgggttatgccactgagatttgtgtaagtacactctatgaggtttacacaatgaccaaatcacctaatgacacatttctcagaacctatgcctgttattaagtgacacatgactgtactattttccttagcagtttacagtaatacaaatttagtatccacagtttctgtgtgtcaaggcacaggtgacctgggtcaactgctcagagtcttgccaggctgagaccaaggtgtcacccagggcttgggttttaccagagacttgggatcttcttggaagtttattcaagtgttgatagattcatttccttatggtttaaagactgacgtctcctattcttattgtctattggccccagattgctctcagctcccagaagctgctcccagctccctgccttgtggctctgcctgtccaggaggagctctctgactcgctttccagcgctgacctgacttggtcgtcactcaggataattacccatttgattaactcaaacccaccagtttacagcccttaattacacctgcaaaatctcttcatcttttccatgtaaagaagcccggtcccattagtgacaccccatcatatttgatggccccacccccagtctaggagagggtattatgcctggtgtacccaccaggtggctagaatcttgaagaccattttagaattctgtttagcatgcttacctatgtgcctctgtaaattattcataattccagcaacctttatttctaccttttgagtaacaacagtgccatatttagattataaaatcttaggctttactgttaatgctcttataattgtaacatattgttctgtaaaaactttgacaataaagataagcaaaaataaaaattgcttgtcaaccagaaatgacaattactaacacattagtcactgtgcaataaagattgtatattttatacaggtacctgcatacataattgagggcaaactaaatgccaggcacatttttaaaatatcacatgcattaactcatccaataactcatgacgacctcacaaggtgggtaatactattgttctcccattttttgatgatgaaactagagctcagagaacttaagtactgggccacacatgtagtaaataataaagcttgacttttcagccaggcttgtgtgttcagagctggtttgtagttaccgtgtgtatgtgtatgtgcacacacaagttcacacatatataggaacagcactcctcattttagattctgtagtacgatttgcaatatgattgctgaaatgagcattttttattcaaatctcttcattatcattgaaactttcttacacagctctgattcattatctgtggtttggacagcatttttgttataaacaatttacttcttaattatctaactaatgccttggggtttttaatcagaggacacattttaaatgaaatcgatatataaaccattataggcaattagtatgatttttagttcttttttttattattattatactttaagttttagggtacatgtgcacaatgtgcaggttagttacatatgtatacatgtgccatgttggtgtgctgcacccattaactcctcatttagcattaggtatatctcctaatgctatccctcccccctccccccaccccacaacagtccccagaagtgtgatgttccccttcctgtgtccatgtgttctcattgttcaattcccatctgatgagttcatttttaattcttaattcaactacaagtattttctctaatataattttctaagagctttacataatttgtatatttcctgtctacctaggtttatcatcccttaaggtttgagcccagctttcagaataacttaaactctatccccaacatctagttaatttttcaatgtaaagtcttaaactgaatctaacaaaatcttgtttgaatatgcaacaggattgaatggaattgtactggatatcatcggtaacaatgatcgtagtgtctcattcttccccttttagagaggaaatcatgtagaaatgaggacacacagagctctcctattctatattagggcttattaacattcataagttgggcgctactaagcttctaaccccttcattttcctttatatcataactatttctctgatgtgtatactggcttcctccattatattccctctactcatttttatttctttctcatcaaagccattttctctcctctttctgtctcctaacctagtttacctcctctatggttaacccactcagagaatagctgtcctttatgtcttctttcagacacatcttctcctctttgtcgacctctcacaggctgtctttgttataaacctttgtaatcactcagcaagtcctgcttcacgcattcagctatttcagttcttcacaatcagtataaatctttgaattcaattctgctcatacagcttcaattgaaaatctcggaaccaactcactgatcaaacacagcctgtaaagaactcttctccgtaacggattacccactcccaaagactcccttctggattcagcctcattccagagcttctgcctgccaggctttctttgcaatctcatcttcattgtgtgtcagccatagtgataggttaatactatagaagttctcaaatggttttcaaacttcaaattaaaaaaaaaaaagagaggaaaaccatgagatccagtgaggcctacaccacaggagaggacccagaaagggggtacaagaccccaggtgaaatcaagatgaagtggctttaggtatatcacaggtcactcagcccttctgaggtttccaaaatcgtactctctatgcaaatgctcttccttcaaatgttttcatgtaacctgacaaaacaatatcttatagacactgcttgattttgtgcttttaaaagcactgcctttcttatgcaatttctctgctcaaaatccgagaaagacttcacagtgtggatggctagggactgttgtttgattacctctggcacttggaatctgaaactcttgcctagtctacagtaatcaactattcaaacaggatgggaaacacacacacacacacacacacacacacacacatgttgggaaattcaattaagatcaactcatttctttgcaatcaaaaatcaaaaaccacaggaataatctcatacttttttttaactaggaatttctctcttccggctaaacttaaagccaataataactgtttctgtttctccaaactttaggtttttccaatttgtggatcaccttttatttcttctgaggatgtcaagtttcatatcagaatgtccctggaaattttagaaagaaaatctcatatagcagctaatctctctttttatcttgtgtctttgtccaatcaccacaaccaagaaagttaaatagtaaattgcaccaatattatatgttgcccaaactggaaaatatttaaagttttatttcctggacctgacttaaactagaggccctaaaacttttcagtgccccacataaatgattgctgcataaaagtacttgtctcattaatgaagaatgaaaatacaactttgggaaaaaatatccctgtggatgaagttgtcaaaaaatctgtttgctgcatttacgtacagacaatttcattagcattgaactcttcacataattattaatctcatgttcggtttttactcagatttctgaacaaaatcagcattaaaaagtgagattaggcaaaaacttgctgtatcattcacttcatcatcattactgttgttattcatgttttgcttttatgtgcatccatgttattctatcttcactggacccctatttgtccttctgtttctaagctcacttggtgtagctctaggtttcagggctaggacaaggcagcataattttgagagatgaaatgaatgcctttgctgctccaggcagcagggcatggaggacagagcgggaagtttgttagtacattgtagaatctgatatctttttgctctcaggttttaaaagactataaaataatattgagcatcttgctgacatttcactttgttctaacatgaagtgtttgctctctatatctggggtataccatcatcatggacttcatcttcaccatgtctgtgtttatttatccaagaatgtcttcatcccccctatattggaatgcatgatttttatataatgtcttcttcattttaattttaccctctaatgtggatatagcacatcccctggtagcttcttgatcctttagtacaacctacttcttctctgaaagttagaagaatcttgtttttgttccagatgttctgaaatttcaaaacaacgtgacttggaataggtcagttttcatgtatttgctgggtgttcactttaacattggcaactcatgttcttacatttctttttatttatctgtttgtgattctgtctcttatgatttatctattgtctctttctagaatgcttttcattgtggttttaaatcagagttcttttttcttcttgaaaatttccttttctaatggcgttctattactgctttatgaatgcaataccttttttgtatcccaaggataataaaacatctttttttcccttctttcttagttttctccaagttacttgattctgttcatttttttctgaccttcacagctttcctcatattcgtgattattattagctgtgtgtttattattacgagtgggagggtcttgttgacttggagctttactgtgggttagagtaacaattatgtcctggcttgctcagtacagtcccattttactcccattgccctgatgtccttgtgaatagctcttccttttattctcagtagtgtccttgtttggatgataaattatttgatcacctcactgcagaggaagctgagtgttcccgttttaggactctctcatctgttgtcagcattatttttttcattttctctttattagtcaggttctctaaggatacgttttaaaattctttcctggaggtttctgatctggttgccaacaatcttggaaccatttggggaaagaggtctaacagcatgaacattcagtatttggtacaagtgtaggcaatctccattttctgtgtagtttccacattctttgtaatacttggttcttctcaatgcagggattcttttagaaaataaacctccagttatctcccagagtgagagaggagtagtcaatcagccacaaggcttaggagacctagggatctactatctgtcaaacagccttaatgcagttctccttactttattaattactgaatcttttatggattcatggtcgaaagttgggttggttctcatctttccagactttcaagttaagattcagcattctactaagtcagtgagcacatattcatttactttccatcctccaaaattgtattgctagtattgattcatattctcccggtctttgtgggaaatgtgtgtgtgtgtgtgtgtgtgtgtgtgtgtgtgtgtgtgtgtgtattccctagctttaggagtatgcatatgtgtatgtgtgtgtgtgtgtgtgtattccctagctttaggagtatgcatatgtgtgtgtttgtgtgtgtgtgtgtgtattccctagctttaggagtacgcatatgtgtgtgtgtattccctagctttaggggtatatatatgtgtgtgtgtgtgtgtgtgagagactgtgtgtgtattccctagctttaggggtgtgtgtgtgtgtgtgtgtgtgtgtgtgtgtgtattccctagctttaggggtatatgtgtgtgtgtgagtgtgtgtattccctagctttaggggtgtatatatgtgtgtgtgtattccctagctttaggggtatacaactgtgtgtgtgtgtgtgtgtgtgtgtatgtgtgtgtgaattccctagctttaggggatttagaaggcatataagttaattgtcagtgtgccagtgtttactcaccatcctaaccaaggtgcagcttctttatttttaattctgtaatttaatgtcataaaaccaaatagttcaaatacatgtttcaaaacacgtattttaaaatgtatgaaaatctccaaattttaatgtaaattaataaattttcctttttggttaaggagtgtcataattcttaaagtgtttattattgattatctgctgtatgagaggtaatatgataaattctttcatctattgtgtttcatttattcttcacaataaccctgagaagtattagggtcccaattttgagatatggaaactgaaacacaaacagatattaacattctctgtaacacaatttacaaaaggctgtttacacaaagaatatagatttggatgacatcctgtatcatttagtggcataagtgtgtcactttcactttttaataggttgaaacattcgaagaaaccctcagttcttataataatataaattactattattattatttgaaaatttttttcttctctctatgatttctggttaactggattctagactgatcaagggccatgtctgtcttgtttactactgaacccagcagagtgtctggtatatgtcagcactactactgctgtgaatagacctcaccactgtgtctttttcagtagagctaagtagccaccaccaatctcagtgctaaataagaaaacaagtttgagataggtaagagtgtgcatcacttataattagaagacatgcgtttattagcaatatgctaaaaaaatcattcccacaatctgtcctataaacttgaaaaagtccaagtgctctatccttttaggtgctccaacttgtccttgtatggctgtttttacagtaaatatgaaaatattctagaagcaggattgagtttgccttatactgggatcaggtaactagagtcctctaatttaatgactgaaaaagatctatttaagaatcaggcctcagtcagcattatgaaaagtaaaaggtaaagagttcactagattctttcatcattttgatgcaagagtgaagagttactaaaatgttttagctaagcaacataggtgaacatcagtaatttcttccaccagtgaaaagtcaacttccataatgcaactaacaattaaatttatgtaacaaaatagcaggttttgagctatgataaatgcaacttatacgtttggggtagtatctacctctaaaatctgttcttttaatgaaatgctagccaacccccctatgaagtgtgggttttgttctcgcttagggtgactgaccagccttacaccaacccttggatatagagccatattgtctaatacacatgcaattatatctaaccatccttgggatgtattttaaaagtaaattacaaaccacatagcctatgagttgactatccaggtagttttaccaactgtttataaaagaaactatgtcaacataaagcagtcagtttggaaaacacgtgcaagagatggttactttcacgtgaccagcatgttgcttagttgtaacatgctataaagggttgtgttttactaacagtgtcactgatgatcctcggttcattcatcatacttctgcgtcactgctgctacttactaactacaatcccaggccagcttaagcattagttttctttacattttgctttgctcattgcttctttaatatatccttattaccatagtcttccctctgtgttctccagtagatagaagaagaggatttgacatgacgctaagcacattaatataatagtttcttctcccagtggtatttgcatttcaaagagaataacaacaagatgaaccaaaatatggaagcaatattttcagacaggataccttccattgctctctaaatcactcctatctgtagcccccattctacttgtgtatacaaaggcttgtagcccatgtaacgtttaaagtctctcccatgtagagtttcttctattggggtggcaggagggggctgaaatggcaagccactatttctattaactgctctgtcttttgcttcaatatctgtttcataacaagttttttttttctcaatagctaccccattttataggcaaaggctcagaggaaaatgagatcagagaaaaaaaatgagttaaatatcatctgcaaacaaatataaagcaacacaccatgcaagaaaggctcaccccctctggatagagaattctctcttggtatcgtgttggtgtcattgttctcaccacctctactctcctcaagtttatcttttctttgggagttccagattctatttattaagtatccagtatttccatacacagtattcatttttaatattgaaatcctaatctccattcctattgatatttgatagcaaaatgttccaacttctatacaacatttgagtacttccttcattgtggccgctttagaatctatctgtatgtaactatgggtaggcaaggaccaaacttgctcagaaagtttcatagatgctgcggttttatcattacattgcctatctgcatggtgatttttttaatcagttattataagcatgtttgatacttttgattgataatggaaagtaaaggaatgaaagttcagctaattaaaagagatgattagaaagaagttggctttgcaggagattggttgataaaacaactgatattttctttttcttgtttcaagccttgggcagaactcttatgaaagcatttagaatttagagggcttgtcatggccacactaagcatctgactcatctggttgctgcaatgtcattaaaatgaatttttggtgccggttcaatttgtctttggctctacagacatgaccttattcacattgattgctctcccattaacggtagtgtagtaaaggaaacgaaataagaatatagtgttcaaaagcaggtctacatgcaaagggtttctttaacagtattattatatcatgatgttttcagagatgtgaagtatatttattaagtatattcctagattataagaatgttgctttaaatgatatattaattttctaccatagtggaaaattatttagtatacagtataaatcattcctaaaataaaaaattatgggatttatataagcatgtcaatatcaacttttcatttagaaaactacaaaagaaaccatttatttaaacactttaaaaccctgtgtattacgaaattaaagtatcattttcaacagagatacaacttttccgtcttttgccttctctaagcttagaaaactcacaaagtttatgaactttaaatcaaaatcaatgtttcttagtttctcatcaatattattttaaaatattgaatatctttaataaatatggagaaaaaattaattcagaaatattcttgcaaattggtctcttttaacataatctttaagtcattgcttacacttcccagtcactttagtaaattcttaattgacgtggttccaaatctcttcctaattctggtcattatgttcttttttaaatgtaatgaactgtgtggtgtgattaacagcaagcttcatgccaagtacaatacagtggggttttatcagatagcagagagagggtgtgaatcgtttcccagacttatgaaatatctatgtttatcattctttgttatctcccaggtacagtttttagaattttaatgtgtttaaataagcttgcataattgttaatgtatttacttaaccaatatttatgagtgcatcttatgtttcaggcataggtacacagtgacaaacacacataaaatctgattgtgtggaacttataatgttataagtatgtataaaattatttcaaataatctgttataatatgccagtgatacagttgttgctgtcagagacattgaattattgaaaaatgagaaaagtttacattattaatatgccatttatagccaatttctgatagatagttaattaccttaagaaagcaattctcaaactttagtgatttgtgcattgtcttcagaagtttcaccaagccccagaccacctatttaattatttaataaatatgtttttaatggactccctttttaaaatcttattctcattctaagcaacaatttccatgaaaggttgtgtttagttcacttgacattgcttcctactgtgctgtcagaacatcatattgtttagatatatcataatgcaatatcatatgaaatgatatttcacaaaccatcaatggtacatacacttgggaaattctggcttaactaaatccttgtacctaatttaataggtacttttctccaaaactattaacttgtatgaccttagaccaagaattgtgactagtacaattcacaaattgtcaaaattgaataccttatctaaatgcaaagaagtcttcagcataactttattttaaaacacagatgttgtgatttgatagtaaattattcaactggattctaatgagttatttgctgactgttcatgcatgttgacccaagtactcttcattcccacatctgtcctttagacagtctcctttttctgtccttccaactataactctgatttaatatttaatgaacaattactatgttttatattccttccctcaaagaagacaagctgtcccaagacattctaaaatgaccactcctcccacccctgtgagttctctgtgcaaccctgccgtccctggcctctccttctgtctctcaccttaccaagctcttagtcctaagtttcaggtaatggctattacaccctcactgaattttgagctgaagagaatattaattacctagtcacatctagttttacagatgaaaaaattgagacttatgttttgacagtccatacttaaatgctgaaattttttttaattgggttcagcatcttcacagaattaaccccaatcatgacagttcgaacatttcctgaaaacaccttgtattgctgtctatttccatcggtttgcaaaatgatgttgatcttgttttttacattatcattttttttttttttgagacggaatcttgctctgttgcccaggctgaagtgcaatggcacgatctctgctcactgcaaccttcgcctcccaggttcaagcgattctcctgcttcagcctcctgagtagctaggactacaggcatgtgccaccgtgcccagctaatttttgtatttttagcagaggcagggtttcagcatgttgaccaggctggtctcgaacttctgacctcagatgatccgcccgtctcagcctcccaaagtgctgggattacaggcgtgagccagtgcgctcagcccattatttgtttatctaatagcttaatcattcatcactgacattttgagcatttaaacaacatcatcctcaataaagttctagaatttctccaacgctgtgttctagacatggcacttcatgtgaacaattccacaggaagtaggtggtactattactattcgcttttatatgtgaggcagccaaatcataggtagataactggcctagagtcaaccattattaagcaggagagtggaaactagctttgtgtgatgttggagatcaccatttttgtcacttcattataatatccactttattccaggtgccattctagaggtataagatactgtataaatttataagacacaaattatatttttaacagatctttggtctagtttaaaagacagaagtaaaagtatttattcaccagatttacatacaagtaattttgggctattgtcacaattcaaatctaccttcataggagaaacattcatgattatggatatacatggaaccatgctgtatagacaattccaatcaaaatgctccacattgctttggacaatgtcaggatcactggaataagtacatagcatggcaaaatgagttttgtgttgtttttcctcctggaaataaagccaatataagacccctggtcaaccaagagaaaagcccataaaggcaggttccagtagctcagagtaagtgtataggatttcttgtgacaaaagcattgtgacatattatcagtgaatttcccttctcccatccaaatctggtgattagtcattaactccagcttaacagcaactcagcagtaacaacatgtactcggtttagttatctgaaataaaacaacaacaaaatgtttctagtggtatgactgttgtaaaaatatacattatatacaaagcagagaacttatacatagtaggagtttgctaaataaatatttctaattgattaaagaaaatacaatagtaagggcctgcctatttatacatataaataatttgagttatggaatgtaatgtgagattatataattttttctccttgtgctgtaagatatgaacaaagagattttagaagaaaaagatataaagaattgtatcacttattaaaaacttagtttattgaagttctttaagagacattgtacttttaaagaattttcataatagcctcaagtttcaaacaagtgaatgtctgtaattgacagccaactctaatgagagttgtggtgttggaaattagcttagtatcttcaattctttaccctgaactggtttacactggcacttgtagattgcatgttcttattggaggtgacattgagagattacattaagttggttatcgatcatactgtataggttcactttactaaaatgtaatctctgtttcaacaaatctaaatctgacaaaatatgccatttttatgccttatggactcagaggttataagggggatgagaggcaggttgcagccccaaactctgggcatttcaaatctagcccagagtgttatttattaaatcaaatgatacatatgaaaatgtttcctatatttaatatgcagatatgaaactatagtactttaaaaagtacaaaacaagtgtcattgaatactttctatctacaaaacattctggagagtatttgaatgaataaatcaattccctccagatatttagtagtaaagaaattctttatgccaatagtgatttatctatcctaattatcataacagaagtaaaacaaaatagtgaatatatttattttattatttctagcttatcttattaattgtgtcagcttcttttcctatttttcctcgtatgagttaatctggtcttattctttctgaactaaccatatcctaccctgactttaccaaacatacaaaagtaactatagccaaagctactaatattaatctggacttccttatgcaaaacaatgttcacattcatttaactgcggactctaatccccagagcctatttaatcattattgtgatatcgtttttgttacttcaaacatttggcatgcaggcagaaacatgtatatgtgtattcctgggaaatctatcaagcagattcccaggaagtctcctaaggtgatattgattacattcataatattattattgttcagagaccttgttgaaaaccaagaggtggtgaaagcctaagcgaatgacccattaaataaaactcagtagactgatgtatacaactaaaaagccaattaatttaatttatgagaaataattatctagaaaccctgaaactcaaaattataactactgcatcctctctctatggcagttccacataatcagctccatttgggggcttagaatcagcatgaaaggaattacataaatcacatgaattgatgacatacggctaagcctgtttgttgcattattttgctacttcagtctgctggataaaattcctctccattggatagtgctttgacaatcaccaaccacttctgctcctacaactctattttttttccaaacttttaaaatggaacaaataccattctgctcatttcttatatatatatataaaagacatgacatatatatatatatatatatatatatataatgtcaaacagattaaaattagttctttctgacttacaaatcaatccatctcatataggttagtttacatttttctattctgatccatgtaccaattttaaagtttaactctttgcagataattgtattcctcacatgtccacattgtggggacaccaaagtactcacagcatattctctaaggggagatgtctataagtcaacattataaaatatgaacattatgtttactgtcagtgtctcagttaacaaaataattcattgattctcagatccatatgatttttcacaatttcaacatctctgaaatcagcatgtgtcttactatcggtagcatctcacaatctctattggccaagccgagacggtggcatgggtgtctcttcctgtggacatgtggcacttgtatcaaaacttgaagaataggcctcagtgccttagaggaaagttctggagacaatagaggctcaacctttttaagaactctgtcaccaatgcttttgtagacagagagaaccattcagagggcacatcagtgattcaagccgcaaagtgtttcaagagcgttagactatgaaagagaagaaatttggggaatggctcaaccaagtcatgtcacttatgttttccttttcaagtatgcacaaaagtgatataatttttaaaagattagaagagctcttttgagatgcttcattttctctttcttaggggttcacgatagagtggtgtatcttacaatccatggcctcctaattatgaaatataacaatgcatactttcaagtaatattccatctgtatacatttattagacattttagaaatactaggagcagaaatcaacatctttttcaaggcgggcaaatctttatttactcctttgtaaaggatcattttagaaagtcatttccttattctgaaatatgtagtggataaatttaagtaatattttcaaattctgtcctaatagcaaatggaaaaattaaagctgttgattcatgaagtatgatgatctattctattaccacagagtcaaagccattacatggtttgcctgtgaaaaaatagtagagaatacaaatttgtgtagataagatatgggaagaaaatgtcatgtttaaatctgtaaatggaattccctggaaaagggttagcagcaccactattaccgatgtgaaaaattcagagcttcttgcctcttcctctctgatccagagatgctgctgagaaagaaacagctctgttttgaagaggctacagcaggcaggcatcttcatgcttacacaggcctctctctgctgaggtggcctcttggggaagcctcacaaaaactccctatcctcagctcccaggatcaggggagaaggatgcccttgatggcctgcggagatcttgagacaaggcatgcggccaggacagacgttgattggcatgaccctcagtgagaatctcagtgaccttcctaggacctcctgggtctgctagggcacatcagtctctgagtctctgtgttgcccacagccttctgtctgcactttcctatttgacagaaacagcttcataaaagcagttcccataaattgaattcccgtggcttgacctaatttactatctccatatgtcggttccaaatcagcagcaggcatatttacagacctgggttggttggcttacccaattaaagatgttaagtaattaaagtgtattactttttcaagtatggagtattatttttcaaataatgcagtatatccttatatactgcactatttaatatgctgttctaatttaaaaaacaataaatatcattactatgagttaggaataaaataactggtgagttatatatatacaaatttatatgtatatttgatataaaattatatataaatataaatacatttacattgtatacaattatatatgtgtaaataatatttattatctcattatagatatatagatctattaatatatagatagatgatatatatagatctatatatatgatatcaatatatgtgtatagctatagatgatattaatgtggaatcacaactagaaataaatagtaggcaaaggtaattttgaggccaaaaatataaatacttataatctctcacctttaattaattcagattttaaataattgaccaacttattttaaattattttctatggaatttctgtggtgttttacctctctaaaagtgtgtgtgtgtctgtttgtgtgtatatatatgtgtgtgtgtgtgtatatatgtgtgtgtgtatatatatctacatatgtatgtgtttatatataatactttataggctatatgtcagtaaaatatttgaaaagttttattctgagccaaatatgagtgaccaatggcccatgcatgatacggcccttgggagatcctgagaatatgtgcccaacttggttttacacattttagggagatttaaaacttcaatcaatacatgtaagatgtacattggttcagtctggaaaggtgaaactgaagcaggaaggagttagggggcaggggcttccaggttataggtaaattaaaagattttctgattggcaattgattgaaagagtttaattatggtctaaagacatagaatcaagagaaagcaatgtctgggttacgttaaggggttgtggagacaaaggttttattatgcagatgaagcctccaggtaacaggcttcagagaaaagtttgcaaatgtttcttaacaggcttaaagaatccattctatcagtcttaaggtctgtgttgatgttaatgctggtcagctgggcctgaatttcaaaagaaaggagggtataaggaggcttatctgactcttcctttctatcagggtctgaactagcttttcaggttaactttaaaatgcccttggccaagaggtggggtccattcagttggctgaggggcttagaagtttatttttagtttacatagatacacacacacccacagagagagaagaggaaggaaggaaggaaggaagggagggagggagggagggagggagggagggagggaaagaggaaaggagggagaaaaggagggaatgggagggtaaagaatgaggcagaaacaaaacggaaatacccttcacagctaacctgtgcatttgtgctgccattgggcttgtcattagttgtgttggttgttccttgcacaagggcagccagactagtgagtcagggctgaaatcagttcctgttccacttggaaaccacatgctctggcacccatctgcatttgtggggaaagtgacacctttttctaattcatgcaaagacaccatatgggctacctgtggcctggcaacagagtctaccacttatacccacagaagattaagcatttgtgctcatcattaccctttccagccactgtcttttaaaatctagtgacacttcagtgcaaagttgtttaactgataccttgtttttggtgaattgagtagatactggcaacctaacaaaccacgagaatttggacagaggcatccccaaaaaagcagtgaggaaaggaagtgtttgcagctaaaatacatttaattacatcctgggaccacttcaacatcttaagcatgtggaccacagctacctcttcattaggtgttgctctctatttgatttacagaatgcagggtcagcacttgtgaattagcgtcgtgaataagacattcataaaaccttatcagttcagaaccgatgctaagacaagacgcaggtctagagctcataagactggtgacaatttcacttatttatgtcagagaaatgttacacctgtgtttttatagcataaagttggtgagccttcctctgtgcaaacctcataagccagacaacacatgcaattaattgacagagacaagagaatccccatttctgttttctgcatggctgctttgcttacatttcagcatactttacctcagttttatttttgaacttgatctagtttggattttgtacacccctaaaaattacctaaactcaattgtaacactagactgctgctgaacgtcatgcttatagagttggaagtgttctgttgaaggatcatttatccaaaagcaacagcaaagatttatcgatacctagtaaaattctgccattccatccttcactgtccagctcccttctgaagatcggatattcttttaaaggcaaataagacgcatagtggtattttacttggaaccttatgagagagaactcaatatatttgaagaccctggcatttgtttttaaaaatactttattgtgtgtgttttttctttccccatcatagcattgttaggggagaaaattgcattatttaaaagtatattatgttagaagccagaagtcttgagctatatttctctgctgtctgtataaccctgagtccatggacaaataaatttgctttcctgagcctttgttttcctgtttagaaaatgagacaattgatctagataaaatttaagctcccatccaatcataaatgttccataatactaatgtagaaaaagcaggttactcagaactatttctgaatccaaaaagatagatagatagataaagctactttataaattatgaattttttttgtagagtctgagactttatgtaaaagagaaagagagatggacatacagagagagagaaaaaacaaaacaaaacgaaacaaaaaacagagaaagaggtgctggatatatttggaccctcctttgtgagaagggaaaagatgatcccaggagaagatgggatcatctcatccaagaaaagatgatcagctagaaccagattgctggggtagtctagaacaaacatttcaaaagaggttcactactttatgaggagacagttctcaaacaagaggatactctgtgaatagatgtattagaatttatcaacagaagcactctttcttcaccccttccagctatagtaccctgaatattttgatattttaatgcaaaagaagacatatttccctaggttttaatttttgactacccaagaaaattatcaacctgtaaattgcttttttctctatattgatataataattagaaccaagctaatcagatgtgccattatgttctttccttcacatcatagtgccaggcaacattgaggggacagctggccagcctgatgccaaaagagaggcatctaagcctcttcaggcaactgacatttataggaattatggtatagcatcaataattcacacaacctcacaacaagtgctggtaagcagctggtctgtagacaggggcctcatcacttactcatgtttgagacatttatactggttcattgccttaccttaaggcttctttaattgtagggaccacgaaaagaatgcagcaactagcaattaaagcaaaagtgctgctctgcattataagggtatatgttgattacttcatggagagggtgattggcttttgaaaccctaagtgaatgtttggtcacaaaaatctaacattttaaatgatcaatttatttctgtttatcatttccttgagctgtgaattgaaaagaaaaaaactctaccacttattttatagaatcttagacatttagtattgaatgtttccttagaaatgatccaattctttattttgtttaaaaaacaaagatctagagaactaaagtaactttcctcaaatcagacagctggttagtaaaagttttaagactagaactcaagtttggtgaaaatgtttcccctaactgacctttgcatgcacaaagttcgactgattataatccttggcttgggacagactgtcattattcatcaataacttatcaacttttattttacaataatataataaaggcttatggacccagcagccctccaaacagcaaggagcatgtcaataatatgctgaacttatggtccttctcattcccctttccttctccctttgctacctagaagtaaccagcaacctgaatcctgcattttcttgatgtactttgcatagttttatggcatgtaaatgtatgtcttaaaaatatatttttaatttataaaatgtgtatcatgctgtatataacatgacataatattgccaagactcatccatattgttgtatatgcctgtatcatagtgtatttttcactctcccattaataagcttttggattctctctaagttttttccattgtgaacagtgctgctatgaatattcttgtaaatgtcacctattccaaaggtgcatgagtatcccaggggtatatacttagcaagaatttcttggtataacactatacagttattcagtttcagaaattagtgacaaactatgtcccaaaggggtggcaccaatatggactttcaccagcagcgtggaagatcctgtagattgtatctatctggcttttactgtagagggccatacagtcattattgttggctctatgggcctcatatggtttctttggcagctactgaactctgtcattgtaggtaaaagtagccacaggtaacacataaatgagtttcataaattttcacagtataaaatattgttcttctgcttctttccaaccatttaaaagtgtaaaaaacataatttgtgagtcacacaaaaacaggtggcagactgattactttttctttcctcatcctatcttcttttatttattttttatttatttaaaaaaattattgatagcctgttacatgccataacccgttccaaattgatatggtttggctctgtgtccccacccaaatctcatgttgaattgtaataatcccaatgcatcaagggcggaagcaggtggagataattgaatcatgggggcagtttcccccatgctgttcttgtgacagtgagttctcacaagatctgatggtctttataaggagcttcccccttcgcttagcactcattctctctcctgctgccctgtgaagaggtgccttccgccatgattataagtttcctgaggcctccctggccatgcggaatggtgagtcaattaagcctcttttcttcataaattacccagtctgttatttctttacagcagcatgagaacggactaatatacaaatactgaggattctgtccgtgaacaacttataactttcctgctctcacagagtttgaactctaatcagaagaggcagaacatagacaaatgtatatattctaagcaagtcatgataggtattttaaaggcagattcagagaagtagatgctggtggtaggaggtaatagtttacatagaatgatgaggaaagccctgtttgatagaacaacacaagttgagttcatttttaaatgagggattggaacatccaagtatctgaggagaaactactgagtgagagagagcagcaaacctctacacctcctcccctgagcttttatggttctaatagcatgctgatatctcttcccaaatattccacaagctcctttaagtcttcatttgccaatctaaatttatcatctactacagccttggatttcctaacttggtgaagggcacctgtgtgaactcatcactcaaaccaaaacccttcaaattttcctgcatcttaggttgccttttactccaagcatcaatttactaaacaagtaatttcattttttcccttagtatctgtattagtttcctagggctgccataacaaaataccatggactgggtagcttaaacaatagaaatgtattttctcaacttctggagtctaggatcaaggtgtctgtaggtttatttttttgtctgtggcctttctccttggcagatgacagctttctctttgtgttttcaaatggtctttcctcatttcctcttcttgtgaagacatcagttggattagatgaaggctcaccttcctggcctcattttagctttatgtcctctttaaaggtcctatctccaaatatcgtcaaattctaaagcactggggattaagacttccacatataaattttgagaggacacaattcagcacatgagtatcttctaatctaatacctttcctctgcttttattgctaccaccttaccatttccttcccttttttatttatgtttattggttttctgattctagattatactcttaatgatcaattgtccccaaaaccagcagaatagtcctacaaaaataaaaatgtgatcttattttattctgcttgaatctttgatttgttccccagtagccttcaggataatgtccactggcatactgtatcctcaaagaactgcaccatctgcatccctgttcttcctctcaccaggtaaactctcatgctgtcagctacaacaatagtaaactatttgcagttcagggcctttacaaattttctttgcctgaaatttcatctctgccttaatccagtctttttaagtgacagattaatatattccaagaagcatggctcaatgtcatctatgaaaaacattagcataccatcattttcaccattgtctgagttagctgttcttcctctgtctcccaggtcatgatatctttcatatcactgacattgtataggataattatttctgccttggactaagtgcctgtgaacagggactgtgtcctgatttattcttacatctttagtgcctagcaaagggctgctcctcttaggcacttagtaaatatttgttacatgagtgaatgaataaatatataaaggaataaaaatgattagatagaagaaacatttttgtatattattttgatactctaaagctaatattctaatggtaatcaatatagtttaaaaataaaccattcaattttactaaacaaaatggtgaactataattggattacatggtataattatgacaatatgcatataaaaattaaaagcctacatagcaaattaatacaccaataattactaaaaataatacactaataattaaaagtggttgtttctggttttttttttttgcaaatgattaagctgtacacaatttattctttttttatacttttctgtatttttcaaataaacttgattctatgaaatatcccatgacccaattcatgttaagcaaatttactacccttttctcaacatcttcaaactgttttctttacatttcactgtttagaaaatataaaatgatatctgcaacaaattacattctgctacaaatccacattttcacgacaagaacaaaaaaatgcataacaaggcatagaggataaatttctctccaacccactgtgaaattttcattaagcccctcatatcttctccaggtctaggccctaaggacaaatgaagagtctaatctttgatcaaggcttacttcaagccaaaattatctattgctctagagaaactcttccaaatggtcataccctgctgctatgaaggtgacagtcctccccactgctcacatattgcatagctgcaggatgcgaggcaaagacttgaaaaacaagattaaaccttactcaaaacattatttccattaaaattacatcacaccgaatatcattacctaaatatttttatctttctgtaactcttacaaaacaaacattacccttgaggcaaccttgcagaataactttcacttaggagaaatgaaaaaggaacagacattataattgtagggaaagaataaaacaataatggtgcactttcttaagaccttcccttatttttttttttttcatttgctgattatccctttggccaaatagtagaactgtggaggttcagagatggaaggaaccttactgatcatctagtatgtatagcataatttacagttgtggaaatttaaagcccagataagccaaggaacttggttaatgtactgattcttcttcctctgggaaacctaggaaatgaattggatgataagtgacatggctctgttattaatttcagccatgtgattgatttcacaggttcttcagttaaaaagacttgggttctgtcccccttttaccacttaccatctgtttaaccttgggtagattatttaggcctttaaaaacctccatttcctcagttgtaaaatatcaattttagaggacctatcatgtaaagaggtgttaggattaaatgacaaattgcttagaactgtacttgggatcatagttggctactactattgttgttgtcatttatcctacaggtaatcctactgtttgagataaggcattctgggagacaagatttaagagcttttgaagaagacaactttatcacatttgcttcagactgtttagtgtgtgtccagcttcaatatctctctgtttcttagacattttaaagactgttaaaggaggagaaaggccagattacaacaattgttgacatttagtgaaggcttagtataaaacaggctctctcctaagtgaattttgtgtagtaacccatttattcctgaaaacagcttcacgaagtaggcaggcactgttctaatatctgctttgaagatgaagagacagacgcaggggttggtttcaacatgtgaaagtatattttattatcacctcccacattcacttctgcaattccaacatttgcaaggcaagagaggatttgccaccctctggtgtctctttttttttttttttttttgagatggagtctcgctccagtcaccaggctggagtacagtggcccagtctcggctcactgcaatctccacttcccgggttaagcgactaccctgcatcagcctccccagtagctgggaccacaggcgcgcaccaccatgcccagctaccctctggtatcttgggtttgatcttctgcttcgggctgtggcttcaggagctggcagtggcttgcgtggtggcaggagaagttcccaccagtcctctggctgtcataacatgcatttcatagctctcaccatatgtaacagtgagcaagtttttatttatcaaaaaggtagcctttgatgaggggcttgactacctgcttatgaattaacaaatagcagatataaagatttctaagtcatgctcttagggcaagaaaatgctttgaaatactatctgatctgcttattttctgggttttcgccttctccaccccttccaagtcaaggtctgagtctgagttctattggatattcactacaactgagagttattattgttctcagctttgagccttaaactaggcttttagaaactctaagcaagatagcagttttaaagggaagaatttttcctgaatgactaaattaggttttatcatagtcaaaagcatagattaaccaaggcaagctctaaagtaagaagcaatatggtaaaaagagagcatggtaaaaacaaagttcttatcacatcttaaatagaaaggcctttctattaatggtatacaagagagaaagcggaaggagagagagaagagatgggagaggagataggaagagaaaggggtagaatgaaggaaaaaaagaagaaataaaattgctgtgaaaggagagcaaaggatagcagagagaggaacaaagcaaaaccagacttccctcctcccctcactttctgcttggtgcccaaatccagagcagaggcagaatgcagagatacccagattgttttcagggaactaagatagggagacacataaggatcatctccttcaataaaaagagcgttgatgtcctcataaattttctctattcttaatgtgtcactctcctctaacagccatagtcagtaaactttttatgaattcccttcttagctttgtgactcatgtctagatttagtagccctgatctctgtttatcatcccttaaccttagcattcaaatgattcaccaatttatgcatgcaattgtattgtgatgccttattttccaatctccaaagaagtgtcatttgggaaatattgtacaggtctggatataaatgttactctatccaacatgtaactcatatttacaaattgaaaaagtttcagaatttttatggggacatttaaaaacgttaggtggcttaaaatattccctactgatgtacatcatctcatttgaaataatgtattcgatggaagcaaatgatctagtgaagagtattcttcatcttgctttccataataacttacggccgtatctcagttctcaaaatgcttttccaattacagctagcacttgatcatttgcgtgcacagcactttacctgaacgattgttgtggcacttttacctttctaccttgccacctgtcctgagaccctcctcagaaatcgtagttgctgagtctggagtagagaggttggtgactatgcagtaaggatacactgtgtctaacttagaatcttacaagatgtcactgacctccatctcctttgaagactctccgtgacctctaaaagttggagttcctgaggccttaccctgggctttcttctctttgcttgacgtataaatgttttgtttttgtttttgattttttgttttttttggcagtcatctcttccatttccatggcactaaatgccgtcttcatgctgcagctccaacatctgttaagctccagatgtttatatcttgttgtttaccaggcgtcagcatttaactgtctctcaggcatccccaatctgacttgttaaaaatgaaacttttgatccctccaccaggaaaatgtgttctttcattattcatttagacaaaaaactggcagtcatcatacacactcgtctctctttctctccttttctttttctcactctcttttactacctgccatatccaacccaccaataacttctattttttaaatttctgtcaaatatatgttaaacttattgaccttacatccactgccatcaccctgattgtagctactgtcacctccattcagggctacaagatcttctacccctacctaccccaatccattctccatgtaacagacagagtgatcttttaaaaacagaaattcgattgttttgcttccctgcttaaaacctgtcggtgcttcctatcattctttgtgttaggtatccacactccttctcggggtctcaaaccttgtgcagaatggcttcttgctaacctcagcctgagccccatctcattcattcagccttttgttttttctggaactcaccaagttgtttctcctcttacaacctttgtgtcagaggcattcaaaccagagcaactccatcttgaataagagctgggtgaaataaggctgagacctactgagctgcattcctggacatccttaggcattctaagtcacaggatggaataggaggttggcacaagatacaggtcataaagactttgctgataaaacaggttgcagtaaagaagctggccaagacccaccaaaaccaagatgcaatgggagtgacctctagtcgtcttcattgctacgctccctccagagtcatgacaatttacaaatgccatggcaatgtcaggaagttaccctatatggtctaaagaagggaggagtcctcagttccagggaattgcccacccctttcccagaaaactcatgaatagtctaccccttgtttagcatataatcaagaaataaccataaaaatgggcaaccatcagccctcagggctgctctccctatggagtagccatttttttatgcctttactttcttaataaaattgctttcactttactccatggacttgctctgagttctttcttgtgcgagatccaagaatcctctcttggggtctggattgggatccctttccagtaacatttgtaccatctcttccttctatctagaactttcccctgtcccacctacccatgcccctcactcccaacccagccttatcctccatcacttactttttgatcttttaggaccagttcaaatatcaattgttttgacacggtccatgttcaccctaaggagatccttcctgttggtattttttactaaaatctatttatttcctgaaaattacccatcctattgaattcttatttagtctctttccctgtttcatcttttaagatattctttgaaggtcaagtccatgtctgttttattcaccactaacaagccccattacctgggcccatggtaagcagcttattgaatgaatgaatgaatgaatttcccaccaataacatgtgagttagataggaactacctcaagctcatctcagagaagtgctttttcacatgtctaaatcccccatccttcagccccttcatcacttttcttaaaaagcacttggggctggttgcgagtaagagtgggaaattcaaatttgcaaagttagttcctgatagttcggaaacgtgtgtcctggggatccaatcatatgatcatttgttctgcttcaggttctttgctagccacccatatcctgctccagtcaattcgcaccctttagttcccaagggcgtaggtcagaaacaatgctcagtactttcaatcctggcattgccagcagcaataggtcaggcaaacactggggttgctgggaccacttagaatgtggaatgggaaggagcagttctaagatcattaatggtttcagcatagaaaaacaaaagtccagagacctgccaaacccctgtggggtaattgtggttctgtaagaacttggcctctgagttcggcattgcctgtaattacagcctttctttctttctttttttttttttctactttaagttctggaatacatgtgcagaacgtgcaggtttgctacataggtatacatgtgccatggtggtttgttgtacctatcaactcgtcatctaggttttaaatcccgcatgtattaggtatttgtcctaatgctgtctctccccttgcccccgaccccgcaacaggccctggtgtgtgatgttcccttccctgtgtccatgtgttctcattgttcaactcccacttacgagtgagaacatacagtgtttggttttctgttcctgtgttagtttgctgagaatgatggtttccagcttcatccatgtccctgcaaaggacatgaactcattcttttttatggctgcatagtattctatggtgaaattacagcctttctattcagcatcctcatttgtaagcctctgaaatgtctgagattatgattatcagtgcataagccctacactgtgagcttactaagaatattttcttatgtctgctatcattgggtgatatggtttggctgtgtccccacccaaatctcatcttgaattgtagttcccataatctccacatgtcatgggaggtacctagtgggagttaattgaatcatgggggcggttaccctcatgctattcttgtgatagtgagtgagttctcatgagagctgatggttttataaggggcttttccccctttgcttggcactgctccctcctgccaccatgtggagaaggacatgtttgcttccccttctgtgatgattataagtttcctgaggcctccccagccatgctgaactgtgagtcagttaaacctctttccttataaattacccagactcaggtaagtcttcattagcagctcgagaatgaactaatacattgggctaaaataaactgtcccaatatataaggaccacgttgtaaaaacttctccactgcttccgtcttttgcctagaacatagaacaggggttaaacgcttccatggtgtgtaaagttgagtgatagattaaaatgtaccattggtcaagagcagtagctcacacctgtaatcctagcagtttgggaggccaaggtgggtcaatcctctgagatcaggagttcgtgaccagcgtgaccaacatggagaaaccctgtctctactaaaaaaataaaataaaaattaaaaaaaaaaattagccggcatggtgtaatcccagctactcgggaggctgaggcaggagaatcactttaacccaggaggtggaggttgcggtaagccaagatggcaccattgcactccagcctgggcaacgagtgaaactctgtctcaaaaaaaaaaaaaaaaaaaaaaaataccatgaactaggtgacaaaataacagaaatttatcctctcatagttctggggagccagaattctgaaataatgatgtccacagggccatgctctttctgaagtttctggggaaaaaaatctttccttgcctcttccagcttctggtggttgcaatccttgagttctttggcatgtcactgcatccctcccgtctctgtcttgtcatcacatggtattctccatgtgtgtgtccatgttcagatccccttttcctatgaggataccagtcattggattaaggctcattcttactctaacatgttatcttaatttgattacatctgcaaagacgctatttccaaataagatcacattcacagtttccaggtggacatgatttggggatgatactattcaatgcagtgtatgagggttcacttgtattcagttatatcaggtaataccattaagtgtttcttaagcttttaatatttgaaaacaaccttattcacaataattgataaaataactacatttcagaatttaaatatacctgaacaagaaatgacaaatggttgtcaagtacttttatgcttagaataccatgctttcctcatgcaggaaattggaacagaccctggtcatgggcgtgttaaatcctcctctttcatccaccactgatctgtctcataacttgatcactcctatggaactgactgtcatttctcagtttcattctaggaggcttaaaagttctacagagcaaaagtatttttcttcctctttttgcttttttgcttgttacttttgttgaggggtcagcaaatgtcctctgaagagccagatggtaaataatattagtaacattaggctttgtgggcctcacggtctctaccacaactattcaactctgcctttgtagtgcaatggcagccagagataacctgtaaacaaatcagcatgcccaagttccaataaaactttatggacactgacatgtgcattttatataattttcatgtattgtgaaatattattcttcctttgatttcccatccatttaaacctgtgaaaagcattcttagctggaagactgggccaagaagaggtgggccagaatttgttttctgatttctgccaagtcttgttccctctctcttgttggttgtctgcctttgctccaccttttctggcatagaggacattctgcagggtactgtgtttcatatcctttttttcctttcccttctcctcctgcctttgaccttccctttccttttcttccttccccctcctactactatgtccctaaaataaatattcactacccctaaactatatttgatcattgcacattgattactgtaatcatttcctattttctaaaaatttgatgagtgtgatgtaggtcatggtgataacatgagggtagtcattctcttatttagaggtagaaattagatttaaatttctggcataatataagtatgaattgtaataatcccctgaacattattagaaatgtagattttttctcttctgagtgatcagcctccaaacatatccaaaattggagagagcactgtaaaagtcctgtgtccccgttactcagcctcaacaggtttccattcacagccaatgttgttttatttgtacctctgtctcctccctcctgtgaaattattttgaagcaaattccagacatcagtattttcactggcgtccctgtgaagagaccaccaaacaggctttgtgtgagcagcaaggctgtttatttcacccgggtgcaggcgggctgagtctgaaaagagccagcaaagggagatggggtggggccgttttataggatttgggtaggtagtggaaaattacagtcaaagggggttgttctctggcgggcaggggtgggggacacaaggtgctcagtgggggagcttttgagccaggatgagctaggagaaggaatttcacaaggtaatgtcatcagttaaggaatgaacaggccattttcacgtcttttgtgattcttcagttacttcaggccatctggatgtatacgtgcaggtcacaggtgatatgatggcttagcttgggctcagaggcctgacaagtatattttagtatgtatctcttaaagacattgactcttaaaaaaaaatatatatatatatatatatatatatatatacacaccatcatagtaacatatctagaaacaattaatacaaatttcttaatgtctttaaatatccagtgtttacatttccctaattgtcctgtaatttttttatgtacaatcggattgaattgtaacctacaaactgattagttgatctacttcttaagtctcttaatttttagattcaatctttttctgtctctctttctttctctgtttctcttccccctattttaagtttatttgtaaaagaaagtaagtcttccgcctgtggtgtttcctacagtcttgttaactgatatcttcccagtggtatggtctagagatttgaggaaatttatgttgtatttgtttgttaataatattttataattgttgcagtatccttccatcaagaggtccaaatgtctacttgtcgttcttttgtggtgttagcagccatggatgaccattagtgtaattattagcagttgcaaaatcatgatgttcttcatacagttggggtatttatcccttaaaaaaaaatgctacctgttgaactagatgattatcctgcatttttataggaattataggacaagtgtttatttttttctttaataagatttcaaaataaatttgttttctagtattctccaaaggcaatcaatgaaacctaatgtttgtttattaggcattatgtacttcagtctattttttttttttttttactttaagaacatattttatttaacccaatatatccaaaatattaccacatcaatgggcaattaatataaaagtttattaatgggatattttacattcatcagttcatcctacatcttttttttttttaatactttaagttttagggtacatgtgcataatgtgcaggttagttacatatgtatacatgtgccatgctggtgtgctgcacccattaactcgtcatttaacattaggtatatctcctaatgctatccctccccactccccccaccccacaacaggccccagagtgtgatgttccccttcctgtgtccatgtattctcattgttcaattcccacctatgagtgagaatgcgcagtgcttggttttttgtctttgtgatagtttactgagaatgatgatttccaatttcatccatgcccctacaaaggacatgaactcatcattttttatggctgcatagtattccatggtgtatatgtgccacattttcttaatccagtctatcattgttggacatttgggttggttccaagtctttgctattgtgaatagtgctgcaataaacgtacatgtgcatgtatgtagcagcatgatttatagtcctttgggtatatacccagtaatgggatggcagggtcaaatggtatttctagttctagatccctgaggaatcgccacactgacttccacaatggttgaactagtttacagtcccaccaacagtgtaaaagtgtttctatttctccacatcctctccagcacctgttgtttcctgactttttaatgattgccattctaactggtgtgagatggtatctcactgtggttttgatttgcatttctctgatggccagtgatgatgagcattttttcatgtgttttttggctgcataaatgtcttcttttgagaagtgtctgtttatatcctttgcccacttgttgatggggttgtttgtttttttcttgtaaatttgtttgagttcagcaaagtctcaggatacaaaatcaatgtacaaaaatcacaagcattcttatacaccaataacagacaaacagagagccaaatcatgagtgaactcccattcacaattgcttcaaagagaataaaatacctgggaatccaacttacaagggaagtgaaggacctcttcaaggagaactacaaaccactgctcaatgaaataaaagaagatacaaacaaatggaagaacattccatgctcatgggtaggaagaatcaatatcgtgaaaatggccatactgcccaagctaatttatagattcaatgccatccccatcaagctaccaatgactttcttcacagaattggaaaaaactactttaaagttcatatggaaccaaaaaagagcccacatcaccaagtcaatcctaagccaaaagaacaaagctggaggcatcatgctacctgacttcaaactatactacaaggctacagtaaccaaaacagcatggtactggtactaaaacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtaggaagctgaaattggatcccttccttacaccttatacaaaaattaattcaagatggattaaagacttaaacgttagacctaaaaaccataaaaaccctagaagaaaacctaggcattaccattcaggacataggcgtgggcaaggacttcatgtctaaaacaccaaaagcaatggcaacaaaagccaaaattgacaaatgggatctaattaaactaaagagcttctgcacagcaaaagaaactaccatgagagtgaacaggcaacctacaaaatgggagaaaattttcacaacctactcatctgacaaagggctaatatccagaatctacaaagaactcaaacaaatttacaagaaaaaaacagtctattgcaattgttactcttattcatgatcacattgtcccatgttcagccagtgggtgtaccttccagttggtttttaaatatttatgacatgaccttcgttgtctgctgtttcttcctttgggataaaacaggttgttctcagctaatctcttgccccacatctggagcctgctacttctctgccccacccactttgcttctctgctcttcatttggaataggaagcataattcatttacctctgtggaaactctgttgttttagaaggggagatgccactctagcagtactatcagagggtaaataatggaaccaaccaatccagcaactctggcacttctgaaatttagacaagggggtcatgttgtgtacttggaatgcacctgcattatgttgtggagagcaacacaggcaaactctgaaaaccaccctcatgtgtggctcactctgaggccttcaataatgtgttctttggaattcagatctgctcactgcacataggttgcaatagacatcatattattcccataatagtcttcaataaatgcttctgaaacaaatatcaatgaataaatgacattttcagcttttagagatgaaaatgacctagcccattttgtctgatactccatttttacctcaggaaactaaggccttgatatttcaagtgatttgtccaagttcatagtgcaaagtagcagatttaatccccaaatcatctgacctcaagtgcatcgtttcctactatacctactgcctctagactgtattagatcatttagcattaattattttgatcattgtccatttcttttttttccttccttctatagggatgaaaaaactttctaccctctgaatttttgataattgagcctatgaaatcaactgacagtagacacattaacatgaaacagaaattttaattactgcaaatgcatggagtcccacaaaatatgggactggaaaatgtgttcgatgactgaagcttatataacatcctgagctacagaaaggaataggggcctgaggcttctaagggtggtggtgacacaaattatgtgaggtgaggaaaggaaatgcatgtcgagcaaaggttaccttgtcatgcagataaagtctctctggtaataaaagttgtcttcaagcagccctcagaagaataggtgcgagtctgagtcacaatctgggcatggtgtccgcccttcttgtgatataaatccatcttccctagttgatgagattcccagagagacaattcatgacaaatgtgtttctttcagaggacctgcccttcattagaaagggaaagttcagaaaaaggttctccctgcgcttttgggggagaaagaggggcaagaaacggaacagaagagcagagagaacttggttctccttcagttcaaggcactcaggatatcaaagcatcatattttggggtattgttttgtggaccccagcacctcctttatttctctttctctctgtccctcttcccttctctctctctctctttctctctctctgtgtgtgtgtgtgtttgtgtgtctcttctttctaatgtaaataacatgagcctcctgtgattgttgttcccataatagtgagtagcaagtctaacaacggttcaggtaacccccaggcaagcaaaccaaaaaaaacagcctgttcaccgttcactaagctgttcgtacagtacatccctatgcccatttccaagtcttagatgactttttctagcacaattcaaaaagtactttatttcacaataataataatagaaactcagaagctttactttctcacttacctaagtaagggtggtaatgttttaggctacagaaataatcatcacttaccataaatgaatcaccttagtgttgccagcatactgaaaaagcaaatgacaaacaagataattttgatagtcactttattgccttcctgtgaagtgctaaggaacggatttattttcttgaacgtttccccttggaggatctgctgaaatctttttaattccgaaatcagagatttgctagcttagcatttggcaaaaatgatgatttatcctatttaagcattaaactatctatgtctatttgggtttcaggtgaccagatggctgagcagggcacctttacatcttttattcttaattttatttcattaactcagcaagtatttattgaccactagagtaccaataccagataacctgtaagggaataaggattaaacagtgaaaatggcacccatagggaccttaacagagtagtggctacaacaaatatgttacagagacactgtgataaatgcaaacacagacataaacataggttgttagggaagcatacggaaatggacagctgatctgcgcttggccttgcattgcggttttgggaagtgattggtattttctgacaagtgctttgaagctgagacctaagggactaagcaaaagcagagtggcagtgtcctgcatgggggcagaatttgctggatttagaggcacttgaatattttgataagcctcacagagaattttttttttaatgagtgaaatcaccaaatgcatttgtacttttgttaaaattaaagttgagaacaccaattttagtccctttgaatatgttaactgtgctatcttcaaggttttctttctccaaaaagctatttctagctaattatcctcactaaggaaagtgatctgtcggactgtgttgctaaggctcctcacaatgggggctgctgcagtgactagagactgagtcaatgaggaaaattaaatacttccagggactgattatttgggaattttcttccaagggaagttcagagaaagcccctccctgcccttctgggagaaggggtcaagaaacgggacagaagatcagagagactttggttcacctttagttcaaggcactcagcatcccaaggcaccacactgtggggtattgttttgtgaggcccaacatttccttcctttctctttctctttctctctgtctctcttcctttctctctctctctctctctcttctttctaatgtaaataatatcttttgtctcatcaaagagtctttaattaagtctttttcctgggttggaagcaatgagaaagggtcacaaccccgtcaagggaaagtcacatataacacagcccgcagtgcccccaaggatgtaaattgcttggatgtgtttaatcttcccatgtttgaagacacagactgtgatgtgaactagggtcaacatgaaaggcagcgccatcttaggtgactttagcctgttaatagggaatcctcctgtccttttcaattgtatattttctgctgcatcaaagcttttcaggtaacggtgtcagaaagagcataatctctcaggttagcctggtacaacttaagtttaaactaactgctaactgaaaataaaattccccaacaataataaaaattttacaaagttaaacactaaagaattttttaaaatattgcataaataatttgttgtaggttataaatgtgtttattatttatatgctgcctctcattatttagatgaccctagcaggtgcctgaaaatgaacgtttacatttttaggttggaccataattacttattttgtgtatcttcttcccactagctttggtggcataaaatttgttattcatcttcacgtgcttaaggcctagaacagtgcttggaataaagcacattgttcaataaatggaagctcccatgctcacgactctgcttgccctataaggagacagtgtgtacacttaccatagaataattattatcttactgttcatctcagaaaaaaaaaaaaacacaatggttttaagaagtaccttgcaccttacacatacttttatgttgctctgtgaaaagtctttgcagtttagtatcttataaatattgtaagtaaaggtcaaattccacaggggtctataatttcaaatattacttttattgttttacctgtaaaaattttctaagtgttttttttaaacttactgttacagagctatctggtaggatctataaccccatgaactacattttattatttattttattttactttttggaaagacagagtctcaccgtgtttcccaggctggtctcaagctcctgggttcaagcaatcctcctgcctcagcctcccaaagagctgggataataggtatcagccaccacacctggccatcaactacatttcaaatggatgttttataggaatcatcattgatgataatgagagatatctgttggaaaacaaaatgaagaaagggttaaggagtattatcagcactgtcacgcgtgtctgtgtgaagagaccaccaaacaggctttgtgtgagcagcaaggctgtttatttcacccgggtgcaggcgggctgagtccgaaaagagagtcagcaaagggagataggggtggggccgttttataggatttgggtaggtagtggaaaattacagtcaaagggggttgttctctggcaggcaggggcgggggtcaaaaggtgctcagtcggggagcttctgagccaggagaaggaatttcacaaggtaatggcatcggttaaggcaggaaccggccattttcacttcttttgtgattcttcagttacttcaggccatctggatgtatacgtgcaggtcacaggtgatatgatggcttagcttgtgctcagaggcctgacaggcataatatttattgaacttctgtagactaatgggcactgttctgggtagcagagattcatcaatatataaaatctgcaaaagttaaaacaaacaaacaaacaaacttctctgacatcctggagtttattgccctttaagaaggtggtgggccgggcgcggtggctcacgcctgtaatcccagcactttgggaggccgaggtgggcggaccacgaggtcaggagattgagagcatcctggctaacatggtgaaaccccgtctccactaaaaatacaaaaaattagccaggcatggtggcgggtgcctgtagtcccagctactcaggaggctgaggcgggagaatggtgtgaacctgggaggcggaacttgcagtgagccaagatcacaccactgcactccagcctgggtgacagagcgagactctgtctcaattaattaattaattaattaattaaggttgtgggggagacagacaatacaaaataaacatcacaaaggaggaaattgttgactgtcagaaggtgatgtgtgctataggaaaaaatagaggtgatgtaggggtgggaagactttcctttatcctctgagggtttgatgagtgagtgtacgaaataatctgaagggaggcagatgaacaggagaaaagacacacaaatttgttacctacaggaggacatcactggagagaaacctgaacacccaaaaggccagtgagattttgaagcttatataccttcttcccagggaagaaggtagagtggatatagtcaaaatttaggggagagtaaataaattcggggaaagacaaatggcccagagcataggggatagtctgagtgcagggttcacctccaggctcccctcttgttttttgttgtcgtggtggtggtactggtgtgaagggtgaggacaatcagtgtgtttttcccctcagagcaaattgtaaagctaaattagtcattatttaaatttactatagttgcctttataaaaactttaaatttacattatacatgttgaaattgaagctatgcaattgtaatataaacacggatttacaactaaagcatgttataatgtaaataattgattttctgtatgaaatcctaggcaatattgtaaaattgtacagacccgtcaactttttccacttaaatattctgagtaaagtttaagggtgttgtagttttcaagtggttttttttctttgtttgtttgtttctttttgtctcttgtgatccaagttttcttctctggttggtgagattactggggcaaagatttcttgacaattgagttccttttgaaggatccttcctaaggccggtaatgggagctcagaaaaagctcctcactgcatttgctgttctccaggtgccctcagtttgaagcaaccagcatgccacagtggcacattttggggtggtattttcttagttccctcaaaggtaaaatgcagagtgggttatatgtttaaacaggacagttgggtgggcctcagtgaggacgtgccctgtgaatagaggccaaacagagatgagagagctagcccaggggagttttaggggaagcatcttctagtcagaggaaacagcccaggcaaacgtcctaaaacaggagcatctggcatgtttgtttgttggttggtttgttttgagatagagtctagctctgttgcctgggctggagtgcagtggcatgatcttggttcactgcagcctctacttcctgggctcaagcgattctcccacctcagcctcccaagtagctaggatcacaggtgcacgtcatcatgcccagctaattttttgtatttttggtggagacagagttttgccgtgttgcccaggctggtctcaaactcctgagctcaagtgatctgcccacctcagcctcccagagtgctgggattacaagcatgagccaccacgcctggcccatttagcatatttgaaccacagttaggtcagtgtggtgtagtagatattaggagtgattttttttttaatgaagagcaagcaatacgttatgaagtatccttaaataacagggagcgttctctttaaggttcctcaggaatggtcagtcatggatccaagatgacatttacttagcctccaagtttgaattcaagatcaaaatctaattactgttacaagcaacaagaatcaaagagtaacatctccttgctacacaggttagaagactccttattgccacacagatgaattcttgactagcaaatgcacataaaccacatccctacccagtgtgagtgaaaaaggaaagggaagattagcttgtctaagtatcgatgtaaatgtagtcagtaactctagctgtattttaaaaggattttaacatctctacaatggaataaaaacattaacggatatccttcttcctagaaaatggctaatgctttcctacaaaaaaagacacatatgagctccaaattgttcttcatgtgggtgagaatggtctgtcattatttatacttgttcacagtgcttcatctgtcatccatctttgggctgtaattgtgagcttaaaaataatcactattttccaccacctgcagaacataatctgcactttgagctcatttcctcagtgttccctacagagttccatctgctttacataccttatttctctacacatgattaaagctgctgatgctacctgaactgcatacatagctggcattatggaatgcctcaaactaccacagcgtgctgtggtgagatgcctttcctatcagagtctaggcttacaaaaatgcatgaagtgtttctcatatattgcatatttggggtgaaaaaagacaatgacagccaatttttaataagttatgtcagggagatcataattattgatcttctaaacaaaactatctataaatatatggtcttcaacttatccaccgggaagacagatgaaagtttcaaatggatcctcttacaaatgactaaaaaacactgcatcataatctaacattatgttgagtctttttgcctgaatgttttctaaacaattttgtagaagttagttaatactttaaataactagacattgtaactaagaaattattttgtaagttattcaggaaagtacacatagctcttataaaatgaccagtatttgttagtttcttttataaatctgaatgtttatataaagtttacctgaaataagatacatcttgctttcatatggaatatttcatgtttgtttccaatagccaaattaagaaatataatttcaaatataaaattaaagcttatgtaattttctttctttttttttttttttttctgagacggagtctttctgttgcccaggctagagtgcagtggcctgatctcggctcaccacaacctctgcctcccaggtccaagcgattctcctgcctcagcctcttaagtagctgggattacaggcatgcaccaccatgcctggctaatttttgtatttttagtagaggctgagtttcactatgttggccaggctggtctcaaattcctgagctcaggcaatctgcccgccttggcctcccaaagtgcaggaattacaggcgtgatccaccacacccagtcaagcttatgtcattttctaattctactctcctttctcaactcttagaatattttattgatatctgtgttcttaaactttacaaaagtgacatcatgcattaaatgctcctcttacttgcattttctactcaatgttctgattttgaaattcactcatgtttcataaatatacttctaattgttttattttcaaatattttataacaattgtataaccatagctcaacttattttccactcttgtcggctggccttttatgttgtttttatttactattgcaaacaatatttacaaaatatttaatgttcaagaattcctttaggatatataactagaaataattattattatgggatattctcatcttcatatttactttttattccaaattattttccaaaatagctccaagaatcagggtataggtgttcatatcctcaagaactctggatacagccacatttttaagtatttgccaacctgacaaacataaaataaaacctcattgtagttcttctttgtatttccctggttactgtgaagatgtgcatctccctgagttgattaaccatgtggtttacccatttgtaaattactggtctatgtttcttgcctatttttcttttgcgttatttccgtttctgttaactacttgtagaagttctttatgtagctggatactaatatttgttagacatatatcttacaattatctcttctactcagtggcctaaaatttcacattctttatggcatgtcgatgaagaagagagctgaattttaacaaaaccatatgtacccatttctcccattagagtgcttttcttacactttctttaagaaataatagaaaaagccggatgcagtggctcatgtctataatcccagcactttgggaggccgaggtgggcactttgggaatctgaggtcaggagttcgagaccagcctggccaacatgatgaaaccccgtctctactaaaaatacaaaaaattagccaggcatggtggtgggcacccataatcccagctacttgggaggcagagacaggagaatcgcttgaacccaggaggcagaggttgcaatgagccaaaatctcgctactacactccagcctgggcaacagagtgagactccgtttccaataaaaaaagaaataatagaaatgttattttgtgctttcctctatggattttgaaggtctgtgtttcattaggccttgaatccatctggaacaatttttatgtagggttaaagacagggatctaattttattttttcaatatgaataaacaattttaaatttctcataaatatctgacaacaggttgcatttatgtcaagtttacatatatacacagactttgctttaagtttttaaaaatttgttgcattattttaattggctgtgcctgtaccaaacctgctttaatcatgattcttgataggccaattgtctctgcattgttcttcaacaatgtcttggctattcttagaccttggctcttaaatacaaattttttccaccagttgctcaattacatttatatacacacacaaattattgggattatgattgaaaatggaattaatttatatactaagttattgattcttccagtctttgaatatggaatattcctttatgtgattcttctttaatattattcattaaagttttaaatttctcccaataagttcttgcatatattttgtgagattttgttttattacatcataaattctatttttaaaatattgtattttctcattagttattattggaaatataattgatttttgtatattgttcttatattgaataatcttttttaagctgtagacttttctaacaggtttgaaaatttatcagctccccatcttctctacaattcttaggataatgataatgattattattattatgttttactttctttttctaatgactaagaccccaacataatgttgactagaaacagtgattataagcatttctctttctgatgaaaaaaaaagattctaatattttgtgactaattctttgaaccttctattataatgaagttcttttactcttttacacatatataggggaattacaatttattcctatatagctcattttattgaaattattctttattatttctggtgccttttcttaatgtactatgttgcattaatttttaacattaaactatcttagtctaaacactccaagtataaaccaaacttgaataactcaagtttctaaaattaagaattcaagccacatgtgatggcttataactgtagtctcagtaacttgggaggccaaggtataaggattgcttgaacctaggaattcaagagcagcctaggcaacatagggagacacccatctttatcaaaaaaaaaaaaaagaaaagaaaaaagcctgatttagtagtgcacacctgcagtcttagctacttgggaggctgaagtggaaggatcacttgagcctgggaggttgatgctgcagtgagctataatcatgccactgcactccagccactccagcttgggtgacggagaggagcgagaccctgtctcaaaaaaaaaaaaaaaaaaaaaaaaaaaaaaaaagactacatctccaccaaaaaattggccaggcattgtggttcatgcctgtaatcccagcacgttgggtggctgaggcaggaggagttcaaaaccagcctaggcaacatagtgagaacctgtctcaaaaaaaactgttaaaaaaaaagaatgcaagaagatataatttgtatattacgataatcagaatatataatataactgaggcagtacaatgtaaattcaacaaaccataggcacagttctcttgtgaagccataattgacaaatattattggcaaatccatctttattggatcattcttatcagcatacaaatacattgtaatgattgcccttttaaaaatagaaaacgccatcacttttgatgaaagaaaatggcttgaaagaaaaatcgtttttttttcttcctactctcccttcgagactgatataatcagtctttctttcacatcagaccatggaaaccctcttggaaagatcatattacccatactttcgataaattcaataattaatttagtcctcattttacttaacattgaaataccacttaagtccgttgatgactctctttctgttgaaactgatcatgtggctttctctgattttcctcccgcctcctggtctacctagtcttggtctctttattggctcttctatttcccacaatttctcccacctcagtaaatggtaccatcatttgcctggataaatattcagtccaaaattctcacaataatccttgtttcatttttttttccccctgataggtctcatccaaaacatgaccagatctttctggctgtatctttacatgatagatttaaagtctattttaaaatatttaaaacaaattatattttttaatgtatttccacttctctgtcacctccactgccaccatccaaagtctaagtgaccatctcccattagctaaagtagtagtttacaagtcatctctgtgcttccactcttgccctgctactaattattgaccacacatgagccacaattacaactaaaagcataaatcattcaagtcacactactgcttaaatctctgctgtggctttccataacatgtaagataaaatctgaagactttaatatgccttacaagaaactacaatatctgttccctgcctttttgtcttatatcatttcctactcttttctctctttattgtattctggcaaaataatctgccagattattcctgcttcatggcctttccatttgccattagttcatcttagattactcttcccattgatcttcatatcattccgaaatttgctcaaatattaggatctcccttaccaatctgcctgaaatggtctctctcactcctcaatcattctccttccacttaccaagctttttttcacagaagatataagtaagtaaaataaacgtgttagatatttgtttgttttctgcttcccatgtttgaaactagactgtaagttgcctgagatgatggattttatatcgtgctcattgccgtacctctagaactcagataaatggtaagcatattatgagcaactagatatatcttttcaataaatgcatattgaagatgttcttgagtttgaagaaatgatttttaaaatatgaagtaatcttttatctccacaagttttctacacccacgcctacgatcgtgtgctagacctttcaacctatgctgcaatcttatagcccactattccagacctttccatttctgactcatccagatcctttatttccatttacagaatccctcttgtctccagggtgtgtgttctgagcaataagaaggataaaattgctcttatcaccttctccttcttcatgcgacacatccccattcatctgtcatggttcacgacaaatgctctgtcaccagcttgctccacagctttctcaagctgggttatatggaccttttatttggatacacaatatatctctgttttagcacttgtttctattttgtagtcttaagcttaatgtcctctaactgccactggaccataagctcatagaaaacaggaaagcaagtctttttcatctttgtgtccccagagcctggcactactggaccagatcaggaacttaataaatggcttgtggatgcatgaatgattaaattatattaccaacttatgacattttttatgtaataggctatacattgttgccattttaaaataatattttaaaaagtctaaaatagtatctgcatattgcccctccccacccaaaatgagtgccgtgctgtgagaaagacaataaaaattttatgcttggtttgccaccaagcataaccccactgagtcaaagagatgcagggtagtaaggtaaaaacagcacgcaacccagaattaggaaaacacatttctattattttgccactatctcttagtattgtttggtgtaacccacttttttctcctaagacttgatttcttattctctaatagaagaaagtcaagatgggtgccctccaagatcacattattttgatattatttgatagtcaaaaattttcacataagaatatagcttcctttaagtggtagggttgcttcctctggatacatgcttgtataagactgcaaagctttgagttttgaaaaaacagttcttattaatgctatagcatttaattggaaatcctagctcacatctttcttatagttagtgttcaagtgctgattgattgaatcaggataataccattaagacttctatgcccaaagaaaacagacaaaattattaagatacagttgctaagatgcagaagaaatttaaagatatagaaaatggaatttattcgttttattaagcaagccaaggcttatacgcaatataaaagatcttaagaatatgtcataggttactacctactgtgttgctatgagacctgcactagaaagatctaatgccacctgtgaaaagtaactatagtagaccataaggcagctaaggaattcagactacacattgtatgttggccacacccagtctagcaagatttatatatacattttaatttagaaagttcataatattccttttgtaaaacaaggatcatttcagagaaaatatgaaaaaaggtggaaaaaatctctctgattaacaaattgcacattaactggtacgatgacatggtttgaaaaacaaaaataatacttagctgcaaatacaggtgtataggacacatataaaaatttttcattagactcagctcatatacttttattaaaatgtgcataatgtgaacttcagactgtatatgaataacatagaaaagaatcaggaaacagctataaaatgtatatatatataataacagctattatatatataataacagctattatatatatataataacagctattatacacacacacacacacacacacacttatacgattaagaaactggttacattctggaaggaattgttttttgcttttttttcactggtcattttccagctttatcagtccctggccagagctccagccatgcaaggaattgagttcttgagaagtgaattacttgaggattacagatatgttgagaatatggggtcagtagtggaggcagcagagggatttttctaatgtgctcatgtcaacatgactacactggttaatcttgagggcccgttattgccagagacaggaacaggtctccagagtatgttccatacatgcccagtgtttcaaatataccattaaatcagcagtatttacaacaaaataaattgtgacaatttaaaaataggtgattacatgatgagacagatactaaattctcagtagttccacaagacattttcataacatagtaatccaaagacagtatttaaaaagcattagttaatccgtggcttatttgtgaaatgaaacttagaaatttaaaatttgctatatgcagtagtttctgtttgcattatatgcataaatgataacacatataaacacactaaatatgggaataagattcttaatttttctacttatgatactagcaaaggaaaatctgtagagtgtaaatacatgttttgttctagatggtggacacatgaaaaattgttcatatccatttgtcacttaagatttaatggctcttccactgccctgaagggtgagtcccggaccaggcagtattcatcacaaactgacttgagagccgtgggccttaagggaatattggagataggctagcaatattccctgtggcccgttgtggtgatgaccacagggtgacactccttttcctttggaaggagagagaagagtgggaagtgctgcatcttgtggcttgagtgacagctcagccacagtacaacagaacaggtggagttctgaggtttttgactctggtccctgattgctggaggatggcaactctggacctacctgggacctcgggtgactcgccaccctgaagggaaggacataggcctggctggctgtgctacctgatgattgtagaaccccagagccttgagcgaacataggcagcagccagggagtggttacagcaggtcttggggcaacacccagtcctgtgctggctttagatctgacccagcacaatcctagtggtggtggccaaggagtagttgtgtcactccacccctagctttcagtggctcagaacagagagagacactctatttgtgtgggaggaagaagaaagagaacaagagttttcgtccagtaatccataggattctttcagatcttgtccaaggccatcaaggtagtatgtctatgagtctgcaagaaacacagcattactgggcttggggtgccccctaaagctgttacagcttagatcacaatacccaagtccttctgaatatctggaaagctttgccaagaaggatggggacaaagaaggtgagaaggtgaagactacaataaatatctagctttttaatgcccagacatccaagaacatctactagtatcaacaccatccaggaaaacatgacttcaccaaatgagctaaataaggtaccaggaaccaatcctagtgaaacagagatatgtgacttttcagacagagaattcaaaatagctgttttaaggaaactcaaatttaagataaagcggagaaggtattcagaattctatcagataaatttaacaaagagattaaaataattatatattaattaaaaataactaatatatcatataattatatattttttaaattaattgaattaaaaagaatcaagcagaaattctggatttgaaaaaggtaattggcatactgaagaatgcatcagagtcttttaatagcataagagatcaaacagaagaattagtaagcttgaagacaggttatttgaaaatgcacagtcagtgaaaacaagaggaaataataatttttaaaaatgaagcacatctacaggatctagaaaatagcccccaaagggaaatctaagagttattggccataaagaggaggtagaaaaagagatggggtagacagttaattcaaaggtataataacaaaaccctagggaaagatatcaatatccaagtacaagaaggttataaaacactaagcagatttgacccaaagaagactagctcaaggcatttaataactccaaaaggtcaaggataaagaaaggattctaaaagcaacaagagaaaagaagcatatagcaggcaatggagcttcaatatgtctggtagcagacttttcagttgaaaccttacagaccaggagagaggggcatgacatatttacggtgctgaaagaaaaaaacttttaccctaaaatagtatatctggtgatgatatccttcaaatataaaggagaaataaagacttttctagacaaacagaagctgagggattttatcaacaccagacctgtcctatgagaaatgctaaagggagtacttcagtccacaagataaaggatgttaatgagcaataagaaatcacctgaaagtacaaactcactggtaatattaagtacacagaaaaacatggaatattataacacagtaactgaggtgtaaactacttcatcctaagtaaaaagactaaatgatgaaccaataaaaaataaaaagtacaacaatttttgaagacatagacagtacaataagatataaatagaaacaacaaaaagttaaaaagcagaaggatagaggtaaggcatagagtttttattattacttgtgcttatttgtttgtttatacaaacagtgttagttgttatcagcttaaaaaaatgtgttataagatagtatttggaagccccatggtaaccacaaaccaaaatcaaacaatggatacacacaaaataaaaagcaagaaactaaattataccaccagagaagatcaccttcactaaaggaggacaggaagaaagagaagacaaaaaaacaaccagaaaacaaataacaacatggcaagagtaacttcttacttatcaataataacattgaatgtaaatgaactaaactctgcaaacagaagacatacagtagctgaatagatgaaaaagaaaaaccatttgatctgttgcctacaaggaacacacttcacctataaagagacacatagactgaaaaataaagggatggaaaaagatatattccatgcaaatagaaaccaaaaaaagaaaaagagtagctacacttataacagacaaattagatttcatgacaaaaactataataagacacaaagaaggtcactatataatgataaaggtgtcatttcagcaagaggatataacagttttaaatacatatgcatttaacagtggagtaccgcgatatataaagcaaatattattagagctaaagagagagatgggccccaatacaataataactagagaattcaacacctcaccttcagcactggacagatcttctggacaggtaataaacaaaaaaacatcagacttaatcttctctttagactgaatgaatttaacgcatatttatagaacatttcatccaatggctacagatcacacattctttccctcagtatatggatgattctcaaggatagaccatatgttaggtcacaaaacaagacttaaaacattcaaaaaatgaaaataatattaagcatattctttgaccacaatggaataaaactagaaattgataacaagatgaatttttgaaactctacaaatactggaaaattaatatgctcctgaatgaccagtgggccaatgaataaattaagaaggaaattgaaaaatggcttgaaacaaatgatgatggaaacacaacataccaaaaaatctatgggatacgataaaagcagtactaagaggaaagtttatagctataactgtctacatcaaaaaagaagaaaaacttcaaataacctaatgatgcagcttaaagaactagaaaagcaagagcaaaccaaacttaaaattagtggaagaaagaaataataaagatcagagcataaataaataaaattgaagaaaacaatacaaaagaccaatgaaacaaaaatttggtttattgaaaagttaaacacagttgacaagcctttagccagactaggaaaaaaagatccaaataaataaaattggagatgaaaaaggagacattacaactgataccacagaaattaaaaggattattggtggctacaatgagcaactatatgccaataaattggtaaatctaggaaaaatagacaaattcttagacacatacaacctagcaagatttaaccaggaagaaatccaaaacctgaagatatgaatatccagtaacaagatcgaagctataataagaactctgtcaataagaaaagcacaggaactgaaggcggaaatctgaaagcctttcctcgaagatctggaacatgacaaggatgcctactttcaccactgttattcaacgtaatactgaaagtcctaagctagagcattcagacaaaagaacaaaataaagggcatccaaattggagtggaagaagtcatattatccttgtttgcagatgatatgatcttatatttggaaaaacctaaagactccacaaaaaaactattagaactgataaacaaattctgcaaagttgtagtatacaaaatcaacatacaaaaaccagtagcatttctatatgctaacaatgagcaatctgaaacaaaaaaatcaaaatgtaatcccatttacaatagccacagataaaattaaatacctgggaattaaccataaagtgaaagatctctataatgaaaaatataaaacactcatgaaagaaattgaggagaacaccaataagatgaaaaggtatttcatattcatgaattgaaataatcaatattgttaaaatgtccgtccttcccaaagtgatctatagattcagtgtaattcctatgaaaataccaatgacattcttcacagaaataaaaaaaaaaattttaaatttaaaattaaaatttatttggaaccacaaaagacccagaataaccagatctatcctgaacaaaaagaacaaaactggaggaatcacattacctaacttcaaattatgctacagagctagagtaaccaaaacagcatggtacagcataaaaacagacatgtagatcaatggaacagaatgtataacccagaaacaaatccacacagctacagcgaattcattttgacaaaggtgccaagaacatactcttaggaaaacagtctcttcaataaatggttctgggaaaactgaatgttcatatgcggaagaatgaaactagacttctgtctctcaacatatacaaaaagcaaatcaaaataaagacttaaagcaaagacctcaaaatatgaatctactacaagaaaacactggggaaactctccaggacattggtctgggcaaaaatttcttgagtaataccacacaagcataggcaaccaaagcaaaaatggataaatgtgatcagctcaagttaaaaaaaaaacttctgcacagcaaacaatcaacaaagtgaagagacaccccacataatgggagaaaatatttgcaaactacccatctgagatggtgttaataaccagaatattatataaggagctcaaaataactctataggaaaattttaataatatgtttcaataattggccaaagacttaaatagacatttctcaaaagaagacatacaaatggcaaacagacatgtgaaaaagtgctagacatcattgatcatcagaaaatgcaaatcaaaacaacaatgaaatatcatctcaccacagttaaaatggcttatatccaaaagacaggcagtaacaaatgctggtgaggatatggggaacaggaaatcctcatacactgttggtagaaatgtaaattagtacaaccactaagaagcattcagaacttccttgagaagctgaaaatagaactatcatatgatccagcaatcctactgatgggtatatacacaaaagaatggaaatcagtatacggaagaaatatctttactctcatgtttattgcagtactgttcacaatagccaagatttggaagcaaccaaagcatccatcaacagatgagtggataaagaaaatgtggtacatatacacaatggagtactattcagccataaaaagaatgagatacagtcatttgcaacaacatggatggaactagagatcattatgttaagtgaaataagccaggcacagaaagacaaacatcacatgttctcacttatttgggggatccaaaaatcaaaacaattgaactcatggacatagggtggaaggatggtttccagaggctgggaagggtagtgaggggttgcagggggaagtggggatggttaataagtacaaaaaatagaatagtaagacctactattaggtagcacatcagggttaccatagtcaataataacttaattgtacattttaaaataactaaaaagagtctaattggattgtttgtaacacaaagcataaatgcttgagtggatggatacctccttctctgtgatgtgatcattacacattgcatgcctgtatcaaagtatctcatgtaccccataaatatatatacctatgatgtacccacaaaaatttaaaatttaaaaatattgtatggttccaaaggagttattgcaatgtgtaatatacaagtgttacaaaataatttgtaaaatgcatcaacagtaactgttctatttcatcaaaatagagtttatatattattgtttgcatgtgctcacaattaccaaaaaattattttaaaatgtcaattaccaaagaaattgttttaaaatgtcatggcactggacttggtgggcaagatggcagataggagatagggctaatgtgcagttctcacctggatgaactgaactgtgtgtggagactcacactgtgatctgttgctccaagaaccaacaaaggaacataccaggaaaacctgaaggattcccagatcctttgaaagaagcagcacactactacaaatttcatgaaacaggtgaaaaactgagcattcccaaagtgtgagagaaggaaaacctgcctccaaacatacatttctactgggggacctgaaaatccagatcatgagattatggaagaaggatttaacctctcctggagttgaaatggatttagggagtcacatgaaatataaaagtagaagtagcagcagaaaatgccttgcaggcagtcccagtctccagctgaagcccagggaagccatctctgatgatatcttataggggcccttggggaaggcagccagaggaattgggaagtagtcacagtgcaaaggaaactctgaactgaaatttgtagttgtttcaactgggcacaaatcttctcaggtgaagtccaggagacaagcaggagtggctgcagattcgagcacaggagccgcagccaatggagtgggcagatgcaaaggagcaagggccatgcttgcttttttagtggggaagtctatgtcctcaggcaaggtcttattggggcactgtgggagtgagactggccttgccaattgcatgggggggtgggttaggcctctcactaatggctattccccacttctctggtgaactatatgacacagcagaggcagccaagatgtcttttggcctgagaaccaccctgcatccccacagtggctatagcaagccccagccaaggagaggctgagctcagacctgcataaccctgccctgacctgataggatttctttacccaccctagtagctgattacaaaagataaactcttgggagctttatggccctgcccatcacctgagaaactgaaatacttaccctggccaagttagggcaagcttagatccctccactaatactgcagctgttgctgtcttggaaacaccaccttctggttggaggccaaccaactcaggccattacagcaactcatggtagaataaccctgatcccaggaaggagaagacaacacctaattccactgcctacaagatactggctaaccagagttcctgagcgtgtccctgtgaaaacatcactgctagcataaccatcattcaagaaagccagcacactaaacatatctacaaccatggactctcacagagtctacctcacttcgctgccacctctaccagagcaggtgctggtatccatgattgagagacctgaagatggatcacatcataggactctgtagacattccccagcaccagtctagagcctggtagcccagcttggtaaccagacccaaaagagcaataacaatctctgcgttccagctctcaggaagccccatccctagggtaaggggggaagcaccacatcaagggatcaccctgtgggacaagaaaatctgaacagcagatgttgagtttcagacctctccactgaaataatctacgcaaacgagaaggaaccagaaaagtaattctggtaatgtaacaaaacaaggttctatagtatccccaaaagatcataccagctccccagcaatggatccaaaccaaaaagaaatctctgaatagccagataaaaaattcagaaggttgattattaaggtactcagataccagagaaaggtgaaaacaaacttaaagatattaaaacaaggtggggcatggtggctcacgcctgaaatcccagcactttgggaggctgaggcaggtggatcatgaggtcaggagttcaagaccagcctggccaacatagtgaaaccctgtctctactaaaaatacaaaaagtttggtgtgtggtgggcacctgtaatcccaggtacttgggaggctgaggcaggagaatggcttgaacctgggaggcggaggttgcagtgagccgagattgtgccattgcactccagcctgggggacagagcgagactctgtctcaaaaaaaaaaaaaaaaaaaaaaagatattaaaacaaaatacaggatatggatgaaaaattctccacataaatagatgtcataaagaaaaaacaatcacaacttttggaaatgaaagacacacttacggaaatacaaaaagtgtagtgtgggaagtttcaacaatagactagaacaagtaaaagaaagaattttggagctcaaagacaaggctttcaaattaagccaatcagacaaagacaagaaaaaaaaaagaataaaaaagtgaacacagcctccaagaaatttgggattatgttaaatggcaaacctaagtatagttggttttctggaggaagaagagaaatttaaaagtttggaaagcatatttgagggaatacttgaggaaaacttccctggccttgctagagatcaagatacccaaatacaagaagctcaaagaacacctgggaaattcattccaaaaagatcatcacctagcacatagtcattaggttatctaaagttaagacaaaggaaagaatcttaagagctgtgggacaaaagtatcagataacctataaaggaaaacctatcagattaatagcagaattatccatagaaaccttacaagacagaaagaattggggtgtcatctttagccttctgaaacaaaataattgtcagcccaggattttgtatccagtaaaatggagcttcataaatgaaggagagataaagtctttttcagacaaacaaatgctgagaaaatttgccacaactaagccagcgctataagaaatgctaaaaggggttctaaatcttgaaacacaccaaaatagaacctccttaaagcataaatgtcaccaggcctataaaacaataacacaattaaaacaaaacataaggtattaaggcaacaactagcatgatgaagaaaacagtacctcacatctcactgctaatgttgaacgtaaatggcctaaattctccaattaaaagatatagaatggcagaatggataaaaatccaccaacaaaatatctgctgtcttcaaaagactcacctaacacataaggactcacataaacttaaggtaaaggggtggaaaaagatattccatgcaaatggaaaccaaaagcaagcagcagtagctattcttctaccaggaaaaaacagactttaaagccaacagcagttaaaaaaaaaaaaaaaaaaagacaaagaggaacgttataaaatgataaaagaattactccaacagaaaaatatcacaattctaaatatatatgcacctaacactggagctcccaaatttataagggaattattaccagacctaagatgtgagatagatggcaacacaataatagtgggggggcttcaatactcctctgacagcactagatagttcatcaagacgagaagtcaacaaagaaataacggacataggccgaccgctgtggttcatggctgtaatcccagcactttgggaggctgaggtgggtggatcacctgaggttaggagttcaagaacagcctggccaatatggtaaaaccctgtctttactaaaaatgcaaaaaattagccaagcaacgtgatgggtgcctgtaatcccagctacctgggaggctgaggcaggagaatcacttaaaccccagaggcagaggttgcagtgagttgagattgcaccactgcactccagcctgggcaacaagagcaaaactctgtctcaaaaataataataataataataataataataataataataataatagacataaactatactctagaacaaatggatttaacagatagttacagaacgttctactcaacaactgcaggatatacattactttcttcaacacacagaacattctccaagatagaccatatgatagcttacaaaacaagtcttgataaacttaagaaaataaaaagtatatcaggtattctctcagaccacagtggaaaaaaagtggaaattaactccaaaaggaaccctcaaaactatacaaatacttggaaattaaatcacctgttccttaatgatcattgagtcaacaatgaaataaagataaaatttaaaaattgagctgattgatgatagtgacacaacttatcaaaacctctggcatacagcaaaagtggtgctgagaggaaaattcatagcattaaatgccctcatcaaaaagtctgaaagagcacaaataaaaaaatctaagattatacctcaagcaaatagaaaaacaagtacaaacaatatgcaaacccagcagaaaaaaagaaataacaaagatcagaacagaactaaatgaaatacaaacaaaaaaatacaaaagataaatgaaaaaaagtgggttctttgaaaagataaacataattgatagaccattagcaagaataaccaagaaaaaaagagagaagatccaaatgtcaattagaaacaaaacaggaaatattacaaccaataccacagaaatacaaaagatcattcaaggctactatgaacacatttacaaactagaaatctaatgtagatggataaattcctggaaatatacaaccttcctagattaaatcaggaagaaatagagattctaaactgaccaatgacaaatagcaaaattgaaacagtagtaaaaaaaaaaaaaaaaaaaaaaagccaacaaaaaagtccagaaccagacggattcgcagctgaattctaacggacattcaaagaagaatcgacaccaatcttactgaaactattccaaaagacagagaaggagggaattctccctaaatcattctgtgaagtcaatatcaccctaataccaaagccaggaaaggacataacagaaaaggaaaactacagaccaatactgctgatgaacatatatgcaaaaatcctcaacaaaatactagctaaccaaattcaacagcatatcaaaaagataatacaccattatcaagtgggtttcgtaccagggatgcagggatgatttaacatacacaaccaaataaatatgatgcatcacataaaataattaacaacagaagtcatatgagcatcccaatagatgcagaaaaagcatttgacaaagtccagcatccctttacgaataaaaccttctgcaaaattggcatagaagggatgtacctcaatgtaataaaaaccatctatgacaaacccacagccaacattatactgaatgggaaaaagttgaaagcattcatcctgagaactggaacaagagaaggatgcccacccccaccacctctatttaacatagtactggaactcctagctgtagcaatcagacaagagaaagaaataaagggcatcagaatctgtaaagaggaaattaaagttgtgctgttcacagatgatatgatcatatacctagaaaaccctaaagattcatccaaaaagctcctagatatgataaattaatttagtaaagtttcaggatataaaatcaatgtacacaattcagtagcactgctatacaccaacaacaaccaagctgagaaacaaatcaataactcaatcccttttacaacagcttcacaaagtaataataataataaaatacttaggactatacctaaccaaggaggtgaaagatctctacaaagttaactacaaaacactggtgaaagaaatcattaatgacacaaacaaatggaaacacaacccaatgctcatggatgggtagaatcaatactgtgaaaatgaccatactgccaaaatcaatctacagattgcaatttccatcaaagtaccatcaatattcttcacagaactataaaaaacaatcctaaagttcatatgaaaccaaaaacaagcctgcatagccaaagcaagacaaagctaaaagaacaaatctggaggcatcacgttaccctaattaaaactattctacaaggctatagagaccaaaacaggatggtactggtgtaaaaataggcaagtagaccaatggaacaaaatagagaatccagaaatatagccaaatatttaaagccaactgatcttcaacaaagcaaacaaaaacattaagtggggaaaggataccctattcaacaaatggtgctgggataattggcaagtcacatgtagaagtatgaagctgcatcctcatcgcttaacttatgtaaaaaatcaactcaagattgatcaaagacttaaatgtaagtcctgaaaccgtaaacattctagaaaataacatcaggaaagttcttctagacattgacataggcaaaaatttcatgacaaagcatccgaaagcaaatgcaccaaaaacaaagataaataaatgggacctaattaaactaaaagcttctgcacagcaaaagaaatagtcagcagagtaaacagacaacccacagtgggagaaaatctttgcacactatgtaggtgacaaagcactaatatccggaatccacaagaaactcaaacaaatcagcaacaaaaaaccaatcccatcaaaaagtgggaaaagagcatgagtagagaattctcaaaagaagatgtacaaatggacaacaaacatatgaaaacatgcccaatgtcactaattatcagggaaaggcaaatcaaaaccacaatgagataccacctgatatggtggttcggttgtgtccccacccaaatctcatcttgaattgtagttcccatgatccccaacccagtgttgcgggagggaccaggtagagataattggataatgggggtggtttccctaatcctgttgtgatagtaagttagttctcacgagatctgatggttttataaggggcttttctgcctttgcgttgctctcattctctcttgctgccctgtaaagaggtgccttccaccatggctgttaagtttcctgatgcctcctcagccatgtgaaactaagagtcaattaaaactctttcctttataaattacccagtctcaggtatttcttcatagcaatgtgagaacagactaatacagtaaattggtactgggtagtggggtgctgctgtaaagatatccaaaaatatggaagcaactttggaactgggtaacaggaagagactggaacagtttggagggctcagaataagacaagaaaatgtgggaaagtttggagacttgttgaatggttttgaccaaaatgctgatagtgatatggacaatgaagtctagtctgaggtggtctcatatgaagatgaggaacttattgggaactggagtaaaagtgactcttgctatgcaaagagactggtggcattttgtccctgcctcattcaagaggaagcagagcataaaagtttggaaaatttgcagcctgacaatgaggtagaaaagaaaactccgttttctggtgagaaattcaaacaggctgcagaaatttgcacaagcagcccatcccatcacaggcccagaggcctaggagggaaaaatcttttgtgtgttaggcccttgggacatggtgcccagcatcccaactgcttcagcgccagccttggctaaaaggggtcaaggaacagctcaagccattgcttcagaggatgcaagccccaatccatggtgactttcacatgatgttgggcctgtgggtacacagaagtcaaaaaccaaggttggagaacctccacctagatttcagaggatgtatggaaatgcctggatgtctaaacagaagtttgctttgctacaggggtcaagctctcatagagatcctctgctagggcagtgcagacgagatatgtggggttggagcccccacacaagactttggacttgagcctttgggttaatgctggaataagctaagactttgaagaccattggaaaggcatgattgtgttttgaattgtgaggtcatgagatttgggaggggccaggagaagaatggtatgccttggctatgtccccacccaaatctcatcctgaattataggtcccataatcctatgcgaggaccagatggagttaattgaatcatggaggcagtttccccacatcttgttgttgtgataataagttagttctcataaggtctgatggttttatagggagcttttcctcctttgctcaactctcattctctctcccgccaccctgtgaagaggtgccttctgccatgattgtaagtttcctgaggcctccccagcaatgtggaaatgtgagtcaattaaacttctttccttcataaattacccagtcttaggtatttattcatagcaacatgagcatggactaatacattaccttattcctgcaagaatggccataattaaaaaatcaaaaaataacaggtggcatggatgtggtgaaaagggaacacttctacactgctggtgggaatataagctagtacaagcactatggaaaacagtatggagattccctaaagaactaaaggtagagctaccatttgatccagcaatcccactactgggtatctacccagaggaaaagaagtcattatatgaaaaagatacttgcacacacatttttacagcaacagtatttgcaattgcaacaatatggaaccagcctaaaagtccatcaaccaatgagtggataaagagaatgtggtatatatacaccatggaatactactcgtcataaaaagaatgaaataatggcattggcagcaacctggatggagttggagactattattctaagtaaaataactcagcaatggaaaaccaaatattgtatgttctcacttgtaagtgggagctaatctatgaagacataaaagcataacaatgatataatggactttggggacttggcggggaagggatggggtgagggataaaagactacgtattgggtacagtgtacactgctcaggtgatgggtgcaccaaaatctcagaaatcaccactaaagaactttatgtaaccaaaaaccacctgtaccccccaaaatactgaaatgaaataaaaatttaaacattgtgctttctcagaaaaaaaatgacaagacgctgtaaaaatttttaattattttataaaatagatacatacgtgcatgtgtatttcttttcaaatctttccaaaatataattttattgaagaatagtatatcaataaataagttacagcatgctacttttctgctcaaaatcctccaatgccaacagttgcttgttttcctttgactacaagccagatctcttactatgacacagcagactgctggtcatgctcgtcccatgcccaaccatttctaactcccgcttcttcctattcttccttctgtcactcagtggactctttgtatacctgaatgatgccgggaaaattccagaattagaacatttgcatttgtatttcttctgtctggaatattttccccaggcattcacatggcttgctggataactaccttacacattcaaatgttattttctcagtgaagccttttgcagcttttgctgtatttgaaaaggcaatccccattcacagggtctatacttcccttccttgatgtagcttttctcccagccattatcactggcaaactatatatatatatatatgtttaattttaattattttgcttacgatctgtttttccgccactagaatggaagaatataagctccaaaactttttttttttaatcgaatttttaaaactaactttgagacagggtcttgctgtgttgcccaggctgatcttgaattcgtgggttcaagtgatcctcctatctcggcttcccaaagtgctgggattacaggcatgagccaccacaccctgcccaagctccaaaaatgtataaatgcttattgcactgtggtttccttagatacattccctagatctgtatctgtcatatcgtaagcactcaataatatttgttgaatgcatgggtgtgttacaaaacaaacatataacagataatgcataggggtttgatagagaaatgtttgtggtgagaggggcagaagtagagtttagggctgagaagtcactaggaacaaatcagtagagactcttcaatctcagcaaataggtaatatttttaaagttaatgaagttgtgtaagatagagactgtaaatgggtgaccatttggttttatttgcttaaattaatgcttgcctttatgaccattatattgaaaagacgtttatgaccctttaaagaagacatcaggtttgaaggctattccatcatgagtcaaagaaagatttggagtactactgcaggacaaggctcttgatagagatttgtgagaaaaaaaataaaaaatggaagcagtgtcagacactagaaagttttatgccagaggctgactgtaacagaaaagatcaaaaccaatctaatttaattaatgtatctttaattaggtgaaggtaaatctgcaggtctggacacaaatgacaaacagtttatcatcagaatcatgtcagaaagtgacagaattactaaaatatgatgtggcttctttgcttatcagaagaactaaaggaaggcagttacaaagaggctaaaggtaaaactggaatatatttattctacagaaaatatattaccatgggggacactgtaactgaacttttctgattgattcaagaagagcaaactggaaagtgctctagcagagagggatgttgttatagatgaaaggggtttagagcctagaagatgaagtcacttgtctagagtctcacaggatagtcctgaccaagccagaactgggaccaaaatgactttaaactgttcctagattgagtagcttggatctatttaacttttacttttttatttttttattttcctttaagttcttggatacatgtgcagaacgtgcaggtttgttacatagatatacatgtgccatggtggtttgccgcacctatcaacctgtcatctaggttctaagccctgcatgcatcaggtatttgtcctaatgctctccctcccatttaccctgcaccccccaacaagccctggtgtgtgatattctcctttctgtgtccatgtgttctcatttttcaactcccactcatgagtgagaacattaactttcgttaattcctctttctactcaactaatatttctgaagccctactatgtgccaattattgtgcaatctctgctttcttaacttttaatgtggggggacagactttaaaaaaataaaatgtgtgcaagtaaaggggagatgaatgctagggagaaaattaaagcaggaagaggaggcagagagcagctgtagaataggaaaggaaaggctggcactggaagagaagaaggagtgggtcctgagggtgccgaggaaagacaaaggaagcagcaggtgcagaggcactaaggagggaccctgctgatgtgtttgaggaatgaaaggtccatatggctggtgccaaaggagcaaggagggaggattgacatgtgagggcatagaggcggggaggagccaggtcacggagggacttcagctgttttaaggacttgacttctactggaacaagacccgctgccattgaaggctttgagcagagtatcagaatctcacttatatttgaaaaacctcaccctgactcccgtgttgagtgtagatgtgaggaggcaagggtggaaagcagcagactggttaggaatcaggatggctttaaccctagtagtggtggtgggttggcaggaggcgtgttcaaattttggaaatacactgaaggtagagcagagaggattcatgggcaggcttgatgatgaatgcagaagaaagagaggcattaatggtgactcctgggttttgtcttgagcacctgaaagaatggagttgccatgtaccaaaataagaccaaatgaggaggaagttcaataagtctcttttaatctacagcacgctctctcttgcgctctgtctctctctcaccacttctttcctctctacccacttcctttgcaatttatcagttgataaaactatattggtctatagagtttcccacgggcagggatttcatggagtatttccctgtgtgctatttaatatgttcctctctcccttataaattctggaaatccagaatttaggtctatagacttggtcaaattcatgcttgatttttatcaatagtacattacgtgtaacattgattgtgtattttcatccaaaggtgcatcatgtgtggtttcacttgtggttatattagcagccattgataatcattgcttagatcctactaaatttgtcagaagttaggaaatcatgatactctaatcccaccatttagtcttcttttatgagctgaaatatctccataaagacaatatttggtttcattaaggttcctataacaaagaaaggccaaaggcttgattcttctctttattcgccaatattcaaaataatgagttggttacctagcatcttccaaaattaaacatttttaacaattttaataaaattaaggatttaaatatatttgatatgcctcaatccattgcagaatattcttgttgatgttcagattggcccatctttggccctgggtgtttttgaactgccctcagtctctaattgcttctttttttctactgggatatgttcctggctcatctttcatcttgcacatttccagccgtagaagccatcatttctccagggatcctagttttatcttagaggaaatggtatttagtgatcacagtctggtgcacgaggtcagtccttgtgtaggagctttttcagtgcacagaggcaagacatatgccacatttaaaattagataacattatcttaggttcttagagatgcttctaactaaaatttaaaagtatatggagcttttatttaaccttatctattttatatctgcttcttttctcgcagtgaaattttcagggtcaaaatcaccaagataattagtcacttgctttattccacatgtacagaacatttcaatagcagagaatgcaatgtctaattttgcctaaaaggtcagtgtgaagagaacatttgttgacaagatgaggatacatattctgatgagagcaaacaccatgtaggaagactcagaggcttgaaagagagcatagttcatttaggaaagagaaaatcctgttccaccagaggaatgatggatgacaaagtcagcaagaagttgggacataatgagcctgatattcaatgctgcagatgttagagcaccaacaagatacaaaagctttttttttttttctttttttgccttgctttcaggaggtatcttgcatttgttttcaataaaaatattactttcctactttgtcctcataagcagaacttagggatgagcaaagagcagggggttttaaggattgctctccttaacactgttctacaccagctcagtaaaaagaccatttaagtgtggctcaattattttctgacatttggagaagcatttgcatactaatgatccagggtcctggttgtttttctccccacagaggacaaagtgtggaccatagtgtctcatgacttgcagatgcagacgcctgtggtcggctacaacccagaaaaatactcagtgacacagctcgtttacagcgcctccatggaccagataagtgccatcactgacagtgccgagtactgcgagcagtatgtctcctatttctgcaagatgtcaagattgttgaacaccccaggtaggctgagaatggaatgttacttttaatcactatctcagctggtgcttagaattgcctaaagaatccaacaggtgtggttcattatcttatagtctagtcttcagtaggaaggaagctgtaaataagtaaaataaaatcattgggcttgttttctggggaatgaagctaagaaagaatgattttgaggaaaaaatagtccattgttttaaacttacggatttttaaattgtatgtgcatatatgtttctagtgcttaactgtcagtagtggctgtgggacaaagtttatcagagctccttgtgaacattcaagcaattccctttgagagcttcaggtgtctttattgtaaagatgaaagcattctaaaaattgtctacagccaaataggatatagaatagcgatagaatttagagctctttcttcccagtagttgcttcacagtacctgtttgtctcaagaagtctagcctgattttttgttttcatgatggccaacttttagcatgtgctagtgtgtgtgtgagtgtgcacatgcaaacacacatacatgtgtgcaagactgtgtccgggtgtagagaacagagagattccaaaagatatactggaaataactttactgcaacaagttccatatgctctgggagtcttggcagtaaattcgagatgttgtcagaaaactgcatctctgtgtctgtagtaaaacacagtggaaataagtcaaagaaacatgagctcataatttccaaccttaccacttcccaagtatgtgactttggtggagtgagttgacctctttttaaaattttaccttaattgacaaaattgtatatgtctttcgtgtacaatatgatatgatatatatatatatatagtgcaatggctaaatcaaactaacatatgccttgcctcatacatttattattttttgtgaagcaaatacttaaaatccatgcttagcagttttcgagatataataaatacattgctattaaccgtagtcaccatgttatacaatagaccttttgatattaagcctcagtttccagcgactttttctgtcaaggagaaattataatgcctacttcagggtgattgggagaatttcataaggtaatatactaggtacttataagacttgatacacttaaggacatgataagtagcaagtagtatattgattttttaaaatcatgttaagcaactttgtgctatgtcagagaccaatgggctgttggatgccccaaaacagcaatgaattgaaagcaatgttgtagggagcagtttacagagaagagttataagcaaacagtgataaggctccgatgactgaaggaacaccaaggttcttaatctcacgcagaactggataaaacgacatggacatacgtggagtggttttaaggagaggagagtttaacaggcaagaaagaaggaaggaggaaaaaaacagctccctcatacagagacagagagaggaagggattccaatgagagaaaaccctgtgtgtggtggtaaagtggctgcttatatgaggaggctggaggaggtggtacctgacttgcatagggctcagggaattggtttgaccgggcacgttattcacgtagcccagggggaaaactggccctcccaccctagccttttaatatgcaaaggcagggcgccatgatgctctacccacatggagatatgtgggggcggccatgttgccaggcacatgtgagggcaaggaagaacagggcaggaatcgccatgtttgggtggacccagtttctaatggccggtatttgcacatcaaagcttgccggcctggctctaagagcgggggctttcctgctagacaagaaacattttggagctgctttaaaagaccccttttcccctctatgtgtctaaaataatttcttaataatttcttaataacttctataacgatagtacacaatattgtgaaaatgtgagtgctttctatgtgcaaagccttgtgctagaattatagacagagtaccctctaagaaataaggttggaaaggagggtgggagtaaactgggaaggaaagtaaatgctgtgctgtggagttgggacttcatccagagggccagtacttctcagactttagtgggcattacaatacctggtgagataataaaacctgctttgctgggctccatttcctgagtttctgattcagtaggtctcaggtggtgcttgagaatttgcatttataatgagtgctatggactgaattatgttcccccaaattcctgtgttaaacccctaacacccaatgtgactatatttggagatttggctttcagtaagtaattaagattaaatgaggtagatcataatggtggggtcctagtccaataggattggtggcctcaggagaagaaacagagctctgtcatgtgagggcatagcaaaaaggcagccacctgtaagccaggaagagagccctcaccagaaacagaatcagccaaaaccttgatctttcacttcccagcctccagaactgtgagaaaataaatttctgtcattgaagccactcaatctatggtattttgttatggaagcctgagcagatgaatacaatggggttccaagtgatgctgatattcctgctctagagaccatgctgagaaccagcacaactcttttttctgttcactttcacttatcataggtgtgtgtgtgtgcgtgtgtgtgtgtgtgtgtgttttaactggattctgtttccagtgccaggaaaagtcaaagactgtatgtagaagaccaagggcaataagagccactaatgaacctcatcagcttgtcttcactgtttcatgagcggctgctccttattgaagcccttttcacagattccagttaattagtcttcagtcctggggtaggggtggaggtggggacaaattcctgaccagcaaaagaaccttggtactctcagctttatgttctttattttctttctttcttgtattaaactccaaagtcagctttcagtttttgaattttgctctggtaattaaaaaacacagtatggcttccaaatatgttcaacttacggttgaggtaccaggagaattagactagaggtgggaaaatagttcacctttagtgctcctggtcttgcagttcagcatctttctttccccctcattgacattccttgtctcttcccctcggccaccgtgaagcctcacacacataaccactctcctttacaaaacataaaatgtacaaaacatcaggaaaaatgggataaacttgttattaagcactctgttagttgcatttcctaataatgagatgaagacatttttctttaacctctagatacccctttcacgagaaaaactgctaaattgaaatcaagagtaaacttttaatctgaacagtaaatatatcactttctttgtatttctagacatctagacactgggtttcccatcatttgtagattattattgtacataataaataatacttcaaaaatcagtttctcataagcttcttgcctgtttggacattctatatatatatcaaatctttggttcacataggatttgtacttaacaaatgtttgctgattcaaatgaaatgaataatatatagctttaagtgttacctcacccaaccttggggcagtggtttaagcaggagtgtgcatcaaaatttttaggttgcttgtcaaaatgtggattgaatggccttactcccaggctttgatagagcttggttggggcctcagaatatttgcttttaacaaacacccatgggtaattctgtgaatcacacattgagaaacactgtctttaatttatggcatgaaggtttctcatgttggaatttaaggtgttagtccttcatgtgggagaagattaaagggaatattagggcttgtctgacccattgaaataaaatggcatacatagttacctccttcagctaaaataaattggcataataaaaattttaaatccttctgatataccagtctctaaatatcgtaaagtgaatttcagcttacccttctgagtcattttttacactcccaattttcattttccaggcctactaatctgcagaatagctgacgcaaggaaaaggagtggttgagacagcaagttccttgtattgttatattttgcatatgtcaaaacaagaaagaacacaatttaataaaaatctttaatttgtgttttaaagaagctaatgtttactgtaattgatttttttttcctccttcatggtaacattcaattttaaatatccatttacttattcttaactaagactgaaattatattagaacttctgtagtagtacttgtgacatctgttcaaatacaaagtatattcattatagtgattgcaattaaaatgaatatcaaatgagtttgtaatagctttgcgcttaaaatgttattttttattttaagagctttacgctcaagagttcatttggggctctatagtttctaatgatacttatgataaagagttgatattcatatggacctcatttttattttgataaatattcttttataccataccattagctagtaaatgtaaaattacccattattagtatcttccaatttttacaaggatagtaatacatgccttgtaatgtgctctcttttattactacaaaacttaaaaatggaaacaaattaaaaataatgattttgccagtatttatggtcatgtccattctcgcaatgtaactgttacttcagttgtcctcagctttacaaaatacacagaaatggaaaaataaaaagttattttattttacgtagaaaagcctgcttagaatgaggcataccaatttgggaatcaccaaattagttctacccaaacagagaaaaatcattaatggtcatccaaatggatgtctacatgatttatatttatatccccggatttgtaaatgtaatattaccttaacttatgaagggctaaattagtgaacagtgaaatctacttctcaaataagtaccataagaacttgaatttggccgggtggggtggttcaggcctgtaatcccagcactttgggaggccaaggcaggtggatcacttgaagtcaggagttcaagaccagcctggccaacatggtgaaaacccgtctctactaaaaatacagaaaattagctgggtgtggtggcatgcacctgtaatcccagctacttgagaggctgacacaggaaaatcacttgaactcgggaggcagaggttgcagtgagctggtatcatgccactgcactccaacctgggcgatagagcgagactctgtcgcaaaacaaacaaacaaaacaaaacaaatcttgaattagataaatcaagcactgagggagttcccttagagcctacttgagtagtcttagtcaacaatactaatacttttagataaccaaaatgtttctctgtatttggacaagaactattatgctgccattaaaatgtttatttgtgtatcttacatacattgtagtcatatatttattttacaaatcatattacactttctagttaagaatttttttgctgaagtattgattccttacatatatatttatttaattgtagagataaaaagttatcttccctatttttctggctatatttagccctgttttgttggtttccagtgtttttcctcttttaatttttcagtgttggctagttttcatgaatgatactttttactgcttcttttgttgaaagaagcaatataaattatatatatttttggatagtttactattagattttgtatctattgaaattgaattatgcttacaatttttgcctataaagtaagctgtgtaaaattcagcatactttatgatactaaactgtgatttagtggctttgaaaagacaagaaaacatgactctggcattgtaacatataatctatttttagcaagaaattctaaactttggtgcggctatcaagcaaatgaatttcaagttatgctgtgcattataagaagctgcagcatttaactcttaagacgacatggataaatcaattccaataaaagatttttcagtaaataaaatttattgtgactaatcagtgtattaatcagaagattatttacttaattattatacccactcattgtattaaaattgggtgatataattaaatgagacaagcaacgaggatagtaataactaaagggtaaaattagaaaattgtatcgagtaatgtttcatactcagacaactagcatctgcatgatgggcactgtaattgaaggggacagagggattgcagggagaagagtaagcaactatttcaacaatatggataggagttgatgagaacctcaactggaataatgagtaggagaataagtcaacaaatattttttagttttgcctgtgtatcaggaagtgtgacatataagctgatatgggaaagattcatatgagttaactaagaaaaaaatgagagaaggattctgggttagcgatgtcagcatattcaatgattcagagatggagatcaagagacactaatttgaaggaagtgagaggcgtcagaatggctggagtagtgaacttgaaggtgggagaggcagaaaaatggaaaccggaaattaattcagagtctctacctaatgttgaggattttatttgaatggcaaacagaatgatttcaagtagggaagttctggctgttccatggatactggagtggaggaagcagaggtggtgggaagagtctgtccgcaccagagtgcacatggactgcatgtctgggaggccagctgggacttgagagaaagtttgttgttgttgttgttgctgttattgtttttaagtttagatgctggaatcaacaggagttgtgattacttatatatacaggaggaagaaaattcaagggtgactcaagtttctgacttgaaaaactggccaacagttctaaggcttaccttgtttattaagaaaaaactggagaattggtggtcacttagctttaacatgcaaagtgatggcactaggaatacaggtttttatgtgatctgtgatggctgatggcatagtgtaaaatccttttaactgacatcaaaagattaatgaattaaattttttcttccttgaaattttcttaaacatactctacaactaaaataaaatggaagaactaagagtatcatcagaatcctaatgttttccattcttgtatttatattgaaagatcagaaaacatatagtcaagactgacctatctcaattatgtaccaattttttttttcctcatgcaaagcctcctgtattgcttcagcttcctgggctgccttggtttcatggcacctgcatgatgtctgaagcaagggaggagcaggctgcaaacctaagcgcagacaattaaatactcctgcaaggaagtaacacgttgtgtgtgtgtacattttatggaccaaagcaagtcacatgttttgctgggcctaactttagaagaggacaaagtacaatcttcccatgtactcaggagcaaagatcacgtggacttattgaatagttgtaatgccttcttaagatgactcagagaggtaatgggaggagaaagaaaagaacgcagaagaaaagaaaaatactaattttgtttatttgtttgtggatggaatgttattatgttcactttttttttttttttgagacggaatctcactctgtcaccaggctggagtgcagtggcatgatctaggctcactgcaacctcagcctcctgggttcaagtgattcgtgattctcctgcctcagcctcctgagtagctgggactacaggcgcatgctgccacgcccagctaattttttttcttttttttttgtattttagtagagacagggtttcaccatgttgcccagactggtctagaactcctgagctcaggcaatctgcccgccttggcctcccaaagtgttaggattacaggcgtgagccaccgcgcccggccagttcacttttttttttttaacgagggtcagagataaagagagactccactcaaaggccaatttcaatgtaagaggacacccttcttttacagattaactggtaagcaaaaaaataaaataaaaaataaaaatactggtactacaattatttgcttccttatgaaactttctacaattcttacccacggtgatcaccattttttctgaatttctgtttcacttagggcctaacctctatcacttagcagttgattatgggctattcatggcttttcttgctcttcattgttttctggtgttttaatgggctctttcttacaataacacaaggtctttgaggacaggggccatatcttagtatcttccatcatgcccagcttctagacatctacctagatagtgaataaattagaaaaacactaattttaaaaggggactaaagaagaggatgcagctagctaaaggaactgaaaagttattaaacagtaggaagaaagaatcagattaggaaagtcctataattgggaagctaagggagatgggtatttaacaataaacaggcaagcaagtaaaaaaataagcaaaagcaagaaaattgaggtatggtgaatggtgagacatcctagagaggaagccatcccctgtcattatctgttgggaggctgctggagtttcatgtcagtggagtttggtggattgagccactgaagactgcatggggaaaggaaagagcaggggtaagttttcaaaaggttgatggtacgaggatggctacatgtagaaaagctgcttaatcagatgacaaagcaagagtaggggtttaaaaatgtttgatatttttagggatgaggagttgtaagtaaatttataaactgagaaggagacattggagaggttcagattaaagatgtaagacagaaaaggaataataggtcccaggagagaaagaagagtgtagaatttgctttggtaaagaacaaggacacctgtttcaagaagggagctaaagacaagggcagaagttctcattaaatgtcttgaacaataccattctagacatttatctcatttaactctcaaagttacgcaaagtagattttattatctctgttttgcaaaataggactcagaggaataaacttactgaaggctaccatattagttcattttcacgctgctgataaagacatacctgagactgggcaatttacaaaagaaagagttttaatggactcacagttccacatggctgaggaggcctcacaatcatgatggaaagtgaaagacatgtctcacatggcggcagacaagagagcttgctcagagaaactcgcctttataaaaccatcagatcttgtgagacttattcactatcatgagagtagcacaggaaagacctgcccccgtgattcaattacctcccaccaggtccctcccacaacacgtgggaattgtgggagctacagttcaagatgagatttgggtgtggacacagccaaaccatatcagccatcattgctggaagtggaaaaactgagtttcaaatgtatatctatcctattaaaaacctttctgacacactgaagaaactgtgaacatggagaagtcaatgcttggccaccaaagtgagtatagaactaatcccggcaggaattgtacccaccctcatctcttcaaccactatgaaagaacgttttccctcttgtcattttcttttttgtgtgcatgattagaaatgctatttaccaagtgacctttggtcagttccagtatttctgattaataaattaatcttaaggtaaattttattaagggtagctcgagttgtactaaaagggtactgctagtgcctttcaagtggcagacttgagctttgaggtgagactttgattttgtatgtagcttagtctttaaaataacaaatataaggatgaaatggaaactctgtgaggttatccagtcactctgtagagcttgaaaatctgccttctcatgtctttctgtttaaggtagactctaaccttttgattctgaaaagccatgttcaaataaatacttattctagtatagaataatcataaagcaaagtgaaaatgcaaagactgcatgagaattatgggtttcatgtttatttctccttgtagttatctggctatatgttttcttaagttttcagacgggataccacactgctgttaatcttttttaaacaaagattatatattaaaatgagagcaacttagaaattacaccaaagctgaattttctttgaagatgatcacatcttaatgaacggatttgtcctaatttatgagaagtatgagtttatagagttgcatttaaactaaacttcaatatattaaaagaccataaagccaagtttttaaaatttgcattttagtttattatattataaaagattgtaaaaatgaagaaacggctattatccaattcaaaaaattaaaaaactacttttggactatttttcaaaattccatactacttactctgccattctgaataaaaaaagggataatcataaaaagtcttctaaaaagattggatagataaaaaaaaatgtactttaaactttgtgaaggataaaataatgtaacaaaatttaaggagaaaatttttaaaaagtactgacaattttattatttatctttatgaatattactctctagtttttgcttccatctgtacatactttcacagaaacaaaactggaatgaagttaatctgatagtcttttctactgacattaaatcgtaattttttccagttcatatattttccttaaaattatccactttaattacatcgtaaaatgaagataaacttaattcatcacctgataaacctaatcgtaaattatttttgaaaatacctcccctaaacaagatactgaaaaaaagcatcagagttttacaataaacttctcttggaaatacctaaagtattactaagatattgctcagttattcattctgcaaacatttattgagtataaaatatttagctgggtgctatgagaatacaatgagggtaaaaataatacagttgacccttcaacaacatgagtttaaactgtgagggtctgcttacatgtggatttcttctgtctctaccacctctgagacagcaagaccaacccctcctcttcctcctcctcctcagcctactcaacatgaagatatgaggatgaagacttttataatgacccacttatgcttcatgattagtaaacgtatgttctcttccttttaattttcttaataacattttcttttctctagcttactttattgtaaggatacagaatataatatatataacatataaaatgtgtgttaattggctgtttatgttatctgtaaggtttctagtcaacagtaggctattggtagttaagtttgtggggagtcaaagatgtaggtcaatttttactgcacagggggttggtgccccaacccctgagttgtttactggacttttaaatagcatttgccttaaaatatagagtgaaattttttttatgatgacaataaaatcattttgtataagacttataaatactgaaaaaatcttaactagtatgtccatcatggataaaagactgaataaatttagaattcataatgacttccaaacattttgatatgtgtattttgcattaggtaattctgcctcccctgtttgaagaggttatatttggaggaaagatgaggaaggcttaggaatgggagaaaatagggtctcagagtactattagctgggatatcagttcaggttcaaccggagaaacagaacaagtagaagatatatttagagatttattgcaaggaattggcttatgcaacagcggggcctggcaaggcaagtcggaagctggggcacactatcaggaaggaaaggctggaactgccagacacaaactgaagctgatgtccacaggaggtagttcttcttcaaggaagtctcagctctattcttaaggcctttcaactgattgaatcaggcccatccagattatctagaatatgctcttttacttaaactgtaattacatttacaaaatgcctatgcagcaacacctggaagagtgtttttttgaataactggaccccgtagctaagttgacagataaaaccgaccatcacagtcaacaaagatgacttttaatatgaactactgataaatctatttctagaatagcaatgatttattccctcatttgtatcacatatgcctctctaggtcagcatagtcaggtgagatccacctattacaggtatggagggatcttccattgtcctatcttttcatttctaatgaagatacagtttggttgagtgtcaaattgccaaacaaagttagaacaatggcaatttgagagaatcaagtagatcaactcagggagataagtcaaaagacaaagactccttttctctgtgttgtttcagaaaagttggctcagaaaagatggcttcattccacattttaatgaatatggcatgtgtccattaactcctcattctcttatctaaagggaagcacctccattgagccaaatacaaacatcctctttctacaaccttcggaaagctgcaatgtagccctatcttgccatcaacattcctctgcaatgttttctaacttacagttgaatcaagttccactaccatgcatcataaaggtaatgttaaagatgctcagagaaatacggttgaagaaactcatccttacagaagcacctatgaataaaataatccataaattttatttcagagactgtatctttcccgagctagtattttcccaccaatgaatgataagacttctctgaaatactagtaacactgatggaagttggattctattacctattgtttgcttacaatttaccaacaccagtggctgggtaaatagtttttataggacaatgaataatgttgcagagtgttagctgactaggaatgccacagccattatgaccttcatcccgtatcttaaaatctctataaaaacatgctcaggtattttttctctcttggtattggacctgaaattcaggcttaaaaatatattgtcatctatatatctagataactaatgcttaataattatctccaaattagatcatgatataaatgaagggagaggaaatagcagtagtatttattaaaggttcacctgggcattttatatatattggctcattccgccccaaatctctgtgagttgtatatcggaatttctattttatatctgaggaaacataactttagaagggttaattaattcacccaaggaaaaacagtaaataccgtgctgagagtccaaaccaagattaaaatctaggtttatgtacctctagactctatatattttctacctcaagaagttagaaaggaaggaaggggggaagaaaggaaagagaaagaaaggaagggagggaaaggaaggaagaaagagaatgaggcaacctaataagttaatcagttggggaatttttaatttcttatattgaaacattaatatgggcttccagcatagttaaagacccaaactttatttttttgttgttttgttaagtagtaggccaaaagagacatttataagagctgcacaaacttctttctgaaaaatcctacctttttatgttttttcaatatccactattggccctgacaagtatattaaaaaatatggtttatataacaatttgtttgaaatgatattgaaaaacatttgatgtgaaagaaacgaaaaaaacatgcctctctctacagagcatttgactttcatgtttttaatatcaaggtatttcaaatagaacatatgaattgtatattgattaaatagaaaaatgctgtaaaaggttatccccttcttttcagacataagatatggaaacgaaatgttgatgttttctttctttcttcttcttcttctttttttgatcttttcagaagaaactcttatgtctaagcctaacacaagtgacacatccagtgtttcattcttaccttataaatttgcttttgatagagttctccgagatcctgttaaaacgagaaagatcagaaatcaccagcttggcagagcccggtgggcagcacctggggggatgaacagcaggacactgatacagacatgaaattcaactatcagagatattgagacttactccattagggtagggacttgcttcctgtcaaaaacaaacaaacaaaaatatgaaatcaccctcagttcgattttgtaagtaggagggagagcagactagaggaagaggcactaggggaggaaccacgctgaggagcagaaaggagggcactgggtgtataagcagaggggagggaggtcctgcgcaggaaggcaaggccctggtggacagcaacagcaactagaacaaacagtccactctgcaggtctgttcagccagcctgttggctatatttagtatttcataaattttataaactcatgttactttagttggctcaaatgttaaaatcaattaatctttctctttagaaggcagatatttaagcctacctagaaaccaaacatattttattttgtttttatttcaaaatctcaaaatggtgaggtaatcaaggcagcaaaattaagaggatcaacattatgagacgttgaagtataccaaaagaagcttaatatgtaaacgaggacaaacaggtttctgctccattaatcacagttataaatttgcataaagagaactgggagaacaatttataaggttctaatgtaaatataagaaatcttaatgaaatggtatcaaccaaagccgagaaaaagtgtgtacctcctaaatgctggttatgctacataggtctcttagattttcacaaatgacttgaattttggaataactagacaaatgttctccaaactaataaaagatggccaaaaggtagattaatatagtaaaaaattataatatacttttttggcatcggaatgttctaaaataattgtttaaatataggtgttagcaatatccaaaaatatattctaaacctgatgacgaaggtataagataatcaatggcaatgatttgtctcctccttctatccctgagcaatttcttattctttttccttccagtctgggaataaaccactttctttgtttagccataagaaacaactcatccattaaagttttatcatgagattgcagcaattcagttacatcttcagactccatttctaatgctaattcttttgttatttctattacattcgcagtgacttgctccactgaagttttgaacctctcaaactcactcatgatgtttggaatcaacttctttcaaactccttttattgctaatatgttgatttcctcccatgaatgtttttaatggcttctaggatggcaaatccttaccaggaggttttcaatgtagtttactcagatccatcaaagaaatcactatccatggcagctatagcctagcaaaatatatttctttttttttttttttttttttttgagactgagtctcactctgtcgcccaggctggagtgcagtggtgtgatcttggctcactgctgcaacctccacctcccaggatcaagcaattctcctgcctcagcctcccaaatagctgggattacaggtgcccgtcaccatgcccggctaatttttgtatttttagtagagacagggtttcaccatgttggccaggctgatctcttctgacctcaggtgatccacccgcctgggcctcccaaagtgctgggattacagacgtgagctaccatgcctggcccatatttctttttcttttttcttttttcaaggcagagtctcactctgtcacccaggctggagtgcagtggcacaatcttggctcactgcatcctccgcctcctggattcaagcaattctcctgcctcagcctcctgagtagctgggattacagacacatgccaccacgcttagctaatgtttgtatttttattagagatggggttttatcgtgtttgccatgctggtctcgaactcctgacctcaggtgatccgcccatcttggcctcccaaagtgctgggattacaggcgtgagccaccgcgcccagcctattttttaaataatataacttgaaagtcaaaattactcctttgtccatgggcaatagaattcatgttgtattagcaggcatgaaaaaacattaatcttgttcatctccatgagggctcttgcctaaccaggtgcattgtcaatgagcagtaatattttgaaaggaatatttattattttttctgggcagtaactctcaatgggcttaaagtattcagtaaacctgttaaagttgtaaacagatgtgctgtcctccaagctttgttgttccatttctagagcacaggcagtgtagagttaacagaactcttaaggatcctaggatttttgcaaaagtaaatgagcactggcttcatcttcaagtaacctgctgcattagcccctaataaggggctgtcctttgaaggtttgaagccaagcgttcacttttcctctttagctgtgagtgtcctagatggcatcctcttccaatagaaagatgtttcatctagattgaaaatctgttgtttagtgtagccaccttcatcaattaccttagctggaacttctaggtaacttgctgtagcttctatatcagcatttgctgtttcactttgcactctcacattacgaagaaggcttctttcctaaatctcatgaaccaacctctggtagcttcaaatttttcttctgcagacttctcacctttctgagccttcatataactgaagagagttagggccttgctctggattaggctatggcttaagggaatgttgtggttggttctatgcagaccactaaaactttctccatatcagcaataaagctgtttcacttttctatctttcatctgttcactggagtagcactttcaattgcctttgagaatcttttctttgcattcacaactttgctagctgtttggcgcaagagggttagcttccagcctatcttggctttcgacatgtcttcctcactaagcttaatgatgtctagcttttgatttaaattgagcgatgtgtgactttctttcactcgaatacttagaggccatcttatggttatgaacagggctaatttcaatattattttgtctcaaggaataagaaggcctgaggagaaggcaaaagatgagggatcagctggtcagtagagcagtcagaactcacataattatcaattaagtttgtcatcttctatgggcacagttaatggcactccaaaacaatgacaatagtaacgtcaaagatcactgatcacagatcaccataacagatgtaataataatgaaaaattttaaattttgaaagaattaccagagtgtgacagagagacacaaagtgagagcatgccattgaaaaaacaaacaacaacaaaaaaacccgatgccaatagatttactcgaagcagggttgccacaagccttcaatttataataaagcatatgatctgtgaagcacaatgaaatgagaatgcctgtgtatatctgaagtcacccaatggaggatgtatcagtgcctatgtctctgtgtgggaacataacatgatgtgtctgtgtgtgtggtttaaatatataaataacacacacacactcacaaacacacactcgtggtttcaaaaagaaactactcaagcacaattcttctactcaaaatgtccctgaagtgagacatttagctctgatgaacttctatactatgtggggcagacttcttgaaaataacaatacacagagcttatttgaaaagcaaacaaatcagattacttatatgctataggtgtttgctattaaatttgaaaataacatatgtggggagaataatcaggctgtaggtaactaaaagttgactgtcatcactaaattaactacaagtgaatccaagattaaaagtgacagaggcagaaaaaaataaaaatgaagtgtaatgtcatacagctgaaaccagagtaatttaccaagagcagatacaaattcaatgggaggggttggcttcggtgaaatatgggagataaagatctaaggtaacatagactaaatgtaaattttaaaaaatgatctgaggtgagaatgttgtggaaatatgtaaccaatatttttaagaactgtttttttccatcaattcaacattgctgttatcctgtttctagtttcaccttaatatagaaacaaagcaattccagtaagatatataaaatatgtgcaggcatgattcagaggaatagaaaaaagaatgaataatttgaggaggaaaaatataattggggttatatatgtaggataaaggtatataaaacaagcccttaaaaataatgttaactgccttgaaaatgttatttttaatgagaaagtagattaatgaagacattggccttcacttgtattagaaaggatttagcagagattttatctgaagcaacttcttagcatagtgtaaatgaaatatttgcctgagtatcgggtttagaagtttcactgaaaggaaaagaaacttgacttgctgcctcaaattctagtagctgaaattatatgaggtgaagtttccaacgctgtctcttaagatagccgacctggccgggcgcggtggctcacgcctgtaatcccagcactttgggaggccgaggcgggcggatcacgaggtcaggagatcgagaccatcccggcaaaaatggtgaaaccccgtctctactaaaaaatacaaaaaattagccgggcgtagtggcgggcgcctgtggtcccagctacttgggaggctgaggcaggagaatggcgtgaacccgggaggcggagcttgcagtgagccgagatcccgccactgcactccagcctgggagacagagcgagactccgtcccaaaaaaaaaaaaaaaaaaagatagccgaccttaccttaatgaattttccacaaacctaagtcagattctttgggcaaaacttgacttatccacagactctagttcaatcacaagcataatcacagtctgtgagactgaaatccataatcaaaatgccattaaattaacttaaaacaagaagactaactgctaaagggagaggagggtctggccaccacactgtgtgggtaaggtatatggagagccaaattgtaaactaggatgccagtgtattaatttgtaatgaaaaagtgtattgctgaaaggactggacacttctgttctctaccccgccaaatctccccctgcagggctaccagatgggaagccaaattaaaatcagatgcttgcttcttgggcttggaattggaacaagaggagtaaatgataggattgcaagttcagggtaacaggtcatctttggactgtggagccctttctcctaggctgccgatggctatgcacaaacttgatcttgtttactgtgctttcccctccagcttcccactgaccctttgttttttctatagttctgttaatgtactcaatcaggctacagtggggtcttgctggcctgggagctatttagttctctttgtggtaattttgttcccatctttccactgagtgttgatattttagtttaactcacaaggcacaatcttatttttggaactcttcagggaggcccccctcaacccagcactgacgatgtaagacaacagagatgattgcttaaatgttttccaatcctacatctctgtggcaaaaagttttttaacactatattatggcacacagataactgaatttcctttccaaagagtagaaaagacaaaggaaaggaaaatctgggtggactcagaagatgtggcctctataaaactaaatcctcaatcttttctcatttctaagaaggggaaaaatgatgatgattgagatgttggaattcattgtcaggaaacttgaatttttgctccccatggagatcaaatggaatatgcagatggagtactttatttcttggtagcttttatagatattttgatcattttcttcatattagagatttcaatttgaaattgactgtgaagatatagaaacacatgctcagcagaaacgtcttacgacatattaaaccattttctccctggaaactgttgtgataataaatactaccaacatagaggaaaccactggggtggataaaccttattatctatctgtgcattattgttaaaaatactaaaatcaagccatgtgtgttgcatggagttctactggaaagctatcatgtaataatacaaaggaagataagagagaagaaatacaaatgggagtgactagagagtaatacaattaatttatagccacatatattaaatttgtttaatattgacagtagatttacccctgggaaggagaagaagaaaacagaatagattttattttaaagaactcctgaaaccttaccggatgttgcctaatgaggtgatgtaacataaaacatcactcgatgctgtatttgcatactgcctttttcccctaagagattgttttgaaagaataacaaagaaacagaaatgaggtggaaaacaaaataacaaagcataaatattttctcagtgtttgcaaatattcataataatttcctatcctctgattcattagttctctcaaaagcccacctggatgtcctcagaatgcaaactgatacttaattattacattgggatctagattctttatagctatgccactcgtgtgaaaaatatgcatatctatttaagagctgtgcaaagcagtggtgatgtgagttatgccattttgctcaacacaagacaaactcctaaaaacagctttaatgtagacacaaactgttttgataaataaagctaactcttaacaagattgttcagagaagactgactttttcaatgtattcctttgtacccttttcctttcaatgtagaaccttctcttcctgctgcttcctacaaccttttcctcctacagttttctgagcaactccacttatccatagagaaaaagattttggcactctgattttcagattactcttagcccaaggtctacatatctttcccttcttcctcacccttcccaatttcacaggagacccagtgctcccttgtctcgctttaaattcttccctataataggccagaaagactctgacaccagatgcattggatttgttttctaactaaattttagtataaaaacatttaagtctagtgacatcacctcgtgcgtatggttttgcatttagtacccttcatattccattttgaaattggccattcactcattcattctctgaactggtgcatattgatcatctgctctctttaaggcactaagctaacttctatgagaggttaaaaaataagacctggtcccttaaggccagttaaagacaaggcctattaaagatttaatcttctactaaagacatttcaaacagcctttgcttaaagagaagtaagatggtaggagactggttagcctctgaaatcacattatgcctaatattggccctaaaaatatattttgttgaggtctttgttaagggagatatggggatatggggcagatgaaatcacagcatactcttcctctgtcagaattctcatgcccccctattgcacacccaccaacccaacaaacacacacattaagatataattacttatacccagacttctgtttgcaaggggctgctgtcctgcctatggctattgaaaacctatttctccatgatgtacctatctttcctgggccctttacctataatatgcacttccctcctcttccagtcatgtagtagatataatcctccagttaacccagcccctaacttcagtgttttattttgtctcaaaaatccaaatatttccatcgaatatttggtgtactttttagagaatgccgtgtcatttttttttgtaattcttcttttctaaaattcttgaattttaattttaagcggtgcatttttatttctgaaaatcaaatttggctaatgaagtgtttagcccaatccagtgaagctcagctccctctttgagccacagtctgtgctgtctaacgaaccttcactgaactcatgggtagtacaatttagtagtggtatttcagtagtacctgttgtatgcctcgacaaggctttggagaaaattcctctgttctgatttccaaattcagctcttttctctgctaattgcttcttcttcttcttttttttttttttttagacggagtcttgctctgtcacccaggctggagtgcagtggcatgacctcggctcactacgacccctgcctgctgggttcaagtgagtctcctgccacagcctcctaagtagctgggattacaggtgtgtgccactacgcctggctaatttttgtatttttagtagagacggggtttcaccatgttggtcaggctgttcttgaactcctgacctcgtgatctgcccacctcggcctcccaaagtgctgggattataggcgtgagccacggcgcctggcccattgcttcttgatataagtactagctattctacagcctgcaccatgacgtagccctacctagtagaaactttgagttagattgcagtcatcaaagccatttgcccttcctttgtctctaataaaattaccaaggacctctccttaagtagtctatcatcctaaactctcaggagatacctctgagtcttggttttctttaaggtttgcaagaaaggccaatcactcctttcttagaacatttaataccactttttaacttatttcctataataccaagatggcacacatattaatcaaaaacacaaaccctcccgatctgacataatgtagatgcaacattacacactttgcccagtaagtaccctctccacctcaaggatcctttgccctttacaaaccatgtttcaggttctccatctctatcacagcctgaagggcaatgtcccaatgtattcaggaatcatttagactatgatgggatggcacagtccctacatctgctaccaaatcaaggagctgattaacagtgcattgcagctcttggcaagagttagagtaggaaataaaattaaggtgtaggggttaggcaggaaattcagataaaactacttgggaaatgtagctaagcaagatataattatctaacttataattagactagaacatcaggcctcccatccctaaaggcttctttttgcaaagagacaagtgataccatcaggtagcagatggtattcttgtatgggtgcgagtgagtgatgaacacttcttaccttaagaatttggttgtaggaattattcctactggtgataacttgctagcttaatagttcattatttctgtgtcttccattcctttgggctagtacacttattaaattagaaaggtggggtggtctgcaaaatttcagtgacatctctacaggctagctattggcctctgccatttgatcatctcaaactatctagcaaattaatacaaccaacgaaagccgacagactacattgatttgaatataactccaatttttttattgtatttcttaaaagttctatgacatactttagtttgcagaaaacagaaagttacttagttttagagcgtgattttttttgtctcactggatgtttctggtttgtttgtttgtttgtttgtttgtttttgagaccgagtctcgctctgtcgcccaggctggagtgcagtggcgcgttctcggctcactgcaacctccacttcccgggttcaagtgattctcctgcctcagcctcctgagcagctgggattacaggtgcccacaaccacgcccggctaatttttgtaattttcgtagggacgggtttcaccattttggccaggctggtctccaacccttgacctcgtgatccacccgccttggcctcccaacgtgctgggattacaggcgtaagccaccgtgcccagctgaatgtttctgttttaaagatccttgcatgtggctctgtatgtaaccctgtccttgcaaagttgttagaaaaagataaatgaactcccattggtttaaggaattgactgtgaagagcgtgatgtaatctaaaaatcagaacaccaaaacttgtttcctctttggataagtagaattggtcaaagaacagagtttatgacttctcttcacataaaagatgacattatctatgatgaaagacctagttcttgattttcttcagattccacatggacatcttacttgctaaaagcaacgtggccaaacaatttctgcctgtagcaaattgttttcagttatgtttcctcacgaagtagtatcctgaaattaccagtttgcatactgtttgcaattattactacaaatgcagtttagcttttgtgtaaatgaatgaatttttattgtatatatttaaggtatagaacatgatgttttcatatatacatacatagtgaaataattactgtagtccagcaaattaatatatccaccacctaatatttagcttttaaagccctttaatttctaaatgtggaattggttcatttatttacttatttatccattctataactcattaattctttgtaccaacatttgctgaatatgtactttgtgtaagtcactttgttaagctctctggaaaataaaaacaaagttcaattttctgtgtagtaaaacgtgtttaaccacaagacattaacagagtactaaattaatagaaatttttcatgtcaactagtgcattattttgttatggcttccatcactaagtaccatagactagatggcttaaacagcagatactggttttctctcagttctcccagtgtgactatcaggattctaatcctgtttttgtatttgtattaaaaagtgatagaacgtatagtcaagacggatggattaaattgttcatctcgcccctaagaattaagagtttttgttggtggtggtttgtttgtttcatctctggctgacaggaagagtgaagaagagaacgctgtttcctcgtagccccaaataacatttcacctacttctaaagctgctgtgaggtatgcaaggtcttacataaagagaaaaatctgtctcaaaaatctgcctcaagattgtggagtcttgctctccttgcattcttttggtttttctgccacaattttgagacttatcctaggaattcagttcagcctttttttcgccttcaaaataagcacatttggctgcttattttgcagcagccaaaacgaagcattcggagatgttattgttgttgttcttctctatcggtccagtacagttccttttcttcttttattcctaggaaatctctttgaatctactctgtaaatagaaatggcttcccaccacacagtgaaaaccaaaatccttatcttgactttacagggtctttcatggtctggccctgcctgtatccggcctcctctctcactcttcctcttgctacgtggctagaagcaagaaaacagggaatctaatctagttttatctggctctaaacccactgctcttaatcaatacactgcaatgcccttgtaagttatttacctctctcccatacagtacgtgccaggtggcccatagttctagctcctatctccaacctgaaaccaattattttcacaaagtcacattgattaaagtataatatttacagaggtatgtgtaagagttgtagatgcaaagtttgattgcttttcacaaagtagatgccactgcataaccaaaatccagaccaaatttttacctgtgccccaatgaaccccttataaccctttctgaaacctaccccaccaagtaaccactattctgacttctgaaactataggtgtattttcctgtttatgaagtttaactcttaatttaagagtattagatatactgttttgtgtctagcctgttttgcttaatattaaatttgacagattcacctatgcagaagatagtatagttcattctcattactgtgtatgtgagtatattacaaattgtctcctattttaccgtagatggatatttgggttgcttctagtttggaagaaattcaaatactgccactagaaacattcttgaatatgtcttgtggtgaatatatattcttttccttcctcttatttttaaacttctattttaagtttagggatacaagggcagaggtttgctacataggtaacttgtgccatgggtttgttgtacagattatttcatcaccgaggtatttcatcaccttagtacccattagttatttttcctgatcctctccctcctcccatcctccaccctctgagaggccccagtgtgtgtttccctctgtctgtccatgtgttcacatcatttagctcccacttataagtgagaacatgcagtatttggttttctgttcctgtgttagtttgctaagaataatggcctccagctccattcatgttcctacagaggacatgacctcattcttttgtacggctgcatagtattccatggtgtatatgtaccacattttccttagtcagtctattattgatgggcatttaggttgattccatgtctttgtgtattctaacagtttacatcactatcagcagaggatgagaatattagagttctcattactctgtatgcttctcagcacttaatagtgtatctatatcatttgagccattctcatgagtatgtcataacactacctctttttatagaccttatttttccttaaagtaactaatttattttagctgtaggacgaaagcagaaaactcagacaaaagagaaatattacctttagcaaaacaatcagaaatgagatatcaaaaatcacccgaaatatactacctaaagaagactaataacatttccagcgttagtcggttagacctttcctttgtttgtgctttcaagtacagtcatgtgctgcataacaacatttcggtcaactacaaggcacacgtgtgacggtggtctcaggagactacaatggaactgaaaaattcttaacacctagtgatgtcccagctgtcgtagctgtagcccaccacattactcatgtgtgtgtggtgatgctggtgtaaacaaacccactgtgcttccagtcatataaaagcatatcacatacaattacaagcagtatataatgcttgataatgaaaatcaactatgttactggtttatgtatttactatgctatactttaattgttattttaaggtgtattccttgtacttctttttaggtttgctgtaaaaccgtattcagtgttatgccagcagcagcctcatacatcccatgtttactgtgtctcttgactgtatcatgttcttttgtgcttaatttaattacacattattttattcatcacggtccttaatcatcaaaattcatggctaatgtgtcagaaagaggccctgtcctgtgattgacctgaaagctaaattaaaagtgaataagaggtacaaagatggaaaatcagtaatggttattgctcaccagtcaggtctgtcccattccaccatagccatgatctcaaagaatgagaacaaaatgatggaagctgaaaagatcttcttcattgaaggcaatgagactaacaacagttcaggaagagcctatatcagatatggagaaacttctaatgacctggaatgaagaccagtcacagaagtgaattcctcccagcaccatgatgatcacagccaagcaagaagtttgttcgcaatgttgaaagaaaaggctggacccaactacaatgttgaatttactgctagctctgggtggtttaaatgattcaagaactgtttttcattacgttatgtgaaagtaagtggtgagtctgcaagtgctgatgtgaagacagctgaagaatttctgaaaactctagttttcagttgattagtgataagttgattgtgagggggaattacttgtcagagcaaatcttcagtatgaaggaaacctctgtattctggaaaccaatgccttaaagcactattatccctaagggggccaagtcaatgctggatgtcaggtttttaaggacagaataaccatctcactttggagaaatgttgcaggctacaaatagaaacttttaatgatatggcacagtgacgaccccagggtctccaagcatatcactaaacacgcactgctggtaaactagaggagccataagaagtcatggatgacccagctcctttccaagacgcccttctgaattactatgccagcaaaatgagaagtactattggagaataacatacctttcaggatttgcttattgttggtgatggtcccacacatgctccttttattggtgatctccatcccaatatcaaagtaatgtttttccctccaaacaccacctctttgattcaaccattgcatcaaggcattaaagcactttttaaggcctattacctgagaaggacttttacccaggctgctgctgcaaaaaaaaaaaataataaaaaaaataaaataaaaaaataaaagataccaatgcaattctggaaggattacgacatctctgactgcaccaagaatcttgcttgggcttggggtggtgtcactaaggagtgtataaatggcagctggaagaagatactcaagaggttcatcaatgacttcaaatgatttgctcaggatgagcaggttggaaaaatcaacaaggtggtggttgaactggcagacaacttgaacgtgggtgtggatgaggatgacatcgaggagctcctggaggttcttgagaaattgactaatgaggagttgttggaatagaacatatagctgaagaagaggcaacagaaaaggaaactgcaggagaagaaaaggaaaacccccaaggaaattcacagtgaaaggtttagaagtttttacagacctcaacaaactccttaaaaagtttaaaaacgtggaccccaaaactgaatggttcgttcatagaggaatgttcatagtgcattgtctactgataagaaaatctatgattaaagaaagaaagaaacccagcaaaacttcataaacatatttctgaaaagagtgacacatctttaaaaagagccttaagcaggtccttcaggagccattccagaagcaggcattgttatcacagtagacagcagctccatgggtgtcagtgcccctgagaacgtcccagtgggacaaggtgtagaggtggaagacagcagtagtgaccctaaccctttataggcctaggctactgtgtgtgtttgggtcttagtttttaacaaaaaagtttaaaaagtaaaaataaaaaattaaagattgaaaaaatatttaaaaatcttaaggtaaggatataaagaaagaaaatatttttgtacggctgtttgtgtttcaagctaagtgtgataaaagagtaaaaaataattaaaatttataaagtaaaaatttataataagctaaggttaattatcaaagagaaaagttttctatatatttagtgtggcctaagtgtccagtgcttctggcatctacagtagtgtgcggtgatgccctaggtgttcacatcctgtcaccactcactgactcactcagagcaacttccagtcctgcaagctccatttttgttaagtgccctatataggtgtgctttttttttatcttttatattaatttttactgtattttttctatgtttagatatacaaacacttaccattgtgttacagttgcctaaggtatccagtacagcaacacactgtacaggtttataacctaggagcaataggctataccatatagcctagctgtgtagcaggatataccatctgggtttaagtacattctatgatgtccatacaaagatgaaattacctaatgatgcatttctcagaacatacccccactgttaagggacacaaaataagattttacacaaaatcttgttacttcatataacaaaatgcaacataaaactttcaaaacaaataaatacacttatgccccataaatgttaatgtgaaaatcatatttcatcaaaaatctatattactatgttaaaatgaacagccttgtaacatatctttgcataggtccctaattaattttcttaaaataagtcccaaagtggaattcttgtgtcaaaaactatgtattttgttacagctttcgaagactactgttagacaatattgtaccctgaccaactatatgctaccaccatcctacatttttacccaagctggatgtgggaattcttatttaggtcattgtgacactagtttattggtagtcgttactggtagtgaaacaatgactccaattcacttcccagccagccatcctggaggggctctgggtgcccgggcaagccccagcctctcatctgcatgctcaattccactcttcttttgtttcccattggcaccaccattgtccgcctcctggactcatctcttggtcttctccatccttccagctattccagctatcatatcatgaccatatcaggcttggactcccccctaatatttattcgctaccataaactaaattatgttttccatcctaagcacaaacatttcactaacacccgtcatctgtttgtgaggcagcagcaggagcaggtaatccacggttctgctttctctgtactcttctagaaataggggagcttagattctccctggatcccatcttctagagatggcattactggtctcatattctattttctttcatgtattgaaacttttgttattaatagcttctgactaaagtgaaaatgtcaatgtgtaaaatatgtggggtaatgtgttccacaatatacagagaaaagctctgaaacagtctcctgtaattctggattttctgttttcttcttgttttttaaatttccgggttcttgagtccatgtggtctaagtcctgcattaatcctgaacacatggcagcagggataaagggaagacctgaggtccgtgttccaattcgccagggatgtgaatgccctggacgttctccttctgatagggacaggaggcagagaaattctaggcagaaaagggtggatccccaacaaaaccccaccctcaagcctgggaacacagtccaaagtgagaacttacatctctgtttctggctcaaatatttccttttccaaaaccatgtgtggccctgccccatcctgtgcctataaaaacctcatactcaaccagcagagagaggtgaagcagctggacatcagagactgtggctggatgttggagagaagtggcttgacttcagagggagagcttgacagcataactttggagaagaatctggccagagatggccagacgtcaggggaagattaccttcccattccatttgcttttcagctccccttccaactgaaagccacttccattggcggtaaaatccccgacagttgccatccttcaggttgttcatatgacctcatttctcctgaattccaggcaagagcctggataccactagtgtggataaaaaaggctgtcacacttgccctgtgcccctgctggagggcagccacctcatgtgagtaggcagagggacgactcagctgttaacactcaagccgtccacggatggcagagctaaaagagcactgtaacactccctctggagcttcaggggtcatgggcatcacgccagactctgccacggggcctgcatgaagtttgctcctgctggtgcccaaaagcactggctctcggctcctgcctccacttacccgtgtgctccttcccatgagtggtggagcacagcggatccgagtgagtggagctggctcctgcctgcgctgaagcagccagttggttccagtgtttgcgcactccagttctcacctcgttcatttcatgctctttcctgcaaggagttgacggctgtgagctgggcaaatgaggcacccggttgcaagttccatgaaaggctcggggaaatatcctgcttcacttccatatggagctagtgctttgtaaagtgcactgacaataacaaagtgtagaggaggaccggacacaggctgaactgagcttcttgaaaaggctgcagctctcagaacaacgctgagaaaactggtccttcagctatagacacagagtcaagaactccatttttcaaattatatctcatgaaaagctggtgtccagtgacgtttatctgagaaaaagaaatttttttttggccaaaataactagatagatttttgttagactttataatgagaattatgaatttcctgaaagtgggatggaatacagaatgttccccaaattgtttccatggaacagctaatagcacatagagcatgcgtatttgctgtgacatgataaagctcaaggccagagatgtcttgtggggctcccaagtactctaacctcaaggtgcatgccctccactcactaattggctcctctggctgtgatcgagctccaaaagggaaggaggctaattcaaatgggatggccccaaaataagaggaatagtgtgcatttaaaccaggatatgggctatacctgcttacagtaccctttatgcaatctccagttcattaactctagtagatattgtgaagatactatcaaaaaaaggttatgttcccccaaattagggaagccctaagggattccgtatctcctttttgtacagagtttgttagaaaatcagatactggtctgagaaaaatgctgattcagatggtcaagagactaaaaaaaagtactttaaaacatcagaatgaaatcactgaaggcaatccttagctttatgatgtgctgtactcctggacaagatggtgtaagttgagatgatatgtcaaatctgatttttctataggaaaaaattgtactttagggaggtatagttctagccatgttcttaatacccaaaagttaatcagaattaccacaaatgatctactcattcaaatataagtagcccacaaataccatgttaaactttctaaatttgaattgtttaaaaaagcaaagttatagaaaatgacatttatgacccattatcagaagctttagatccaatattagaatattagaggcttttgtgctaaactcttttctttcttataaattctagcctttatttatctattttaggagggcatgtggcaaagcatggcagggaattctttcaaaagtggaatccaggaagaaaattccttgggaaactttggactggattctcaacaaacccttcagagagacttaaagccggtaaaagaccttttgcaaaagtgatccggggggcctccactttgtttctctggatatttctctgttgaaatataggtgtcaagcacgtcccattttagatgctcttcagacttcaaaacattaccttcctgctttcagggagccatttcatcagcttttgtactgtgtattcactgcagaccctgctgttatgcaaggtaccaccatggctaaaaattcacaagacgattcttagttgcactgattttttttttatttgatctttcacaatgttgctgcttccgtttcaaaaacgtctcaaagctttgatttgattgcagctggattcaaggatacccaaagccaagtttgatcctgaattccccaaatcaaaagtatttcatttcagatgtatgttctatacctggccataataatgaacagcaaccattactggagcatgcttttgatttttttttcattaacagtcatttttatgatttggaaacataattagaagattcctattccagactacaaatcaatggatttgattctactacacatttgccaataaagagcaatggtatcaaatgaagcatttgacctgtctttaaatttctttcattctgtaaattctacatgaggtatgatatatggagccaactggctcctctgccacactgctgcagttcagttgttggtattgtctggaaggaaaaaacgaagttgtggaagtgtgtgagttagttggaggtaattaccatgtaactgattatcattcatgttctgagcgctgtgctattacatacattattttatttcatccttgcaacatccttattcctatttttcagctaagtaaaaaatgaggctcagaatagtgaagtaattatccacggagagggaagatcagcagtatagattaagttggaataaatctaaagctcatcctctttcactatagcatgctgctttctagctatataagaaaaaaacctcattattctattaccccattgagaaagtactgttctctcttgttcagctgtctgctttacttagctccgatgaaatctaaattaaatgctctgctgctgatgatgttggtaacactctggtggtactaaccatagttctggggagtgaatgggaagaatggccaagactggagatggggacattagattttgagacacagaccaactgaaatgagactgtgttttctgttaataataggaatttaaatgaatcattgaaaaatcagagaaagttttctgaaatataggaagcaaatgctacctatacttctttatatctttcaaattaaaaaataattttcaatacatgttaaatggtacaaaaatcagtggggcttttttaaaaattcaagctttataagaaaaaataataaaacatgtgccaaatatgtctgaatactattaaatgtaaatggtgtatcattaaatgcactggctgtttgggagaggtgtaataaacaagagacacattgtagctatgaccgtgacgatttactttttttaattctggaggaaatttcaaactgtggaatatataagcagaaaggaaatgaataatgcatctaactagcatgcgatagtaagcctcactcccgttgtggacagacaatatacaagaaaagattttggtggaaagatgtaggtgctatttaaggggaggatattctttattgaaaacatatccagcaacatctgaatgccaaataaaagtctttacagtttcatctctccttagagagcatattttttagttgttgttttgtttgggagaaaattgcagtttaagatttacaaaccacttcatttgcaaactgctattactatagtttctgcctctgaaaatgtttaaagctgcaggcaatgaaaagacatattattagagcttttccttataaagaaagctctcattctattgtaaaaaatgagcgtataaaaatacaatattatttatagagttatttatataagcagcattttgatgtgccttcctgaggcttggagatattagaaagcagaatatctgagaaaacatatttcacttcgttgtttaaatgcaatagagatcaagagattatcttcatcatgataagattcaaagaaatttacactggtaattggagcttgtccatagaatttattccttattacaatatagactataggttgttacatttttttccttaagggaggtaaggttagatttttcactatttaggttgagactctttagttgataactgaaagttttcttttagcattcaatttgttcttgaattattttttatttcagcatatctttctaaaaattatgcatgatcagctcttttttttttccattttcctatcagctgtttatcttagatcttcattcatggatgtgttagtttcccaggattgccaaaacaaatcaccacaaactttgtgtcttaaaacaacagacatttattctctcagcagttctagaagccagaagtttgatatcaaggtattcataaggccaaacctccttcaaaggctccagggaaaaatccttccctgcctcttccatattctggtggctccaggcttttattggcttttggtggtatcactccaatctctgcctccgtcttcacaaggccttccattcagtgtctcaaatcaaatctcttttctcttataagaacaccagtcacttgacttagggcccacccaaatccaggatgattaattttgagatccttaacttaaacatatctgcaaaaatccaacttttcaatttccgaataagatcacatttccaggtgctaaggtatattagtcagggttccccagagaaacagaaccaaggggatatctaaatgacccttatgggagaccactagtgtcgatcctggttcaactctaaaggcctgaaaatcatgagtgctgatatctgagggcaggtactcagaaagaagaaatttattctttctccaccttgttttaaattcaatccctccatggattggatgattcgcacattggtgaggtggtcttctttactcactgtactgattcaaatgccaatctcttctagaaacacttcacagacacacccagaaatgatgttttactagctatctaggcatcctttagcaccatcaagttgacacataaaattaaccatcacacaggggttagcgtttgggcatgtattttagagggattcaggtgaatgtattacaagatgtgaaaaatagactttggagttaggcaaaactgagtgaaaaacatggatctgccactcacattgaggaattatgatcatgcccataattctttagagcacaagtttcccccttttaaaaataacgatattttaataattgtgatgatactagcttcacacatgttgtattagataatagcgtgcattgtaagataatatgtataaagcaattagctccctgctttgccaataaatggccattgttaatttattgattatatggattttatttttctaattagagtaattccattgacttcaatttctatagagttcttctttccttttatgcagcagaagttacaaaagagaatgtgacatgaatcatatctgtattgaaaatagacatacgatgactaattttgttctaaatgaagaatgttttcttatggaattattgtaagaattaaatggaaaaaaatgtatgtgaagtacttagcagttagcatttagtgttagctactattatcaacaattccctaaaacctgctagggttacagtaaccatggcaacacaaactctattttatttagtaatatatttatttgctaattgacaaacaaaattgtatttgttcactatatataatatattgttttgaagtctatatacattatggaatgactaggtctaggtaactaacatatgcactgcctcgtatagttatcatttttgtggatattttgcattcattctcttagcattgtttaagaatacaatatatggctaactatagtctctgtgttgtatgatagacgtctttaacttcctcctatctaattgaaatttcgtattctttgaccaatatcttcccaaccaccatccaccaactaccccagcccctggtaactaccattctattctctacttatatgagatcaactttttaagattccatttatgagggcaatcatgcaatatttgtctttgttcctttggttggtttgtttcacttaacataaggtcctccaggttcatccatgttgtcacaaataacaagatttcctcctttttcatggctgaatatagtattccactgtgtatacatacagcattttctttatccattcacccatcaatggatacttagattgattccatctcagctgttgtgaataatgctgcagcgaacgtgagaatgtagatatctctttgacatacagatttcatttcctttggatatatactcagtagtgagattgctggatcacttaggagttctgtttcattaatttttttttttttgaggaacctccatactgttttaaatactggctagtttacattatcaccaacatcaggcaagttctcctttctttacatcctcaccaacacttgttctcttttgtctttttgacgttctgagaagtatgaggtcatgtcacattgtagttttaatttgtctttccctaatgattagtgatgttgagcattttttcatatagctattgaccattttgtatatcttgtttagagaaatttagagtcatggctcatttttaaattgagctatttgttattctttgtttgttctgccattgagttgtttgagttccttgtttattttggatataaaccccttatcagatgtgtagtttgcaaatattttctttcccccattctgtaggttttctctttactctgttgattgtttcctttgctgtagaacagctttctattttgatgcagtcctatttgtctatctttgcttttgtcgcctgtgcttttgaagttatatccaaaaatcgttgctcagaaaaatgtcatgtagcttttttttctatggtttttcaacgagtttcacagtttggggtcttatatttcagtttttaatccattttaagcagatttttatatatggtgtgagataaggatctaattttattattctatatgtgggtatccagttttcccagcaccatatattaaagagactctcctttctccatggtgtgttcatagtacctttgttgaatattattagttataagtgcataaatttatttctggagttcctatcttgtctcattgttctacacgtctgtttttatgccagtgttgtgatgttttggttactatagctatgtagtatattttgaaatcagggagtgtgatgcttccagttttgttctttttgctcaatatcacacactcctttctaaacctcatcatcgtttagggtatataatacaattaataaatgcatatataattatatgtcttttcaaataattgataacctaaacttgataaccaatcatagttttacatactaactggcagttcctttctatcttgccctgaatcttattttatagacatacatttccaggatgttacatgagccttcagtttagctcatcaatactcagctatccaaaattcctcattgccttgcagcagtttttcccaataccagggccatgttcttagctggctttgaaaaatgttttgaagaggcatcttctccagaaatcttttgagactgatctccccaaatatgaatggtgctaggattattttactaataattgaaccttctaatgcttttctctttgttattgatttcttttgtggcattaatttttaaagtgcttgatttcccagttgattatttgctatattaatcatatgtctttcaaggtcttggctttgttaatactgtcttaactgactacagaatgaagacttctaactttcaggtaaggattccgcgttttttattcaggacaggtccaaaaaatggcaagataacagcaaggggattcatttgcctgcaggcagtttggttaaaattctcccttagttctcatatacacattataatttgcattttaattttactgtcttcacaaccacgaaagcatatttaggtaaaagtgctaattagatctttgtaaacaaccatatgttattttggtttatgaaatttaaagagcaattaaaaacacatatatttactacttataggtgggagtgggaatgactttaatctgaaaagtgtaagtgaatctgaggaaaaagctaaattagagatgtgttgaatgatcttttggaagaaactaaaagaaatttgaaacttttcttcagaaaaccatagggccacacaatgctacacattgagcctcaccataattaaatcaaaatacttgaaaattatatttcaaacctcttttcaactactgtacttaccttagagaaatcttcaaaagaaatctgtggtatgtttattgttaatgaaagcatgtcattctttctctggtgacttatccgtctttatcagtttcactgtgaagagcagagtgatatatgagtgtgataacttaagatgacatcttatagtgcaatccattatctgaaagatttaaggaaaaagctctctgaaaaaacataattaagaaaataaatgtttttagaaatataataaagatcttttatggttttggttcaggaacatccatttctataatatgatacactaaggaaatagtctgccaatcatctaaataacacttgtattttgatttttattggtttggcttctccacaaagaaactaacaaatcattaacaaggattaagaacaaaaaagtgtctaaagtttttttagaaatggattgaggaagtagattaaaaggagactcagagaaaagagactgttttctaaaaatatggccacgttgtaaatgtgtgtttattttctcaccaataaaaataggcaatatgttgtttattgcctggatagttggacttgacttggtttttggctcctgatttttggtctgagtctaatgaaccaataaaaatctcttgatgtgccacataagtaactcccacttgaccccattccaggagctaaagaatctcatggcttcaacaaattctcctgaaccttgctttggaattatattgtttatttgtaatagttattttctctttgccttagttgatttaagaagtctagtatcacgtcaggatcataatatatagatacagaactccttaaaaataaaccccaaatctaaaatcaggattgaaaaaaggacagaagtgaaatcaaccaaagtaaatgtttaaaatatgcattcttagctgtgcttattcaaattggtcaactctgaatatcttcgtttctttttttttttaattccactggttacagattccaaatttcatccattccttcttgccttaaactgtgatctgtaacctgtgccttcactcaaattaccatttcagctcttttacaaacatcaaatagcaaagggcaatatggatattttattagacttgcacagatcagaaacaaaaaatgtgcacacaggttcaggggactatgtgcagcatttctgtaaggaaatagtgggtgtgaggtatagagagaaaactttcccatcatcaagttcctggacactatggtactgcacttgtcccactataattcctttaaagtatagcgactacttttcacctttgtaataactacggtacttctaaagggccactacaatagcaatgagaatatcatctgtttttcttggaggtggtagttttcatcaagcatatcaagacatatgagaagatggtatttaaaatattcagccaacaatatgtcctgggcatggaccagaatgaacactggccgaagtgctaaagcaatatattggggccccggctgtttctgagatgtggggacttttgtgaggtctaccctagtgtacacccggagtagattcaggaaacctaagccgttgatgtttaccagttatacaaaagtatttcaatacctgaactgctgtggctataccagggcatgttcactaaatatcagccatggactttgcaaatttaagcaagcagacataaaaataagtcatacagtcattctgatgttcttgccattgcacatgctctctctctctctgtctccctctctatatataatttattatacaatacattataataaatagtatgtataataaatagcataaactaatacctacaaaatatataataacatattagtcatattagacatattcttatacccaattaaatttttattaatagaatagacataaggctggagtgcaattaatgcaaaattaatatatacgttatataactcatgtataaagacagaatatttaacattagaatattttgttattcttgtttggcattgctttcaaagtccatttctgttccacataaagaaattcatttcaggttttcatagtcgtaacccacatatttgaaaggggaagtttcatgtgtatgagatcatagaccaaagagcatatttgtaaccatcattggttgtttttgtctgtttcatttagtttttatagaaatagaacggatttggaagcttactgtaaacactgtgaaatggtgaagacttaagaagcttttcttaaatctctaaactgctgagagcgtcctagtatgacaaaatggtgccgtcctttagtacttaaataaatatcattcttcctgaaacactacagttaaactcagtgggtcacttttgtgctttggggtgtaagaccccaaatattaacctgaggaacctaaaagcacaccagaactttctgaaactttttcccccatgctagatggggtttggtctaggagaaaagttttgcttctcttcccagtgggtcttgttttagaactctctaaagcaatgagcttctctggtttatcttccatcttgtttattgtacctagtctctgacatgcagaaatgacttaataaaggttttctgaattcgtgaaattcacctcctgaaaattaccaccttatgatctgaaaaaactatctgctcaacagaaagttactcatatatctgcttctatagatacagtagtctcccttacccatggtttagctttctgtactttcagttaactgcagccaactgtggtctgaaactatcacagtattttgcaagagagagagagagagagactacattcatgtaaattttattacagaaaacatggcatatatgggacttagtgctatctgtggtttcagcatccactggggtcttggaatgtgtcacccatggataaagggggaattactctgctagatttggtaaaaaggcagactagtggagagatcttctgaaaaaaggagataggaaatgttactgaagagaaatagaaaatattgtattaatttattaaaagtaaaggttattagaaggtattaaatttttgatataatgtaggtgacagtgtgagtggggaaagacctgtaagtgcaacaaggggatgaaattccctatcttctagccatactccagtacataaacggcttaaaaataatgtatatcaaagcaatgtaataaaggattaccgtgatgaattttatgagattaagctgcagttaatttccttatgcatttaagattaataaactgctaattagaatatgcaaataagggtttctgaagcctaaaatatattccctagcatcttacccataaatcttattcagtaactattttgttatataattggggaataacagattgatgagccaatctaattatgtgaaatttacatgtgtatggtattttataataaaggacatgaactaatgttaaagtagtggaaagtagttgtaacattcattatagttattaattacaaaatttaacttagtttgaaagtactttgtgccatataagctatcagccacaccaagtactcttactacacatctggtgcataattgtcgggtgagactgagcccatcagcaattacagcaattattgggactcttacatttacagctcacacacatcacacccaagcacacgtttctggaatattgctgatcatccagggacctagataacaactaattgcctcattatgcaaagtggggaaagatattcgtatttcttacatcttctgttctacattatacacatagagatgcctgtttgacagcaagcaacagataaaagaatattagaattatttttgtgcccagttaaggttttttgggtttggcttcgactttttcataaagaaagcatcttcatgaggctggaggacataaagcaatttgaaagctattatgggtaaaaaacatctaaagggtttacacacacacaaacacgatgaaggaattaggaagggctctaatgatcctactatttactactttggcaagataccaaatggaataagaattaaaattctattgaaaattaattcaactgagtggacagaatgctatgaagtattcggggcattttctttcatataatatataacatttactaatatgttcaagtaacaaaagttacctttatacagttcacctgtactctgtgtatttgtccaacattcccatgaaggacaaatgtaattaatcccaatttaaacaggtaaaaaatgaaactttgatatatgcaaactgcaatttgtaatcaatagtgagaaaatggaaactgcagcctttgcaatccagttctgtgttctttatacctgtgtattgccagatctatgtgtgtaaataaaattcaacaaagaaatacctgataagataagttttgtgggcatttatagcacacttagtgaaaatatataatatcaccaagcccgccatattagaccacttttaccttatttttcttactttaatcaatatttcattaaatttgacttaactttatgtgtaaagatactggtatgaacaacaattaccttgtccatattattatctcttccagctttttcagagcagtttgaacaaatgaataaaaacttgagaaacataaaagatgcctaactaatacatatggcacatgcattataatattaaaagggaagaattctcaacttgttatgtacacactcaagcttttttttttttttttgagtattcaattagcagaataaccctacagaatccgtcaatatcctgtcttcactgtgaacagaatagaaaattcctcttcttttttttttaatgactgccaaaatctagggcacttggtgttgatgcatgactaattactaatgtttcaacagagtaagtcagattcaaattgtaaaggcacacaagtgaatttaaaacctactttttcattctttgataatttctctaccaatggaggataagaagagatgatgccggtttgaaattcctgacaaaaacttaaaactgcttttaccctgtctggtatactattattttattctaactgtgagaaaagtagtaatgagatcatcctatttcaactaccgtgactttaaagagaacatgacagatacaatttttcaacaaattaggctgttttctgaaatactaacaaagtttgccttttcagaataaaatgttacaagagctgcttctggccctaatgtgcccttatcagcgtgtgtgtttttaatgtggttaaggtttaacattcattccagcttcacctatagcttgttggtatgctttatcaccatggattttaaacacactgaagaaaataatttctacccccaaaattattaaagcccctacaaggaactttacactttcaaaaaaataattattttcaaatataaacacctctttatatcttgacttttagatccctataaaagccaataagacaaatttgattcaatgggaattctttgtactggcaaaaaatattacatgaacgataatataggagaccctctgttatgtaaaattacgctatttattactttagcaagttccaatagaataatcgttgatggccctgaggtgtcacatgatcctgaattacttaattgttacatatattcaggaaaataataatgttaactgcatcatgctctagtctaagcttcaagaaattggtaatacaaatattctatataatctagcattctacctaaatatttgatcatttgtgacaactacattgaatgagagtttaccatacttttttaacaaaagaaaaaatatagcttagttagctattgatgagacctactagaagaaattaaaactcatatcttatgatttatcacaaagcatttgagcacaaagcatttgaatttgatgttaattcaccttggctgtgactcactgagaattctgggttttacagatgggtagatcacttccttttcatgtagctttttttaatattgttgacataagagaatctgaagtatcatttcttcacatcctatttcacctgtcattgtcatctcaaaaatctattttctcttgcataaaacctcagtgtttaaagctataaaagcaaacacagcagtgaggaaattttcccctgggtctatttgccatatgctttaaaacagaactatttgaacaccaaaatcagcattcctgaacttgcgtatagagacgtttgttttcttttcccacctgcataagggtaaagaattcaggcttgcagaatatcctttgaattctaaaaccttgctgaaaaatcatttttatactgcagagtgatgactcttgctaccttcttatgattggaagggtttccaagagaaacaagatggacttgacttctcttggaaatataactcagagtgtttgagagatttagaagttattcttctgttactttctagatattcacttttaattataagtaaaatatgtttcagatccaaacaatggtgacttcattcattcattcattcaaaaaatgagtgtattatgttttcactgtgtttccttcacagatattcttggcacatcagataacacagtgaaaaaaaaacagatgacaaatcgtcaccttctaaagcttatattctacagggggaataaaaaaacagaaacgtatacatacacgcatgcatatacacacacataaatttaatagcatgacagatggtaatactgctatggaaaaaataaagcaagaaaaaggaatagtgagtttaggatgaggtttggagggttaaaatttgaacagaaatttgaaggagatgagagtacagatatcatgctatctgtggggaagattgctccaggttctaggactagcaggtataaaaggaatttgctggggaagagcacggaggaccatgtgtccagaaagagaagttaagtaaccaggagtgaggggcagacttattgaggctgtgtgcaattaaaggggatgttgactttaagtgagagggagggccattagtggcatttgagcagagcaatgaaatattctacttaaaaaaaataataagctaactttagctgctatacacaaggaagcagaggtgccacttaggagattattgagtattttaggaagagatgagagtgtctcagacctgggtgatagtgatataggtgatgagaatcagacagattctggatatagtctgaagtttgagacatttggcttttgtattcaatatgaaatatgacagaaaggatgagttgaaggtatttgatttgagcaaggaagaagttgcatttattaagatacaaaagaatgcagaaaaagaaggcttgggggaaatgtcagaagttagctctagactcttgaagttttaaattcaaaataaatatccaagtgagtactactcaatctattgagtagatgattgcatatctaagtttgaatttcagagaagaggtgtatactataaatatatatgtggattttgtcagtgtggaattggtatttaaatccaggggtccaattaaaatcaccaagagagtaatgtagatagagaatgggagatgtttgaagactgagccttgggatatccaagactcatagtttgtagagatgagaaaaaccacaaaagaagactgagaaggaacagccagttaagtaagagtaaaatcagaagagtttaggctgtcctggaaggaggactgatgtttctgctaaagtgatgcaatgatattgcaaatgtaatatacttgaaagacaccaagaggagaggtattggaggcagtacatttttgcttaacaaaaaagcaagggaaaaggacagtagatagagagggatagtgtaaaaaaaaaaagctgtataatttttaaagagagggttattaatgggtacaaatttacaattagctagaactgtaaataagacccattcaatagctcagaagggtgactacagttaacatttatctattgtatatttcaaaataggtaggagagaataaatcaaatgttactagtataaataaaagataaatatttaaggcaatggatattctgattaacctgatttgacctttagagattatatacatgtatcaaattatcacttgtatcccaaaaatatgaacaactattatctatcaatttaaaaagttggctaaaatagcagtacttttgttggaatgaattcatagaaaaataaatgataatgtatgtgaatgaagaatttctggagaattaaatttctgcaagtaatgatggaatatagtatacaaatgggtgcattgccttgtatacaagtaaggatagtttatccagagtgataggagaggtctatgggctcattcacaggtcagtctgtgaatattgtgatgaaggctttgggatattttttctgattcttttattttcttaatgaagtaagaagctgagaatgagaaagtgtagaagcttaagaaggaaatgttaggcaatagtaatcaaggaaaagaaggagagtgaatgaaatagatgtcagtagtagaagggcagatggcaacagaggctcacatgggtttaagggtcatgaagaccatgcttcatattgttaatgtttttctagagccatatttgaccatgggtaggaggagtaatttaaccattgtatagagattctccaactgtatataaggcagcaacagagtagcaaacacaagtaaataaatgtaatgaccaattatgggggaggagcaaattaagagcatgaggaagagagagaaggcaaggggcagaatcagtacactgtaagttctaatgctgaagttagggtactaagagtgaactctcaccttctctatgataacatccatatttacataaaatctgtacacaaacattctgatacagtatagcatcttccattttccattgagaatgattctcatccatttgtgctattcccattttgcaaggaggaccttcttatgttgggaaattttaatgattataaatgctctgcatataatccctgctgacggaatctatgcttcattgatggatgaatgtactcaatcatgatgcggaagagggctacatggtaccttccaccaacagctactttttctattcctctctctctctctttaaatattttgcctttaaaaaatatatcttcttaccatttgacgcattcctgggaaggctgttcttatcagcagacattgctggaaataaagagagaaattgtagaaggaagaccagttattaaagaacaaaatgtcgatagccccaaagagaggtttaattttaaaaagcaaagctaaaaatagcaaaaatagaaaaaacacaaacaacaaaacctctaaaactctgaaatgcgtgaaagagtacttttcaaatgcaagcatgcatgctaacttcacatttccacccctacttatctctcccacacttgagcctcacagctcacatagccgcctttctcctgagtatgacagctcaactcccagaacagcctatcaggtcacaaaccataactgatcatttttgtgtgcttcttagattctgtttgcctggaagcagcttttcttttaacattatttttctcctacagatggaaatggaagagaggagaataaaaattcaagtctaagactgagaggttccataccagcgagcctggcaccaggttgagcatgtatcatagggaaaagttagagaccacacaagcctctgtggttatactatgctgcagagaagagggcaaattaaactggaggtccaccttacaagaattttgtgaacagctgaatgttataactgttatgaatacctgcatcacctaacttaaccacatgaaactcactcgtgaattccctactgtacacatgtcagcattctgaggttttagtgattttcttaaacaccagaatactaccaaggggtcactcaaaatgcagtgctgggaatgttgtaagaaacagttattccccttatttaaccaaattttctgtcacaagctgcataattccaagtttctggatcttatttaacccttggggaaaaaccagtccttgaattaaaattaaatataacattattcctgaagtattacaggattttttttttatttcttgaaagcggagtattcataattactacttttttttttttttttgagacagcgtcttgccctgttgcccaggctgaagttcagtggcacaatctcagctcactgcaagctccacctccctggttcaagtgattttcctgtgccagtcccctgagtagctgggattacagttacgcaccaccaagcccagttaattttttgatttttagtggagacagggtttcaccaagttggccaggcttgtttgaactcctgacctcaagtgatcctcccacctcagcctcccaaagtgctgggattacaggcgtgagccactatgcccggtctcataattactttgatctccctctcatataattaaagaaatcattctatcatcttttctatcacgttattctctttacacatttgtccgatttctttctgctcctctgtagtgacagttttaaaatcttcatttgttattgcgttattatatactgatcaaaacaccaaaatatactttgtgctaaacatttcattgtgcactatggatgattacaaaatcaagtaaaaacacagcttcagctctgaaggtatgatacagataaataccactgtgaaaattttgtgtgattaaagataagtgagattattgaagaaagtaggttttcctagagtcaggatttgaagtaggggttattcacagaaagaataaaaaaaaaatttcaaattgcaggagacagtatgcagaaaagctggatttgaccccgatgacttgtccccatcccttttatttcagcaatattttcctttcaactaaagcaccaatgcaaattataccagttttttctctctgtagattgtgtggcttgaggaactacggtgtaggaaccaatcagtgccaagcctccctccccaaattccgcctccagtctcccttccttcctttcttcctcattgtctacagagggtgcccagaaaagaatcttattgcctccttttccaatgatttacaggataaattccagatccttagcatggcccacacttttctctgtgttgtggccctgtttcactaacgttaccttgctcggctggcagtttcatttctccaaaatgacttttttccctgtccaccaggcaaactgcctaatatttcaagacgtaactctgataccaccttctatacaaagtcttcccttaggcaaaatgtctaatcttttctctacttctttaaaaccaaacaggtttctttcattttattgcatttctgtgtagctttcctctgagatttttgaagtcaggggctcttcactcagcattacatcaatacatcattaccgaccaatgactatatctcagacattgtaccaggcatttacgatgatggtgaccacaatcatacatagactcttgcttcatgaagtttatcgagtaacaaaaaaggtatccacaaataattacacaaataattaatcttaatatatcataaaggaaaattacacagcaatatgaaaacagatcaaggagagcaaatagattctggactgttggggtgggaggcaatattaggagtcacagtttttatgtatatatgcttttcttttgataaattagaatcatttataaaacttttaaagtttttctttcaattatcattgtatatttgaataatacaattaatcatccactttgagttgtattgaccttaaattgtgtattttgattctccactgtacagatgaaaaaattatattgtatttgcaatgtaattattgcttattatacttccccctactctgcctcaaaattttggttagttatattattatttcagcttttctagcagttatctttatatagcggtgaacttgtgactggcttttaagtccaaatccaaaataaattttggttgataatttgtgtctgttaatgagtaaaacaaagggaaaacattgaagatgaatgtcagaacttcactcattcatcaaagatataaatgacttaatcatagatcacattaattcaattggattaatttgattaattaattcaattatgattgcttgatcatagattaggttttaagttctgaaaaaagattttctcaattttttgtactattctatatgtaatgactgtaggcacaacacacttttaagtttcatctgtattattaacattttttccgttctctcttcagtttgacagtcaaaaaagcagtaagtcaaaccctgatttgcagcatttgtcaatttccatggtataaatattccctgtgtggcttatttaaagcttccagcctaccctcatggaatgcagagaagagcacagagagataatacatgttatttgaaagactcaatattatcacaatatctactcttcctaacttgatctacagattcaatgcaatccgaatcaaaatctgagtaagctattttatgaatgttgacaaagtgatcaccagcagcataccacaatgtaggatttcccccacacatttgcggtgtcaagagcatagatactagtaaagtgtagtaaaatccgttaacttatttacttgcaaatgtatatgcttaatattttcaataagctttattttattatcagagaagttttaggtttacagcaaaattaagcagaaaatatggagtttccatattccctcatcttcacacatactcagactcccctactatcaacatcccacaccagagtggcttgatttgttacaatcaataaacctacacagacacatcattatcaatccaactccacagtttacattagggttcacccttgctgttgtacatgcgtgggttttgacaaatgtataatgacatgtgtctactactgtagtatcacacagaatgttccactgccctaaaagtcctctgctctggttattcatcattccacttctccagattctgacaactattgatctttttactgtttccatggttttgccttttccagaatgtcatatagtctgaatcatacagtattgccttttcaaattggcttctttcatgtaataatatgcatttaagcttcctttgtgtcttttcaaggctcaatatctcatttcattttagcattgagtaatttgtcattgcaatgtaccacagtttatttatccacttacctactgaaggacatcttgattgcttccactggcaattatgaatgaagttactataaacatccttgcacagacttttgtgtgaacataagttttcacctcctttgggtaaataccaaacaacactattgctgtatcctatggcaagaggaagtacaggtttgtaacacactaccaaaaactatcttccaaagtggccataccattttgcattttcaccaacaataataagagctgtcattgcttcacattcttggcagcatttcgtgttgtcagtgttgcagattttggccattctaataggtgtgcagtagtatctaattgtcattttaatttgcatttctctgatgacatgagcattttttcttatgcttatctgccatctgtatatcttctttaatgaagtagctgttaagatacggaccatttttaattgagttgttttcttattattgtgttttaagagggcttttttcggtatagtttggatgacactcctctatcagatgtcttttgcgtaccttttcctctagtctttgacttgtctttttattctcttgacatgctccttcacagagcagaaaatttaattttaatgaagtctagcttgccattttttccctaaagtgtgccttagatgttgtatctaaaaagccattctgacaccataggtcgtctagattttctcccttgtcatttctaggagttttatagtttagcattttacatttaggtctataattcattttgagttcattgttgtgaggggttcaaggtgtatgtctagattatttatttagttagttagttattttgcttgtggatatccagttgttccagcctcctttgttgaagaaaactatcttttcttcattttagttccttcgtcaagatcacttggctatatttacacagatgtattcctgggttctttgttctgttcagctaatctatttgtctaatcttttgccaacaccacactgtcttattactttagttttatagtaagtttaaacttggatagtgtcagtcctccaactttagtcttctttaatattcttggctattttgggtatgttgcccctttacataatctttaaagatcactttgtcaacattcacaaaatagcttgctcagattttaattgggattgcactgaatctgtagatcaaagtaggaagagtagatattgtgataatattgagtctttcaaacaatacatatcagctgttcatttcgttctttgatttctctcatcagagttttatagttttcctgttatagctcttgtgcatattttgttagtttatttctaggtatatcattttcggggggcgctgatataaatagtattgtgctttgaatttcaaatcttacttatttattgctggtatatggtaaagtgattgactcttgtactttgaccttgtatcttgcaaccttactacaatttcttattaactcagatagtttttttgttgttgttgttgattctttcagattttctacatagacaatgatgtcatctgtgaacaagcacacagttttatttcttcctctccaatatgtataccttttcttttattttcttgtcttattgcattagctaggactttcagtacagtattgaaaagcagtggtgagaggggacatccttaccttgttcctgatcttagcaggagaacttcaggtttctaactattaaatacattagccgtagattttttgtgaatatattttatcaagtaggaagctcccctttattactactttattgagcattttgttatgctttgttttttaatcatgagtgggtactggattttgtcaaatgctttttctttatctcttgatatgatcatgtgatttctcttccttaacccattgatatgatggattacattaattgatttttaaatgttgtaccagtcttgcatatctttaataaatcacagttgttcatagtatacagttctttctatacattgctggattggatatgctaatattttgttgaggatttttacatctatattcatgagagataatgatctgtagttttcttttcttataatgtctttgtctggttttggtattcctcaaagtatgagttaggacatattctctctgcttctaccttctagataagattctagagaattgatataaatttcttctttaattacgtggtaaaatttaccaataagttgatctgggcctgctgtttcctgatttagaaggttattaattattgattcagtttctttaatagatacaggcctattcagattgtcaatttattctcatgtgagtttttcaaagaattggcccatttcatctaggtcatcaaaatagtggatttagaatttttcacagaattcatttgttattcctttaatgtccacagaatctgtagtgatggcacctctttcatttctgctagtagtagttgatgccttctctctccttttttgtcagttatcctggcaagaggcttatcaatgttactgatctttttgaagaacctgttttcagttttgttgattttctccatcaatttcctgtttccaattttattactttgtgctctaattttcattacttttttttctttgcctactttggaattaatttactcttctttctttagctttttaaaaaactaaggcagaagtttatatggctgattttagatctttttttctaatatatgcatttagtgttacaatttccctctaagcactcctttcactgcatcccacacattttgataagtttggttttcattttaatttagtgcaaaagatttttaaatttttcttgtaatttattttttctaaataacacatatcttctttagaagtgtgttatgtgatccccaaatattttgaaaatttccaactatctttcttttattgatttctcacttaattctattttggtctgagagcagacactgtatgatttgtattcttttaaatttgtatgtgttattacccagaacgtgatctatcttgttgaatattttatgtgagtctgagagcaatgtgccttttgtggctgttggatgaagtagtttataggtgtcgactgtacctagatgatctagtgtttttgagttcagctatggccttactgattttctgcctgctggatctgttaatttatggatgaagggtatcgaagttgccaactataacagtgggacttaatctaattctctgggcagttctatcaatttttgctttaagtatttttacattctggccggcaccgtggctcatgcctgtaatcccagcactttgggaggccaaggtgggtggatcacgaggtcaggagttcaagaccagcctgaccaacatggtgaatgaaacactgtctgtactgaaaatacaaaaaatagctaggcttggtggtgcatgcctgtaatcccagctactctggagactgaggcaggagaatctcttgaacccgggaggcgaaggttgcagtgagctgagattgtgccactgcactccagcctgggccacagagtgagactccatctcaaaaaaaataaaaaactaaaaaatttttaaaaagtatatttacattctgttgttagaaaacagacatatatattaagaattgttatgacttttggcagggaggattgacccctttatcattatgtaatgctccactttcctgacaaattttcttgctgtgaaatctgctctgtctgaaattaatacagctacttccactttcttttgattcatgttagcatgatctatgtttctctatccatttatttttaatccatatttgtctttacatttaaagtgaatttcatgtacaacacatattgttaggttttggttttttattcagtctgacaatctctgtcttttaattggggaatttagaccattgacatttaaggtaaatatcgatgtagttcaattaatatctataatacttgggtttggttttgattttttgcccttgttctttgttcctgttttcatctttcacacatttgctgctttttgtggttctgaggattttatatgactctatcctctctcttttcttagtgtctcaattatacttctttgtttttacttcttaagtggttgccctagggtttgcaataaatatttgcaactaattcaaatctgctttcaaataactgtcacaggtagtgcaaatactttataataacaaaatattttgaatccctcctccatatacatagagtacattattattattatcatgaacaacctgttgtctgttagataaattaagaataagaaaaataaaagtttttgttgtgtcttcccttaatcattctttagcgctctccctttatgtagatctagtttctgacctatatcatttttgtttcctctgaataacttcatttaacattttttttgcaagtcagatctactggcaacaaatttcctctatctttatttgtctgagaaagtccttatttttccttcacttttgaaggatagttttgcagagtgcagaattccaggttggctgattttttttttctcccaacaccttgaatatttaactctactctcttcttgcttgcatggtctctgaggagatgtcagacgtaattttataagtgaagtgtttttccctccctctggcttatttcaaaattttttctttatctgatttaatgaggtttgaatatgatgtgcctaagcatagtttttaaattttcattttttggcatttatcctgcttggtttcctttgagcttcctatttctgtagtttgatgtctgcaatagtgactgagaatttttccaaattaatgtgtggtttggaagtttctgttatcacgtcctcacactcagagattctctcttcaaccacattcagtctactaattaaatgtcagtcaccaaagccattcttcatttctgttaacagcgtttttattccttagcatttcttttttgttctttcttagaatagccatctctcagctgacattgtttattcgctctgacatgtcttttttttcctattaaagccttctagcatattaattatactttaaaaaaattccttttctgataattccaacgtccctaccatatctgactctggttctgatgctaattcgatcgatctcgccaactgtggttttttgtttgttgcctttattaatgcagcgataagtcatgaggatgattttctgataatttcaacatccctaccatatctgactctggttctgatgctaattcagtctccaactatggtttttgtttttttgcctttattaatatagtgatacgttgtgggggagcggggaagcattctatgattaggtctcagtcttttggtgagcttgtgcctctgggctatggacttcacaagtttccgccaacccctttacgtggcacagggtgactggaggagaccacagctgtgcatttcccctcccctaggtaagtgaggctctgatacaacctcagaagattcagctctggtaaaatagtttctcctctgggtaggccttgttaagaagaacggaaggctgtgatgtatttcaaaatggtaacatttcctttctccctactagaagcaaaagggactcttttccaatatttactgtgagaagctggcagactcctggagaggaaacttgtagaagtgtgaggaccccctatgactgagtgccctggagttttcatctttcaagcttgtccacactcaacctccagaagttcgttaattacagtttagggtttcctaccctggtactggctcataatgagttttctgctcatggatttctgtttggttattaagttgtaattttccgtgtccacctgtctatctctccaatgttgccctgtggtttgctctatgagtacccttctctgatagattcaagaagagttgtaatttttcattttgctcagatttttacttattgttaggccagactgaagatacctaatctccttacatgccagatcagaaatcaggagtttatactttatttttcagttatggctttatttaacaactggtttgcaaatttcctgaaaatttaacagttgcctcttgtgagtttggggtgggaaagagaaggggctccaacacaccactacctttataccattacatcacatatttaaacatctattattgatagatttgttttaaaataatgtcagttaccaactgtctattaaatatgaaaaaaaatcatttcttctttcttcttcccccatccacacttaagcttttcatttcactgctacattttattatttaagtccaaatgacaggacttttttttaagacatggtcttgctctattgtcaagtctagagtgcagtagcacagtcatgctcactgctgtcctgaaccccaggctcaagtgatttccccacctcagcctcccagttatctggggctagaggtgtgcaccaccacactcagctaatttttgtatcttattttgcagatatggggttttgccatgttacccaggctggtcgtgagctcctgggctcaagcagtaccctgcctcagcctcctaaaatgctgggattgctggtgtgagcacattattgaataatatcagaaatactaaccaaaataattagaaaaagtaaataaataaataaataccttagaggaaaaaatcaacaacaacctttcaagtgaaggagtgggacagatctttctaagaaggaaacagaaatcagacattataaagcaaagattgaccaatagaactaaagaagaacttgataaatttgactacatgtaaacactaattcatatgagaggaaaaggggtagtagtgcccttaatacatgcttataacttaatgtttagattataacgatttaaaaaaagaataaatatatataaagggttatctaggtgacttaagcaagctgaacgggttggagttcatgcctcatccccactaaaattctattaaaaaaaaaaaaaaacgctttttaaaagatggctttcataaaaaggaatgagttcatgtcctttgcagggacatggatgaagctggaaaccatcattctcagcaaactaacacaggagcagaaaaccaaacaccacatgctctcactcataagtgggagttggacaatgagaacacatggacacagggaagggaacattacacaccggggcctgtcgtggggtggggggcaaggggagagatagcattaggagaaatacctaatgtagatgacgggttgatgggtgcagcaaaccatcatggcatgtgtatacctatgtaacaaacctgcacgttctgcacatgtaccccagaacttaaaatataataaataaataaataaaaagatggctttaatattacagaaaaatcacgaaggtagtttttcattttatttttaattttgtattgatgtgaaagtcacaaaatataacattaaccattttaaaatgaacaattctggggcaattagtgcacgtatcatgttgtgcaataaccaaaactgtctagtcctaaacatttcatcactccccccaaaatttctagacccagcaagcagttactccccactcccagctccttcagttcccagcaactgtcagtctgtcttcctctctctgaatttacctattctgaatattttatataaatggaatcacacaatatgtggctttttatatctggcttcttgtacttagcataatgtttttgaggttcatccacccactcttcttaatggcttttcaagttctcacactgacaatgtggaaaatgtattattttcctgctttattcatagcctttctttgcttttcactctctgttggtaatgaccagaatcatacctagtcctaagtggggctgaaatttttcccttcgaaggctttttctttcagttccctagttgtattaaaaaagtaaacgtagatatgtagagtaggtactgatatcagtaaggatatgatgctataatttaccatggattaaaatgattcagaaaaattacccagggttaagtatgaattattaacatttagtgaaatacagcttggggccaccagtgcactgttccaggagggctgttcacatggaggcccacagtcatagaaggtgacccaggtgcgtgtaactgcaccagtccattcccctcatgattacaactattttactttattcaactaaattttatacctatccacttcaaattcattcccagaaattgtactcaccatttgccacttttattctcagaaggtaagaagtttaaaagccacaaaacgtatgcctaaaagatgaaagaatggagtcacagtatgagtgctaaattgaagaaatatcagaaggaagaaatgaaatcacaagtaaagtgattgaaacttggaaacttattggtgttttatgaggagacacaattgctcccacagtgctatactgaagaaagtgccagcctccaaatgaaaagctgatataagagtggtgtgaaaccagtgttaagtattttgcctggaagaaattgcttagaatgagagcagtccctaaactccttagtatcatttagtatgtttacttataactattactcatcatttggcccgctgggtctccttttgtactggaacagccctgccaagggactccctgtcgtggactaattctggagagtggaacaccgctgggcagggggtctctgtgctgtgaaatctgaagctaagaggatggatggcatttagttgagtgcattcctccacggatgctcatttaatttttaaaaatgtctctgaactgctgggacggttcttcctggattttttgtagttctcttcagttacacacataactccttagagatgcattttgctagtgaggtctttcaatatgtcaggctcttttcatttaagcttagacattttagatgttggaccattgtagctgaatatttctcttcccttgccttcatgtaaaatgaccctagtgtaaagtataaacctggtttgtttgcaaggaaaatgcactcttcagtttcatgtttctgggtgaaggagtctgtcaaagtgctgcctgtcattactgataactgcagtaggtcagtttgctttactgtaacattaatttatcatgtgacttgtatcatgtaagtgtaagaatacagccaataaaagccataaaaataagtcaactgctaagagatatttcaatttttttagaaattcgctgggtgacttgtcattgatacattttattaaattacatatccaaacagagtatactgtgaagatcaggcgagaaatttgtcttctaacggcttttttcataatttccattaatccatattgtatttggtttcttactggaggctattttaagtagtcttttatcagaatcagagattttatactaatcctaccttttagttatgagcatttagaatattcgttaacaggagttgtaagttctcccaactaaacagacgtggtatattcagtttaacacagagcacatatcagaaaacttcattctagttataaggccgaacttcccttaaacctcaatatcatttgatcctcaaactaaaatcttttgagactaccagctatgctatgctttcattacggtgcggaaggaaccctgttagagacacagtatacctaagttttgggtccagctctctctaactgcctgcatgaatataagcttgttattgaacctgtttccttaactgagggaaaaaggatttgaagtagaacagtagttcttaaccaggagaccatcaaatcactttggttggttttttttttttttttttttttccgaaatatacttgtccatatctctctggcatccttcaaccccattctgatgtaatgaagctggggtggttaatttccagttaagtttgtcttggagagatgacatctctcgtcggatccacctctacaagatatgactctgaaatcacaagagctggggttgcagaatttgcagcagcaattgtatcaatggcatcaatattcttataaaaagtgtttatatctagttctagcaatgaaagtcttgaacagactttctgattaaaatcagaaaaaaatacaactttctgattaaaataaatgggttagctgtttcccaatctgttatgacaacaaacctatttctggaccaaaaatcttgatgtgtaatgtaatgtaagatatggtcccacatatgtttcagtaagaataaagaatatttaaaagtatagtggtcctcactagacttcttctcggtgggaaaattgtacagaatgcgagttctgtaacctctgcttcctttagtaaccccacctgagagccagaagaccaacagttcagaccagaaaaagtaatagaagcagaacttccggaggcttgcagatggagtgttaattggtgatctgaaaaaaagtgcttcatctctcttgtcgttaatgtttgggtctgcaggaaaggctgacttcatgaacatgtggcctgtgtagccacagagggccccaagttcagaaaggcctcgtgctgttgtaatgctctgctgtgatggtcttgaaatccttaatgtttttaaacaagggtcctgcattttcattttgtactgggctttgcaaattaggtagttagtcctgcttgtagcaatgaaactaacaccccctgccccggtaaaaccaagcagttcctatcatttttctgcttctttacttttgcctttaaggatcacttgttatttacattgttcaagcaatggtaagaagtgtcactttccctggctgcctcccacacttgaggcgcatagcaagcctgtcctcttcagttctgatgacctgcccattctaaccactgcgcctgtttcctgaacccttctccatacaccaaccacattaccaacctccccttcccatcgagagaagacgatttgcttcttaattcccagatcactctaattagaacactgcaaaaactgacaactaaagcaagtggccacctactagttctcacacactggactctctaacagtaatgaatttctgtgattatttccttgctactaataaaatactagctggaaaagtggtcaagtgaggagccaccagaattttatttcttcttcaagcatttaatagccaactatagggccctgggcatttactgaaaggcaatttcagttatgttagtaaattgctgtttaggacaacagatcaataaaataaattattaggtctataatttaggtatttacagagtaaggacaaaaaatactttttcactctgtgtattcaaagcagttgatccatgatttttggatacataatagctgtatgtatttatgagatacacgtgatattttgttacatgcatagagggtataatgatcaagtcagagtatttagggtgtctgtcatctggagtatacatcatttctatgtgttgggaacatttcaagttctctcttcttgctgttttgaaatatacatttttgttaactgtagtcaccctactgtgctactgaatattagcatttattccttctacctaaatgtatgtttgcactctttacccaacttctcttcgtctcgctcccccatgcacacacccttcccagcctctggtaaccattattctactctctacctccatgaggtcgatttttcagctcccacatatgagtgagaacatgcaatatttgtctttccatgcctggcatatttcttttaagataataactccagttccatccatgttgctgtaaatgacataatttcattcttttttattgccaaatattaggttggcacagcagtaattgcggtttttgcaatgataatagtattccattgtgtacatacacaacttttttgctgtttttctcaatgactctagagaaacatttattcgctaatacattttctttgtgttctctaacttaatgtcatcttttcatctcgcttgattttcatgcagctaaatcggaaatttgtcgttttctccctaaaaaaatacaataaagttctttcttataaattatattctctgattttcttgtcagcctgcttcaagaaaatccatgtgtgcaaaatacttgctatcagtttgccccataccaaatggctgtttaatccaaatatctgaccagcaaaccaagcaattccttctgaagaaagggtggttggacagccaaagccactgggtagtggaagagaagaccacccatcctgagctccccagtctagtgtgaggggaggacagctgatagctggagatgcagcatttccagatgtcactggtcccaaaccattatcagagtaacactggcctcatagaatgagttagggataattccctcttcttcagtctttggacggtattttcgaggagagctcttgtccgttctttgaaagtttgttagaattcaacattgaaaccattcagttttggactttgctctgttgggagactttttttactgattcaatctcactgctcattattggttcgttcaggctttttatttcttgctgattcaatcttgataggttgtgtccagaattttagacatgttctctaggtttttggtttgttagtgtatagtttttcataatggtctttaattatgtttttatttttgtagtgtcagttgtaatgtctcttttctatttctcatttttttatttgggtcttctttatttcttggcttgtctagctaacagtttattgatttcatcttttaaaaaaccaacttttcattttgttgatcctttgtatttttttaagtctctgtttcgtttagttctactctaatttttattatgtatttccttctattaattggggctttggattgttcttgtttctctagtttcttgaggtgcattagattgtttattgaaatctttctacttttttttgacataggtgtttatggctataaattttccccttagttttgcttccatagttttggtatactacgttttgacttgcatttgtttcaagatatttcttgatttcttccttaatttcttccttgaatcaatgatcattcaagagcatgttggttaattttcatgtatttctgcagtttttaaagtgtcccttgttactgatttctagttttattccattgtgatctgagaagatacttgatataattttgatttttaaaagtttcttcagacttgttctgtttcctaacatatggtctatcctgggaaatgttccatgtactgatgggaagaaggtgcattctgtagctgctgaatgaagtgttctctagatgtctgttaggtccatttggtcaagtgtgcagtttaaatccttttaatttttttgataattatctgtctagatgatttgtctcatgctgagtgtaaggtgttgaagttcccaactattatcgtattggagtctatctctccctttaaatctaataatatttactttctatatccaggtgttccagtgttaggtgcatatgtgtttagaatttttatatccacttgctgagttgatcctttttcatcatataatgatctttcttgcttctgtttactgtttttgacttaaagtctgtgttttctcatacaagtttagctattccgtttgtttgtgatttccatttacatggaatctcttttttcacctctgctttcagtctgtgtctttataggtgagataaatttcttgtgggtggaagagagttggctcattttttttttgtcttttcagccagtccatatcttttaagtggaaggtttaacctatttacattcaaagttattgttaatatataaaagcttattcctgtcatcttgttaattggtttctagttattttgtaatgtcttttgattctctttctctcctattgtttattatagaaaaccttctgtagtggtaacatttgaggttttttttttttttttccttatttgtgtgtttgctctaccagtgggttttatcctttcatgtggtttttatgatggtagatatcatcctatcacttccaggtataggactccctttagcatttcttataggaccaggctaatggtaatgaattccttccactttcacttgtctgggagtttatttctccttcatttatgaatgacaacttttctgggtatgtaatccttgggtggcattttttttttctttcagcactttcaatatatcatctcattcttcctggcttgaaaggtttctgctgagagattcactgttagtctgataggggttcccttataagtgactagatgcttttctcttgctggttttagaattctctctttgtctttgacttttgacagtttgactataatgtgctgtggagaaggcctttaggaattgtatttgtatgggaacttctaagcttcctgtatctggatgtctaaacctcttcctagactttgaaagttttcagctattattttgttaaataggttttctatcccttttgttttctcttcaccttctacagcacccagaattcaaacatttgatcacctgattgtgttccatatgccacaaggctttgttcattctttttaattttttaaaattatttttgtctggctgggttatttcaaaagaccgctcttaaagttcggaaattctttcttctctttcatctaatatattgttgaagctttcaaatgtattttttatttcatttaaggaattattcagtttcacaatttctgtttggtccttttctgtgatatctatctctttggtaaatttctcattcatattctgaattttttttctgatttctttgtattctcttgcatttcactgagtttccttaatatcaatattttgaattcttttttcaaggatttcataaacttacttttgattagaatatattgccagaaaattcttgtgtttctttgaaagtatccttgtttttccatgtttcttttgtccttacattgacatctatgtatctggtgtaaacatttcttcttccgggtttttgaatttgctttcctaaggaaggactctgttaaagatgaatctgtggtttaggttgggtaggacactttggctttgattctggatgcttgcagtagtgtaatcactgtgtgatttatttggctgtaaatagtatcagtggtgtcagtgatttcctcagtgactgcagtgtctgtgatttcctcagtgatttatgatacagtggaggctgtgatgaagattttctggggacagggacaacaggtgggcctgtcctcaaaccccactggtggccagtcacaggccaaacatgcctttccttgggccccagggcaacatatgctaatatacctgtgttagcaggctcaggcaggccattcttgggcctctaggtggcttgcccaggtgctggtagtggcaatggtgggccaggtgggtgggtaggttatcagacctctgggcagcagcatggaatgggtgatggcagtagcaatagtgagacaatcatctagctctgaagtgatttgcattgtttgttggcattggctacaatgggctgggaaggccagtctccagtcccacctgtggtatgtgtacgtgggtacccagtatggtgattgcattgttgtgggcattggctagaatgagctgggcaggcgtgaactcaggaccacagaaggagtaccctggtgctgatggtggtcaacttgggtaggtggtttccaggcccttggatgtcatgtctggacatagagtgggggagagagccaggactggtggacctgtcctcagacctcccagtggtatgagcaggtgccagttgtggtagacaggggtggagtgatccacatgtccccaaagaaatgtttgagagaaggcagcagctgcaaccctgctactggggaaggcaaggttgctttcagtggcagcagctgtatacatgtgtttagggaacacacattttcttcaagcttgaccctgggaacagcagtcacttgcagtgacagcagctgtgggcaggagagtttgttcatggggcacatgaaaatgcatggcagctttgttcctggggatattggggtcacagtcaatggcttgcacttgaatattggctgcaactagctgccagccatgacatgcattggctgcaggtgaggaatgtcaataggacaccagggatgtggtgatgcaggtaccgttggacctcccaggcaggatggtaggggctaggctttcaatatggtgacttgctgtagctgcctagggcttgggggcagagggtgtgactcagcttgagctctctctggagcaatgccttcacttggtctccttgcagcttcctatgttagtcttggggcccactaggtcctagggactctcctgtgtctaggattgcatgagttcatggtgggaacctggactgttgggggtcactcacttacccttttcctccactggggagccagcctctccaggttctcagccaatgctagccaagcaggcagcctcacttccccttccttttttgttttggttgtgtcctgtcacttatctgttgaattctaatgttctttcataaatgatctattcaaagtgtgatcatctattcactgtttttgttcttctctgtgtaagagacacgtagcagatgcctctagtcagccaccttgcaacccctctgccatgcagttaatacatgattttttctacttttggatggaattagataaggcccaagctaagaactccatacagcccattttgtaatatgatccagacacagagatgcactgttcagatcctcgttcaaaaaacgacccaccgcatagctgagagggatgtggtcagctgatgcctccagctgttagatccttcaggatctgtctcagttttcaaaccaaggttacgctcttctctcagtgatctccaggcaatggccgagcagaatgatggtacaagggccaggtcatcaacatcccctacaggacttctccatcaggttatctttactccagaactcccctttgagctggtaaagaattttagatctgcactgagatctgtcagcttcctatgcccaatcccgcatcttacttttttctttaattggttttacttccaataaaactcttgcaatcctaactccatctcagcatctgtttcccagacaacccaacttgcacaatgtccttacagtaatgcaaaaatgaatttcacagagctctttttgtaaagatgctgatacatgaagtctcaaatttcatggacgtgacataaggaaggcaacagcttgggaagaaaatatgagaaatagcacttagattgggtttattctagaagaaaggacacctcatctaactttctagtagtcctctataaacactgttcctctggactgggcgtttgatacataccgagcagccttgttttcaaggttagagtccctagaaaatagatgatgttcagagacaaacctgtctaggtactgagaactctttctacttgatgtctgattgccatctccaacagattatattttgggatgaattattcatctttagcacataagtaatctttcttattttcttattatctttacaaatcagtgtaatgcccagaaagcccagtgtacaatcaaaattttagttgcttatttttttcttttgctcctttatgtccaactagttactaaattatgtttatgtgtctttgaaatcttttgccttttgcttgtcataagatgcccaaaagatctgtcttttggccaaactccatggcagagataggctacagttgtacaccagtttgtacagtgtacaaaattgtacaccaactttgttttctttttctcctgtgcaagataaccagctggcatcctacaaaacacacatgaattttaaatagaatttgtgaggaggtattgtttctgcatgttggagttcctgtaaattacatttacaactctttattggtatcataatgttgatggagaaatagatctcctaggaatatgtgcactgaccattcaactatccccatagctaacattttggatgcattttaagcttcttagcttagcacataaatcccatcataatttatcctctgtttcccaccatcaccactcctgaaacacagcctcacagactatttactctagctataaccagttataatgcttcatgcttcatatatgctatttatcttttcaagaatcctttcttttttgccttctgcttaaagacaacttctacaagccttcaaacctcagcttaagcattacttcctatgtaaactcttttgtgatctcctaatttgactctttttccctaatgcatttatttccattggatctcttttatacttttatcataacattgactataccgttccctaaatgttgctcttttagaactataatcctatattatttgacttcatatataaatgtgctctaaaaatgttgaatgaatatggtgagttttccactttgatatcttcatgctgtcttttaccccagggcctcaaattagccatcagaacagatggcttataagaactggtatgctaaaaagtaggtttaactgtggttgtggacatgcttctttctcaggggttccatttctgaagtggaaattaatttgatgcttctctagagtgatgttcagattaatgttatgccatttgtaaaggcctctaggactctcagatgaagggcatttgatattagcctcattgttactcgaagctgttgtagggttcatctatttgctactcagcaagacatttgacattctcgtaatacagcacatcccaggattaattaagagatttccggaagtctcaggaatacacctactttgacatcaatgtgctgtgaatgttgatcttggtagccttactttgaatagctatagggtatttaaatagtaacctaacttacaattaagactgcttagtccctgtaaggattctgagtggaatttagcaatggataatgaatatattctccggagtcttatactgaatttgaaaagaaacccaaattcctgagctttagtcacttaactacaacatctttctacataaagaccataagctaagaccatagaagagagagctcatgcatacatgagtacagatggttaccaaagtaaggatctaaaattggactctgctgtactcacatcgaagctcccaatgtacgaagggatgaccttccttcaatggctttatgcaagggtcaaaatgtatttgaactctggagcagaaaagcactgctctataggatttccaagtgttcattatttaggaggtcaggaacgatgggagcatgtggcaatccagacagctgcagtccccacagacctaaaagaaaacagctgccagagcagccatttctatacaaaatgtctcatgaccagaagctatggaaataaacggctagaggcagctgtgcttccctcttgctaaacactcaaagattccatttttaacacaggatgtctattattaagacaatcagctaagatgtcaattcaaaagccacaaagttctgcaacataaatactgtactgacttctctcttctgttgtgtgggaccatggcttctttccctgtatgctggggacactacttcagaataatcaagtgaaaatactgcttttttatggtaactctccattcaagaacttattataatagtgttataaaaagactgtaatcttatcataggctgtatttgaaaattaagatcctccacaatctggctctatcctctttctcaaatcaatttctcattactctcaatacaaatgctatccttcaggtaggtaagactcttcattcttgctccacgtttcttactcacgttccttcaggcaaaaatgccctgtcagacacatgaaaaaaatgctcatcatcgctggccatcagagaaatgcaaatcaaaaccacaatgagataccatctcacaccagttagaatggcggtcattaaaaagtcaggaaacaacaggtgctggagaggatgtggagaaataggaacacttttacactgttggtgggactgtaaactggttcaaccattgtggaagacagtgtggcaattcctcaaggaggtagaactagaaataccatttgacccagccatcccatgactggacatataccgaaaggattataaatcatactgctgtaaagacacatgcacatgtatgtttattgcggcactattcacaatagcaaagacttggaaccaatccaaatgcccatcaatgatagactggattaagcaaacgtggcacatatacaccgtggaataccacgcagccataaaaaggatgagttcatgtcctttgtagaacatggatgaagctggaaaccatcattctgagcaaactatcgcaaggacaaaaaaccaaacaccgcatgttctcactcataggtgggaattgaacaataagaacacttggacacaggaaggggaacatcacacaccggggcctgtcatggggtggtgggaggagggagggatagcattaggagatatacctaatgtaaatgaccagttaacgggtgcagcacaccaacatggcacatgtatacatatgtaaccaacctgcacgttgtgcacatgtaccctaaaacttaaagtataataataaaaaaatttttaaaaatcccctgtcagtcctctctgcccacccttttgacatttgatggtaaagcccaatctttcctctgcccacattagtcagtgatttctttaaatttcatttataacgatccctaaacctcataattccgcaaccaattacatgctagtacacgtgattctctaatctgtgtattttaatctcatctcctaagaacacggtggcaagatctgtgttatttactttgaggctgcatcccatttttttcttttgtgtttttttaattgaagtgaaatttgcatgtaataaaattcacccttttcagtgtacatttctatgagttctaagaaatgcatgcagttgtataatcaccactacaattaagggatagaacagttcgaacaccctaaatattttccttgtgactttgtagtcaaacctctcccacctgcagccactgataacctgatccatttcctgcctctatagttttccatctatgaaaccatgcagtatataggcctgtgtgtctagatccttttacttagcataatgcatttgtgatcattcatgttttatgtatcagtagtacattcctttgtattttgggtaataattcattgtatggatacacctagcatgtttatacatttaccggttggagaacgtttgggtaatttccaatgtgggaccataaagccactataaacattctcacacagatttttgtttgaacatacgttttcatttcacttggaaaaatgcctgggagtgggattgctggattgtatggtaagtgaatgtttaaattgatgagaaactgctaaactgttttctatggtggtgtagcgttttgtttttagaccagcaatgaatgacagatccagttgctcagcatcttagtcattctaataggtgtatagtggtatcacataatggttttaattagcatttccctaatgactaatgatattgagcatcttttaagtgctcctttatgttctatattttttggttatttcatagtactagcaaagtactaacaatgtattagatgcttaacgaatatttgcagattgttaaattgcagatcattaatactactctcttttgcatgccatttgcatcccattactagctgttaccatttattgagtacctactgtatgccaagcgctgtagtaagtgctttatatatggcatcttattaatacacataagaaccctatgaatgtgctgggtggtattgttcccatttgataaggaaaagggacaaacagtgctgacttgtgactctccaaatccttctctttccccaggaattttgggtttgcttgttcaggttctggaaggtttttatactactgctaaggatgagtgaagaggtaaatttaaataatccaaaacaggctgaaatgatccacatgataaagagataatttagaggttagtggggccatgaggaagaaagggaaaagtacttgggagaggcaagggaagtatagttgtggaggtagaagagagagaaagaggttctttgtttgtgtgtttgtttttgtttcagtttttgttcaaaaaaaaaagacaagagggagcaagaattgtgaagaagactgaggggttagagggatgaagagagtgtttagtatgctaattatgaaatattctctttttggagtttttttgagtgaataagattaaaacaaggtttttagggaaaaggaattggatttttttatattgatactagtataagccatagagcttattaatatttcaacagttatacacacccttacttgtgcacgtgtgtgtgtactcatgtgtatgtatatgtagttttatgcagtttattaaatgtgtagatatgtgtaaccactaatcaagatatttaactgtaccattaccagaagacttcattcttcattgtgctacttatttacagcggaatctacaccctcatcccttacccctggaaaccattaattgttttctccatatctataatgatgttatttcacaaatgctatatttataaaagtatgaagtatgtattcttttaagatttttttcacccagcaaatttttttgaggttcacgcaagatgttgtgtgtatcaagttcttcctttttcttcctgagtagtattccctgatatgcatataccacagtttgattaattgttcacacattaaagaagatttgagtagtttatgttttggactattaataaaactgctataaaccttggtttatcaatttctgcatgaaattaagtcttcctttatctaggacaaatgtccacatgtataattcctggatcacatagtaagtccatttttatttttattttaaaagaaactatcaaactattttacagagtgactgtactattttagattcccatcaggaatgtatgagtgattccgcttatccacatccttgccagcatttgatgttatcactatttttatcctagtcattctgataggtgtgtagtaatattttgttgtggtttccattttaatttctctgatgactaatgatgccaagagagttgtcatgggctaatctgccatctgtatagtctctttgtatacacgtcttttgtccattttctaatttcatgtcttttgcccattttctaattttatggggtttttttagtattgaaattgagaattatttatatgttctagatactagtactgtgtgagatagatgatttgcaaatattttctcccagtctgcaatttgtcttttcacccttaacaggctcttttacagaatactttttttttattttgatgaggtccaatttatcaacttttcttttaatcatctatgatttttggtgttaagtctaagaactctttccttgtcctgtatcttgaagattttctcctatttctttttctagacattttatagttttgtaagctgcgcacttacatctatggtccatttttagttgatttttgtataaggtgcaaggtttagatcaaggttcatttttatttagctagttagctatttgcctataaatcattgcatcgtcatttattgaagacttttcttcctccatcagattgcttttgctctatttaagaaaactaattgggtataattaggtttttatttctgtgagatgcaacttgtaccaacactggtcacaagagagccagttcttactctggttaaatatggatcaggaaactgaaactcagtttaagtaacataatatagcatgtatccacctactacttggctgtcctttttacaaagtttgtaaatgccatgttgaagttaccttgttttctggggtaatacccaaggtttgttgtcttatgtcacagatatcgaggatgcagacacacagagtgaggttaacagtgaacgtttaataagcgaaagaaagataataggtctctgctacagagaacggttctggaaaaatgggttgccagtccacagtgaaatgccaggggctttataggtgagctggtggtgaggcagagtctgatctacatagggcacaaaaaaactggttaggactaagtgtgccattggcatagggcgcaaatttctggcagctcccaccctaagcttttattatgcaggcgagttctctgcctgagctgagccatgttgccaatttctttctttctgtacatgtgctaaccaaaaagggaagatggagcttccatggtggacatgcctggcccccaggtagcccttttctattgacgcagctaccggcatcccccgtgcaagcttccagcttccttatctatgtttgcagctcgatttttcaggctgctgtttgtcaggaaaagaataatttcttgggctgctttttgttagaagggaagttctgccgaggactctgttgccctcactatctgccgaaataatttctttctacattctgtatcagtattgctaggatcatgagttggacagtgtgttacacaattttttagatatcaaagtagtatttatatgctttattaccacagcaaaactaacccggtgctcagcttgaggtgaactttacattgatacctttcccttctctaataaagcaagtagattgggagctacatgcttggcaaatacataacaatcttcttggtatgtttccaaaatattttgacaacaatatcagtggaattcttggagcttatcaccaaaatctgggtgaagtaggcctttctatttctaaagaaaaaaaaaggagagtcaatcacctttcctttaggtcctatggctggtatttaaaaggctgagtaactatgatttaaatgaaatgtcgtatttttaaaacactgaaagctgcagtgactacaggcctggggaggttcactctgatttgctgcccatcagatctgcagaaggcacacactaattcccgaggcgcagcattgtaagacttaacacggccaacactaataattaggcctggttgaaaagtggcagagaaatgctcaatttaccagcagtatcctcacctaatttcatatatattttctaatttgactttgagttaggcagtatcccatttcatggaaatgggaaccagattcagaggagggaaatagcagagtaaaatggcagatctgtatctgactccatagctaatgctccaccttggggttttatttcttccaatttagaatttacggtgagttatagaacttacactgcaacttaagttaatatcaaatcacagaatatttatcctggaagtaactccagggtctcactggagagtcttaatgttaaaatatactttcatactattgatgaaaaaaattttgaggagaatttaaaaaagcaaacagccagacatgggcagggcggggcacatgcttatagttttagctgctcaagaggcggaggtgggaggggtgcttgagtccaggagttcatagtgagttatgatggtgccactgcactccagcctgggcaacagagtgaaaacccgtctcaaatacataaatacatagcaatgtaaaggtagcgcaaatagcctaatttcctctgttttttttttctgaattcactcatattactataatagtaccaattatatactttattatatctaattgtactcatgtcccttgtaactaaataactccttgaaatcaaggataaattcatagtcatctttgtaatcatattgcttgatatagtatctgatgtatgaatgttaacgtcagcatgattaattgtaattaaatgtgcctagccaagttaatttatttattttactttgaccgtggaagcacagttgtattagccatggaatgctgcctcaaatacctttcatatataggtataggtagggtaaaaagctacacagaacattactaaactccagctttcatagtcatttgtatgagcacgtactacacaggcaattaatgtaactgtagctatttttatacatggaaacactcttaagggaaatgatcagtttcttaattaacttgtgatgaaatgcatgatgttgttggaaaatatgtattctgcctggttttaactgactctataatattattaatttattaatatttccagtttttgcataagaatcactagtactttttaaagtgaacctcttacaaaacaaaatatatttcagtctttagagagttaagtcattagacatagcaagttcaaaaagcaggatttgagatcatttttggtaagacctgttttgctgactcttcttgttatgcaaatggcattttctcagttttgtatcctgggtaccatgtaaatggatagagaatgatgagggttgctcactgttggttcctataaaaagtaattactaaaaaacataccacatagccatttacaaatatgactgctaagtttatattgcagagcagcacttcctgagcccaatgtaataatggcttaatctaattacatacacatatgcttgttaacacatgtaagtttccagtacacaataatagtgctctatatctcaagagctttagtattactattgcactgagacataaacactttttaataactgtcctttaaggattttcaaagaaaaaacaatctatgaaaaactctgttaacagggagttcttaggaagaaaataaggaataatgggcataaagagatgctaatattttgtgattgtcttgcagcaaaatgttattaaaagggatagttaaagaggttattatttcacctttgcaaatactaatgggtgctcttgcctccttcattgaacttttagctctccaaaggaattgcagtggtcagtttgttgcagaagctgggtacctaagcactgccaaatgccccacccacagatctctactccaactgcaaacaagcccaggaaggaatgttttttctctctctctcacattcgatacaactgctcaatctacttctctctggtagacatagctccaaaaaccaatgactgattgaacaaattaaagggaatcctgccactagaataaaaattattctaatctggctggtatttttattaattatattcttacataacaatctggcagaatttgagtgaatctgccagcttctgtacacagacctcattgtctctaaatgattcacctaactgccagtggtcataaatacaataataacaacagcaaccaccggagcaaattaaaatgttttacactggtaaacagcgtaactgtttggctgaaactgtcacttaaaatcttaaattatctcactaggtaggggtatgaaatttcaacacaactagggaactaagtctaagctatttaatatttgaataatattaaaaacaagagtaaaatacttaaccatgctgtaatttcccagcattcctcttgtagccacccgcactgtgacttttgcctttctctcttttttcacttccattacctcctctgtaattgaagcatccacctctttatatttccttcaacagacaaggttttattttccatgtcctttaccactactgtgattgaagatttcctactttctctattcccatcattcacatcaaagttaatatgttcccgccttgtaacacacccaccttgtacattttaattaagacaggcactcctgtattctgtgtgttcatcacctgatcttcactcatattcttctctttctgtttttttcttatactcaatgactattttcactcttccccaagattcacgttttataaattccaattttcccaaagcgaagtgacacacatgttccttttgtctaaactgacctgtatgctaatgactcttaatttcattctaagaaaagaagaaaagagaggaaaaagagcatttatggtatacaaactgtataagcatgcccactagacatactgttatgtctgtgggagataagctgttctaaaaataattcctcaaaagcaaatagcagactctgaaggttaatgtaatatgtacagcattcccatttcctttctttctgttgtgttgaggatcaccaaacaagctaatagccctcaagtgtgggatcacgttaaacaaaaacaggacattttgattcatggatgtgccaagttacaaagtttatcctttcaaaagtttaatgctgagtgatatggttaggctttgtgtccccacacaaatctcatcttgaattgtaaccccgtaatccccacgtgtgaaggaagagaccaggtggaggtaattgaatcatggggacagtttcccccatgctgttctcacgatagtaagttctcaggagatccgatggttttataaggggccctccccacttcactaggcacttctccttcctgccgccttgcgaagaaagtacctcgcttccctttcaccttctgccatgatgaggcctccccagccatgctgaactgtgagttagttaaacctctttcctttataaattatcagtgtcaggcagttatttatagcagtatgaaaaaaagactaataccctgggtatcaaggtctttatggttttcatcaggataccaagttctagcccacagcctgtgagttatagggtggcttggtggcttggtcatgatgacaaaccccatcaattcccaaatatgttgaattaattaattaacacattaattcaacaagtatttatgcagtgccttgtctatgctcagcattctgtgagatactgtctggtaaacaaaatacacctaagacatagtgtcttacctgaaatagaatcctagggaattaggtgggcaggcatacctaatctgtaattgagttggtactaaaatcagtgctggtttctatgttgttgttgttgttgttattgtttggggtttgggcttgggttttgggttttcctgtatatttccacttgagtagtaatgttacagtatgtttgtttatttgtcttgtttgtttttggttttggacttggttgacaaaatcagaatatatatgttatgggtttgcagttttcaatcactttttaaccctgttaactttagtctcaagtaaacaaaaaattactgagacttctataaatctaagcaatgtcaggttcagaaaaagggtggcatttgtggtgtatgccttttcactcccctttgctctagtatctcaggctttcctgtgtcctccaggctgacatttagtcccatggaaacaagacttataaggagcattactctttttcattccattaaaatttaccttaacgttgtgccatttcttccaggagttccctttacatatttctgtcatctaaaaaataaatcagtttctctttaaattaaaccttcctggctcctttgccccattgaatcctggaggaaaacaggaaattaagtatgaaattcaggtattaattaaaataaatgctcatagtgccctattaaattggctgcattttgacaggaacactggttcaagagttacctactctcaactgctgtaatctatatacctccatcatttccaagcatcagtcaagttctgaaacacggacttctaacttcataggcaattgtttaccagcgtttcagtttattactaaacactggaaattataccagacatcttagtcctggatggggcatgcccttctgatcagcaagtctgttcagttataacccaaaacgccatacagtttaaggagaatgaaaacagaggtaccaaaccttttgaggaattgtcttttccacttttagctgtttctatctaaagaactggggctagccccaaaccatcagcgtgccctttcctcatggacagtgtgggagaaatacagaccaatcccttctctttgtggatttcatgcagtcccactcttctaattttatttgtcagtaacatgttccagtttctgagatcacaattaatcttacattaattacattttaaattaaccacaatatgctctttcagcagcacttaaaatgtcatcagcaagacattgcataaatcattgttgagcgtggtttacttgtgaggagatttatgtagatgataattccttaaaaggcacatggattttttaaaactcttatcaaagtatgatatttctggggttcgaccacagttacaggaaggtcatagtgtatccggcagtttgcacagcccttcacctaattttgccaacaagcatatgaagggaaatatattttcttctgtgattatccattttgtgttttgtcagtttcaatgacttctcttccagatttatgaagtttatatggcactgttatgagagacctattccaactctgccttttagtacctccagacccctaatgacacaattatgagctttctcaagtaatgttattgcttaaacctttaaagtctcccaaagctcggagcactatttgcaaatatgtagtaaattaaactgcaacacctgctactgtgtagttgtgtcacaggtcatttcatctctctgggtatcagtttcctcaaatgtcaaaataaagggaagctagaatcactgtaagatcttctgcaagtctaaaattctggtattctctgaacaatgctatagatagttgactttcactttcctcatatcacactgactgattgatgttgattcttatctcaaaaagtaagatttctagctctagagagaccttcaagattgtcagctctaacacctccattttgcagataaaggaaacttagggcttgagaaatgaagtgacttctcaaactttccacagtcagcaagtggctggcactaaatgccaactctcctgctactgataaagttctctctcctctactccatgaaaaaaaaaattcttgcatttttatttaagttgaagatatttcaaagtaaacctgatcaatgaaattcaactgtgaacacgtatgtcagaatattacagtcaggaaacaggaaagggggatgaaaaatggcatgtgtagtaggacccagacagccaaattaatattgattcaaagaaccagaactgcaatgaaataaggacagaactaaagaaattcagaggtttggggaaaagaaaaaatttaataaaaatggaaataagactcagacaagcacagctatgcttttgtcattgacattcagtactattaagttcatcttcatcgggacattggtaaggaaaggcgtgtgatctctttgcagactgatagactttttggccctgtaatgatagactttgtctttttttttttagaactctagttgcaaaactctgcttatacgtgaaaaaaagatcagtctgcatctgtccctgttgctaatagtaaccatctttcaaatattgccagcttttcatatcacaagcattttggtccaactcacttcacctcattcagtcttcgctactcaggacttccttttaattgacacacaataattatacatatttatggggtacaatgtgatgtttcagtacacatatgcattgcctaacgatcaagtcagggtatttagcaaacccgtgacctcaaatatttattatttctttgtggtaaacacttttagaatcctctcttttaggaattctttgtatagtttcaaggcttctgccacctccacagaatgctttttggttctctctgtgatctgcacagtgtattttttctcatttcatctactgcttgtcctacactttcatttcttcatagcactcctgatgtatttcaaaatctttaaaagcattactggtaatcatcataataataataatgaggctataacattttccataccacagtcttagaaatcatctagtttattacgttcaaaaaatttcccaaaagaaggcctaccaaacatgtaataaacctaaaaatgtatcaggcactagttcagaggctgcatacaccaatctgatgctcataaactcattctagctatttgtacaatacaggctttcttctccaaggtttccatagagtcctagaggaattattagaatcctgagccggaattaaatgaaatgagtgttaaactgtgatctggtaaattgaggtagatggtgcaaacagctgattgttaaaggaaagtatcctcaagcctcacagttgcagggtctgttttataatctcatatcctagttttgcctatttggccattgaaaaccaatccaaacagcctctttaagtgacagctagattcaattcctgttgaggtgttgttgtttaaaccctctctccagagagcttcagtgggattgaaaaatacttgttccctggaagctacagtaggaatgctctatgatttgtgcataatacatatgataatctgagctttaaattaatccctaacccttctggataatacgctgcaggtaatttctccttcctatattacactgcggaagctagaattcagaagtatagtcttgctcaccttttaaggataatagagcttcaaaacagtattgcaggaagcaaagtggaataaacagaaaactgtcaaactagatgccactactgtgagttgttgaaaaggttaaatgtcagaagcaaatataattggatgactggaatgaatgactaagtgctttttacactaagttgcttgtttcacaagcaaccctagacccttagaaacagggttgatgaagtcaaagggacggccattctgtcttgtctttccccttctcagatcagcagaaaagcagcagaaaaacatggtgttggattgtagtccctacagatttggtacttccaagactctcccactccagcaaaaagaaaggacactcataacctttcctttttttctactccatggtaaaaatctagagatgggtatagtgcaaaatattcagattttggagaattattatccattttgtacttaaaaaaaagaaatcttttgagaatttaaacccattgtttaataggatctcaaataaagcaattgcactaaaattcaagccaaagaagccattaagaactgatcatttatttggaggaattaatgttattttcctttaaggaaacaaagataagaagcatagatgttttaaatgcagttcttaaaacaatcttttcttcttaatgcttcagaaattgtttatgatcaaaagatgcttctgcgtttttatattaaagccctgccttgggcagggagcaaggagaatatatcattattagtgggaagctcgcaagaaagatgagtgtcccccactctctctcctcctctctggagtccaactgcagctgtaactttggctctgaaatttgaacaagggaggaagaaggctggatctggtgtcaactgtgaacgtgatttcccccaaggcaagagccaccccaaacagggcatgtactttaaattgcttttcgggtaaaggtccgaggtttccattgaaccagtagcctaaagttgtgaacccaacacgagacttcctgtattcccactctgcttctaccacaaaccagttttaggagcttgaaaagatcacagagctgctataggcctcttttctcccctctgtcaagtgaggaactaggaggaggtggcttttagtctttttcagtttctgactgtgtgaaagctatattcttcctgactggtgaaagctttgtatattatccctcacaagggatgttttctttttaacaagaaaacaacaggagataggtaatatcagcaaatactgcatgatttctcgtataaaaaggcatctaaaataatcaacagtatggcgatagagaatagaatggtggaagggcatggaatcagggggataacgagagctgttactcaataaatataaatttattcaagatgaataagttccagagatctcctgtacaacgtgatacctatagtgaacagtaaagtattatatacttaaaaatttattgagagagatcttgtgttaagtatccttgtcacacacacacacaaagaggacacaagaagacttttggcggtgtggatacgtttattacccaggttgtggggatgataatgtaactgaacccaggactggccacttgctacttaaaagccagacatgacagacgagggttggtaggaggaaaatgaggtttatccatagagccagtacaccgcaaagagggtggactatagcctcaaagaccatcttaagtcagcacaggtgttaggctgtctttatgttaagggcagggggaagagaaggggaatctagatcaagagctgaccaataactgcagacatctgggcagcagcaagggtccgagaaggttgagaacgtctttgtcctgggtcaggtcacaatgctcctataaatccttaacaaaacagagttgtttacatacttccccctttaatcccagatttagttgtaaatctgatttacaactaaatacatgatttaatgtaacatcacatacatttctgttacattaggattagagacaagttctatttagaaataacttcaacagtttttatattttattttcacattgaaaatcggtcagacttgcttcagcctcaaagagcatgtttatattataattaaatgagcactggtggtgagctgtagtttctgtttctaaatgggaaatgggttaaaccaaaatgaagttaattatattagtttttttgctgtttcactgttacagtaatgctagtgtgtagacatacatatgcgtatatgtatatgtgtgtatatatatatatatgtccaacctcaacaaaattgtatacattaattatgtgcagtttttagtataccaattagacctcaataaagctggaaaaatgacaaaagaagacagatagcatcctgagtgcctccccaacctacctgaaccccagtagattggtgtgtaggtaggaactggacctttcatctctgtcttcccaatgtccagtacactgggcacttagtaggtattacataaatgtgtgttactggtcggtttaaatcaacaacctgatacctttctgagagtagaatatgagacctagtttaggtaccaggtaaagagattctaacctgctttctctacgtaagactaacctcaccctggccatgttaattccaatccttaatcttttaatctaatgagttaactatcagttgtataatttttatctgattattccaattcatcacatttaattatcttactgtttctgccttccattagtgaggaggagaaaacatttgctaataattttattatgtagtagggactgtagtaagtactttatatatcccatcatattttatttaacagcattctcaaaaacactgaggtagaaattatgacacttattttacaggtgaggaagcagctcgtagcattttagtaacatgtccagattctcatcactaagcagcatcatagctaggactggaaacaagcctgtttccaaagcctgctttttttttttttttcctgcgctcactgcactggagttttcttcccctaccaaataaatcaacattatttctgagattgcataatgggagtatgagggacttggataggaagcagagaactgtctgaaatgacattttctaatattggtggtagattgcattgatccagtgagatgaacatctccatctcactagccacccctatggtcatcaatgtgcatcttgttatgtattttggtgcacctagtggtacaaatgagaccacaaatcttattcttgtgtaaagcatcagattgttttgggctcgccatccatgtcttttgcctcattagagccatattctactcaatccagtgagaaaattgccatagacgacttttcagataacaatgatgaatactactttatatatgtatacacacacaatgtgtgtgtgtgtgtgtgtgtgtgatcaattctttcagcttagtaaaacaaaagtgttagcagaatttttacattcaagttttctgacagtcataatggtaaataaataactctaattctgtttctcaggtgaagcgaagttcggaagttgtcaggctactgaccactctgatggaactagcaaggaaatgtgtgtcatatattattttggaaaaagaggatttttaaactgaattcttaaagttgtgaagagaaaaactgaaacctattttctcctcttggttaccagtgtccatttagcgcccagaaatatcaaatggggatcagagtagccctaaaatgatgccataacacaccttgcaagtttctttcattgtgaaatttgtgagtctgataatacatcttttttcatgtttctagttagcccctttattgcatgattaataaaagcaaagggatgaaggactggggaactcagtgggcaatgtatgcgataataatatctaatcaatttccttctgcaagtttgattacattaagacttctggagaagaaaattgattggactcattcacttgggaacctttcaggaaacaaagtgatttcttttagttttctattgcaactgatattatgggcctagagccaaggaaaaatgaattgtcctatcctaatcaattacttaaatctggtttttataccaagtgttcataaaattggcaaagcattgaatgggtggaaaaatgctaaacaggaaatagaaaaagaacaaatcaaatttaagtaaacaaggatgaaaggaaaattatatgtataatatatattatgtataatgtatataatatataaatatatatttatatattttttgagacagggtcttgccctattgctaggactacagatacacactaccatatctggcttattttgttcattttttgtagagatgaggtctcactatgttgtacaggctgatcttgaactccagagctcaagtgatcctcctgcctcagcctcccaaagtgctgggatgacagttgtaagccactgcacccgggaggaagaatgcgtattaaaggaagtaatttagccttatctcacctcaggtgtccagacatttattgagcacctactatgtgtccggcctttaactagatgttagaagtctaaaggtgaataaatcatcatatctctaactttaagggcctcccgctctaataagaaaacatgcacacacacgcacacacacacgcacacacacacacacacacagagttgtgaaactactagatggatcaatggcaaagatgaggatagggaacaattatagcacaagaaaaggctcctaattcatagaattaggtaaaaaggtatttgctttgaggcaaaaaaaatacatcagagtgtacaaaaaagaaaaagaaaaactgtgtggaccacaggattttgtaattgctgagcatgctgtgtgagacatggaagcttacaacatgaggagcagtgagggtaatagagaagatggattgtagaaaatcataggtgctgctctttgtgaagcaggttgtacttcaggcagtagaaaaccactgaatgtttttaaatggtggacaatatggtcagatttaggtgttgaagggatgattctggcaccattatagaacatgacttttactaggaaaagatgagagaaaaaagaccagtgaggatatagagattttccttgtatgctgcaaatggaattcctctttcaattttattttgaaggatctccactggatttaagtagtcaatgaattaaaaaataagggagtgaataagaaaggaggaattatagctatagccaacaattaatatctatggctatgaagatggaagttgacttcattgagcaaacaggaacacacttttagtatttaggctaatgagttagcacatctgatcatttatcttcaatctgtccacagaagatcttttgaggtaaaggatttccaaagaagtgggcttatgtcaaatgttccaagatcttgaacaattacggtcctttcagaagggcagataaaatccaatcacaggcataattgttttattgggttttgctttattgagcttcgcagatactgcacttttcacaaattgaaggtttgtgacaaccctgttttaagccaaccctattggcgccattttcttgcagcatttgctcacttcatacctcagtgtcacattttgataattctcccaacaattcaaaatttctcattattattatatctgttatggtgatttgtgatcagtgacctttgataatactattataattgttttggggaaccatgaactctgcccgtacaagacaatgaatttaatcaataaatgttctgtgtgttctaactgctccaccgaccagccattaccccatctctccctctcctcaagaccccctattcccaaagacacaatactgaacttaggccagttaatgacagtacagcggcctctaagtgttcaagtgaaaaaaagagtcacacatctgtcactttaaatcaaaagctagaaatcattaagcttagtgaagaaggcatgtcaaaagcaaagataggcccaaaactatatctcttataccaaacagccaaggtgtgaatgcaaagaaaaagttcttaaggacattgaaagtgctactccagtgaaaacatgaacgatagaaaagtgaaacagctttattgctgatatggagaaagttttgatggtctgcatagaaccaaccacaacattcccttaagccacagcctattccagagcaaggccctaactctcttcaactctgtgaaggctcagagaagtgagaaagctgcagaagaaaaatttgaagctagcagagttggttcatgagatttaaggaaagaagccttctctataacgtgaaagtgcaaggtgaaacagcaaatgctgatgtagaagctgcaacaagttatctagaaggtctagctaacgtaattgatgaaggcagctatactaaacaacagagtttcaatctagatgaaacatctttctattggaagaagatgccatctaggacttctatagctagaaagaaaaagtggatgtctggcttcaggacttcaaaggacagaccttgttaggttacttgaagttgaagccaatattcacttactgttctgaaaatcctgagactcttaagagttctactatctctactctgcctgtcccctagaaatggaataacaaagcccggaagacagcacatctgtttatgcatggcttactaaatattttaagcccactattgagacatacatagaaaaaaaaaagatttctttcaaactgttagtgttcattgaccttgcacctcatcacccaagagctctgatggagatatacaagaagattaatgttgttttcatgcatgctaacacaacgtctattctgaagcctgtgaatcaaggagtaatcctgactttcaaatcttattatttaagaaatacaattcatagggctagagctgccaaacagagtgatttctctagtaggtctgggcaaaataaattttgaaactactggaaaggacccaccattttagatgtcattaagagcatttgtgattaatgagagggagtcaaaaggttaacattaacaggagtttagaagaagttgattccaacccttatggatgacttcgaggggttcaagactccagtggtggaagtaactgcagatgtggtagaaataacaggagaagtagaattaaattttgagcctgaaggtgtgactgaattgctgtaatttcatgataaaactttaatggatgagatgttgcttcttccagatgagcaaagaaattggtttctttttttttattattatactttaagttctagtgtacatgtgcacagtgagcaggtttgttacatatgtatacatgtgccatgttggtgtgctgcacccgttaactggtcatttacattaggtatatctcctaatgctatccctcccccccccaccacccccatgacaggccccagtgtgtgatgttccccttcctgtgtccaagtgttctcattgttcaattcccacctataaatgagaatatgtggtgtttggttttctgtcattgcgatagtttgctcagaatgatggtttgcagcttcatccatgtccctacaaaggacatgaactcatcctttttatggctgcatagtattccatggtgtatatgtgccacattttcttaatccagtctatcattgttggacatttgggttggttccaagtctttgctattgtgaatagtgccacaataaacatacatgtgcatgtgtctttatagcagcatgatttataatcctttgggtatatacccagtaatgggatggctgggtcaaatggtatttctagttctagatccctgaggaatcgccacactgacttccacaatggttgaaccagtttacagtcccaccaacagtgtaaaagtgttcctatttctccacatcttctccagcacctgctgtttcctgactttttaatgaccaccattctaactggtgtgagatggtatctcattgtggttttgatttgcatttctctgatggccagtgatgatgagcattttttcatcatcttggctgcataaatgtcttcttttgagaagtgtctgttcatatccttcgcccacttgttgatggggttgtttgttgttttcttgtaaatttgtttgagttctttgtagattctggatattaaccctttgtcagatgagtggattgcaaaaattttctcccattgtgtaggttgccagttcactctgatggtagtttcttttttgtgcagaagctctttagtttaattagatcccatttgtcaattttggctttgttgccattgcttttggtgttttagacatgaagtccttgcccatgcctatgtcctgaatggtattgcctaggttttcttctaaggcttttatggttttaggtctaacatttaagtctttaatccatcttgaattcatttttgtataaggtgtaaggaagggatccagtttcagctttctacatatggctagtcagttttgttaaatagggaatcctttccccatttcttgtttttgtcaggtttgtcaaagatcagatagttgtagatgtgtggtattatttctgaggactctgttttgttcccttggtctatatctctgttttggtaccagtaccatgctgttttggttactgtagccttgtagtatagtttgaagtcaggtagcatgatgcctccagctttgttcttttggcttaggattgacttgccaatgtgggctctttttggttccatatgaactttaaagtagttttttccaattctgtgaagaaagtcattggttgcttgatggggatggcattgaatctataaattaccttgggcaatatggccattttcatgatattgattcttcctacccatgagcatggaatgttcttccatttgtttgtatcctcttttatttcattgaacaatggtttgtagttctccttgaagaggtccttcacatcctttgtaagttggattcctaggtattttattctctttgaagcaattgtgaatgggaatttacttgtgatttggctctctgtctgttattggtgtataagaatgcttgtgatttttgcacattgattttgtatcctgagactttgctgaaattgcttatcagcttaaggagattttgggctgagacgatggggttttctagatatacaatcatttcatctgcaaacaaggacaatttgacttcctcttttcctaattgaatgccctttatttctttctcctgcctgactgccctggccagaacttccaacactatgttcaatagtagtggtgagagagggcatcctggtcttgtgcctgttttcgaagggaatgcttccagtttttgcccattcagtatgatattggctgtgggtttgtcataaatagcctttattattttgagatacatcccatcaatacctaatttattgagagtttttagcatgaagggctattgaattttgtcaaaggccttttctgcatctattgagataatcatgtggtttttgtcgttggttctgtttatatgctggattacatttattgatttgcatatgttgaaccagccttgcatcccagggatgaagcccacttgatcatggtggataagctttttgatgtgctgctggagtcaatttgccagtattttattggggatttttgcatcaatgttcatcagggatattggtctaaaattctctttttttgttgtgtctctgccaggcttcggtatcaggatgatgctggcctcataaaatgagttagggaggattccctctttttctattgattggaatagtttcagaaggaatggtaccaactcctccttgtacctctggtagaatttggctgtgaatctgtctggtcctgcacattttttggttggtaagctattaattattgcctcactttcagaacctgttattggtctattcagagattcaacttcttcctggtttagtcttggaagggtgtatgtgtccaggaatttatccatgtcttctggattttctagtttgtttgcatagaggtgtttatagtattctctgatggtagtttgtatttctgtgggatcagtggtgatatcccctttatcattttttattgtgtctatttgattcttctctcttttcttctttattagtcttgctagcggtctatcaatattgttgatcttttcaaaaaaccagctcctggattcattgatttttttttttgaagggttttttgtgtctttgtctcttccagttctgctctgatcttagttattttttgccttctgctagcttttgaatgtgtttgctcttgcttctctagttcttttaattgtgatgttagggtgtcaattttagatctttcctgctttctcttgtgggcatttagtgctataaatttccctctacacactgatttaaatgtgtcccagagattctgatatgttgtgtcttcattctcattggtttcaaagaacatctttatttctgtcttcattttattatgtacttagtagtcattcaggagcaggtcgttcagtttccatgtagttgagtggttttgagtgagtttcttaatcctgagttctagtttgattgcactgtggtctgagagacagtttattataatttctgttcttttacatttgctgaggggtgctttacttccaactatgtggtcaattttggagtaagtgcagtgtggtgctgagaagaatgtatattctgttgatttggggtggagagttctgtagatgtctattaggtccacttggtgcagagccgagttcaattcctggatatccttgataactttctgtcttgttgatctgtctaatgttgacagtggcgtgttgaagtctcccattattattgtgtgggagtctaagtctctttgtaggtgtcgaaagacttgctttatcaatctgggtgctcctgtattgggtgcatatatatttaagatagttagttcttcttgttgaattgatccctttaccattatgtaatggccttctttgtctcttttgatctttgttggtttaaagtttgttttatcagagactaggattgcaacccctgcctttttttgttttccatttgcctggtagatcttcccccatccctttattttgagcctatgtgtgtctctgcacatgagatgggtttcctgaatacagcacactgatgggtcttgactctttatccaatttgccagtctgtgtcttttaattggagcattagcccatttacatttaaggtttatattgttatgtgtgaacttgatcctgtcattatgatattagctggttattttgctcgttagttgatgcagtttcttcctagccttgatggtctttacaatttggcatgttttttcagtggctgttactggttgttcctttccatgtttagtgcttccttcaggagctcttttagggcaggcctggtggtgacaaaatctctcagcatttgcttgtctataaagtattttatttctccttcacttatgaagcttagtttgtctggatgtgaaattctgggttgaaaattcttttctttaagaatgttgaatattggcccccactctcttctggcttgtagagtttctgccaagagatcagctgttagtctgatgggcttccctttgtgggtaacccgacctttctctctggctgcccttaacatttttttcttcatttcaactttggtgaatctgacaattatgtgtcttggagttgctcttcttgaggagtatctttgtgatgttctctgtatttcctgaatttgaatgttgacctgctttgctagattggggaagttctcctgaataatattctgcagagtgttttccaacttggttccattcttcccgtcactttcaggtacaccaatcagacgtagatttggtcttttcacatagtgccatatttcttggaggctttgttcgtttctttttattcttttttctctaaacttctcttcttgcttcatttcattcatttgatcttcagtcactgataccctttcttccagttgattgaatcggctactgaagcttgtgcattcgtcacgtagttctcgtgctatggttttcagctccatcaggtcctttaaggacttctctgcattggttattctagttagccgtttgtcaaatctttgttcaagatttttaacttctttgccatgggttcgaacttcttcctttagctcagacaagtttgatcatctgaagccttcttctctcaactcatcaaagtcattctctgtccagctttgttgaattgctggtgaggagctgcattcctttggaggtggagaggcgctctgatttcatagaattttcagtttttctgctctgttttttccccatctttgtggttttatctacctttggtgtttgatgatggtgacgtacaggtggggttttggtgttgatgtcctttctgtttattagatttccttctaacagccaggaccctcagctgcaggtctgttggagtttgctggaggtccactccagaccctgtttgcctgggtatcagcagcagaggctgcagaacagtgaatattggtgaacagcaaatgttgctgcctgatcgttcctctggaagtttcatctcagaggggtacccggccgggtgaggtgtcagtctgcccctactggggggtgcctcccagtttggctactcctgggtcagggacccacttgaggcagtctgtccgttcgcagatctcaagctccgtgctgggagaaccactactcttccaagctgtcagacagggacatttaagtctgcagaggtttctgctgccttttgttcggctatgccctgcccccagaggtggagtctacagaggcaggcaggccttcttgagctgcagtgggctccacccagtttgagtttcccggccactttgtttacctactcaagcctcagcaatggcgggcacccctcccccagcctcgctgctgccttgcggtttgatctcagacacgctgtgctagcaatgagcgaggctctgtgggcataggaccctctgagccaggtgcgggatgtaatctcctagtgtgccatttgctaagaccattggaaaagtacaatattagggtgggagtgacccgattttccaggtgccatttgtcgccccttcccttggctagaaagggaattccctgaccccttgcacttcccgggtgaggcgatgccttgccctgcttcggctcatgctcggtgccctgcacccactgtcctgcacccactgtccaacaatccccagtgagatgaacccagtacctcagttggaaatgcagacatcacccgtcttttgtgtcacttacgctgggagctgtagactggagctgttcctattcagccatcttggaatcgccccccgaaattggtttcttgagatggaaactactcatgctgaagatgctgtgaacattgttgaaatggtaacaacggattaagaatattacataaacttaattaataaagcaacaacgggatttgagaggactgactccaattttgaaagaagttctactctgagtaaaatgctttcaaacagcatcacacattacagaaaaatatttcatgaaaggaagtcaattgatgtggcaaacatcattgttgccttattttaagacactgccatggccaccccagctttcaacaacaactgccctcatcaattggaagtcatcaaaatagaggcaagacccttcactaggaaaatgtttccaactttttgaaggctcaaataatcattggcatttttttagcaatgaagcattttttaaattaaggtatgtacattttcttggtcataatgcttttgcacactaactagacacagtataatgtaaacataactttttttttttatttttttttttaggtggagtcttgctctgttgcccaaactggagtgcagtggtgcaatcttgggtcactgcaacttctgcctcctgggttcaggtgattctcctgccttagcctcctgagtagctgggattacaggcatgtgccaccgtgcacagctaatttttgtatttttagtacagacagggtttcgccatgatggccaggctggtcttgaactcctgacctcaactggtccatctgccttggcctcccaaagtgctggaattacaggtgtgagccactgcgcccgggcaaaacaaaacttttatatatactaggaaaccaaaaaattcctgtgactgttttgtagtattcactttattctggcagtcttgaaccaagtgtacgatatctccaagatatgcctgtacctgtcagagttctactttgcattcaattacagctattaatctcctgcaagtcattttgtctctctgaagttttttttttttttttcttaaataggagaatactatttatcaactcatttcatgggattattgtgatagtgaaataagaaactgtaagagaaaaccttatacttttacaaatctaattgcttttattatcattattgtgtatgtgtgtgtttgtgtgtgttcactgttaatctcaatgcccttcttactatttttctcccccttaaagcaaccttgttcattctcactttcccttcaggtatcagttttctaataccttcccctcatcaaagtctaagtagaaaaataagatataagctattgacatgttgaataaaaacagtgagtttctactgctaggaattccatatcttgtcttggccctatcagccttgaaactaaaataggaattttcagggttcttatggaaaggtgagtctaatggtttgaggcacacacacatatacccccattatatgatttatttcagagaaaatcatcctagatacagtcccaatacagtcagaagccttgagaagctgaaaattggaaggaaaatgtggatagtgtgtgttcctatgagaatttccatttcatcatacagtaaaagtctatgctggctctcatacatttctataataaaatgtatcatcaatatcatcaatgaaatatatatatgtatttcatgtatttatatatttcatatatatataaatgctgaattaaatataaaacttaagtatattacatatctattgaatactgatttcagcatttttggatttgaggcctgctgggagcactgtgttgactcaatctaccacattgcccaaggctggccatccttcacatagtcttacagctttctctgcccacaactccaggtgtctgtgtagctttgactggcatctctgcagagctgagggggctgtgggaatgctgtctttctccaggcatccacagaggggctggcttcaggtttagtttagtcccatagtccacttgtgggtcagagaaatacattaattaggttagctcctatgtgagttattgcttcgcaggttaaaatcattctgattctactttggtaatatgcaaggattttcaaaacattttctaagagtgtgatatgtgcagcaagcatttaaatttagatatcaaattgtttttattgaatttcaaactcaaaagtgtttctaaatattgtcattttggaattgggcccccaaaaatagtaaaaatagatgtttaggtagagaaacacatttgtgtagcaatgcctcaccctgctacagctcgttcgctgacactgcccaacaaacccactgaggcttggtgcgagaaattacctcattaaataatcttataaaaaaattgtcagatgtaacaaagactggactctctgagcttttctctataaagaatgcattgttaagttgatcgggttaaggttcagttagtccaaggtagggtttatgaataggaagaaacttgtcattcactttgtagatgagtaaagcatgtgaatttaggggaaaatatcatcagtcacttcctcaaattgtttttggaagtagcaaaatgtcaaccatattattaaataaggaaaccatacttcttaaataaacttccctagaagcagatctagagatgaggatttgatttgtgtgcaaggaatttatgaaagggagtgtgctaaggaaacaatggaagcaggacagggaaggagtcgaaggggagcaagagggagggcccaggcagaagtcctcaagctcagggcgtagatctcagccagtccctcaggtgtcctcaggagtgtcagagttttcccaactggaggagaaaaagctagactgccattttcccacccccaatggtcattggttaccagcatgtgtggaagatggcagtcctcaggcacttctggctcctggaggctctggaaggcaaagagaagtctgccaaagaatatcacagatgatggccattggaagctttccaagggttcaggttttcagaactgtttagaagagatgggaagagatttgggtcattacagcactggccgcagcactgtctgctatgtaagtgcatgactagatggaccttgagctattcttcaggtccagataagggatctatgtgtcattttaaacactggcttcatgtacttgcctgaccacaaagggcaatgtcaccaggaatataaagtcaaataaaatgggtcctgtaaaagacaatttgctgctgggttgcagtttaatccatgacctcttttgcttacatgagatcttgaaagaatattaaattaagagttatcttctatgctggcataagaagcaaataattttccataatatggaaataaaatatgtgaaaaatgttaagtttcttgaaacaagagtttaaccagaagttaataaacaactctttcttcaggaaacctttgactcatggtttatacatacttttgtattaagttgtgtagcataaaaataaaagtatagcagtagtatactaccactggagtgtcattcctgagatagccagatgttcagttattttgaaataaccctggagtataacagtaaagctaccccctcaaaaaagttttttgttattagaattcatgatattaatctaagttaatctctccattcctttgtgctcctcataacatgttgtttaaatgtctctacagtactgattccatcctattttatgttattattatcttgatggctgtattagtccattctcatgctgctgataaagacgtaccagagactgggcaatttacaaaggaaagatatttattggacttacaatttcacgtggctggggaggcctcacaatcatggtggaaggcaaggaggagcaagtcacatcttacatggatggtgcaggcaaagagaggagagcttatgcagggaaactcccctttataaacccatcagatctcgtgagacttattcactatcacaaaaatagcccaggaaaggcctgcccccctgattcaattaccttccactgggtccctctcacaacacatgggaattcaaggtgagatttggttagggacacagccaaaccatatcaatggcaaaaccgtataaggttcatctttagatcatccaaaacatttgtcactgttccagctcatgatagatgtttgaaaacatttgaatgcatgaattggcctacaatttcccttctttgaaacatcttgtcttttattataatagccaagtacatttgctctttgaataatgattcaccatacactctcctagctgcttgttaattcttaactttctctcccttgttcctttggaatctgttatcagtgtttcgacaggatgtgcacaagtgtcagagcatatgttgtctgcatatgtaccaaagaaggcatatctttctttccttttctctgcaatattcttctctttaatgcaactataaattcccagaacatacctcctattttgagccaagaatcaggctttgaataaggtttcgctcatgtagagtaggattctggatattcagcttcaatagtgaagctaagaattctacgtatcttttcctactagcttggaaaatatatcttaaactagtccttggctatgactttgccccttctcaggaatagacacagtgtgtttatgcaaaacaaacacagcgttttcaaagatagagcaagagaaaaaagagacttctctaataggctttaatacaagaatgaatttcatggatttatttcagagcaaatcatcctcgatgtggtcccaatacagtcagaagcctcgagaaactgaaaattgggaggacaatgtggacagtgtgtgctcctatgagaatttcagtttcatcacacagtaaaagtctatgctggctgtcataattttttataataaaatttatcatcaaaaatactaacaaaatgttgcaaacccaacacattcacagtcttctatagttttaaacatacactaaggtcaaagccaataggatagtcagctgctttaatttaggagtaacacgagaatgggccagcccctagtagctcctccattacctggtcatatgcgatgtccactatgattgcatcgtagttacactcctgggaaaacacacctgtatccgaaatctcccaaatagcaaatggtagctggaatagggaaataggtggctatcactgagtggaattaagatccctaagtaagtgaattgtagagaagctcatctttgatcagggtcataaaaaatctggtgctggaaggcagggattaggtgaggctgtaaaaccggatgccccaaagcaaatttgctttgtctttctttctcctcacagactcattccttatcttcccaattaatgctatcactgttctcccctggtaccaaagcttaagacctatgggttgtttggacgcctaactcttaccctgcttgtccagtcacgctctggtaattgcgtttctgctttattccggttgccttgatttaggatttcatcttctcccacttagttgagtgccattttctccttcctgacctctcatattttttgtgactttttttttccatctgagcagctagactgacctctcgtgtgttttaacgtcagtcctctcttccactgccagccatctcttcagtcccaggtttatctccatccctatctcctcccccagctccgtggcttctccccactgtctcctcctgtctttgccatggtgatggctactgtggagtggagtgttggttaggggccctggagccccacccttctagtttcgaaacccacctctgccttattacctgtgtgaccttgggcaagttatgtaatctctccaactgtcattctccttatttgaaaaattatactaattaatgcctaactcaaaagattattttgaatattaaatgagataatgcccataaagagtttagcacagggcgtgttatacagtgaagtattcacaattaccattgaagaaatttgatgattagcatttgatatcactgaggctaggagatgcagcaagaacttcagtgggtaaatttctaggcagacaaacaatattactaaaatagaaggtatatgagccatctgcccctttttacaaggtatatgagccatctgcccctttttacaaactacagaacatttaaaattaattcaataagcagaattcctggtattattattaaatatcaacttttcaattgacctggccataaaccatctgttggttgataaagacacacatcctaaacttacagaaatagtaccattattcaactttatatgccagtggttcatttctttaacaaatatgtagcgctctccttcatgctatgctagactgaactaattgttcaggacgtcagaggacaagtttagttcttgctctgagaaaacatcatctgtatgagtttgcaagggtttccataataaaataacaaagattggatggcataagcaacagaaatttattttctcacagttttagaggctagaagcccaagatcaaagtaccctcagggttgttttctggtgagggctctcttcctggcttgctgacggctgccttcttgttgtatcctcatatggcctttcctctgtgcacacctgctagacagagctctctttctcttctaaggacaccaatactatcctatcagggagcatgccccaccctccaacctcatttaactgtaattgcctccttaaaggcccatctccaaatacagacctccaaattggggagtagggctttaacgtgtgaattttgggggacataatcctgttcataacactatctaaccaaagaaccagaaaaatagaagatcaagggacacctagttcaagtttttaggtgaaccataacctacataagttaacataaaaacatttctgagagaaaaaaaagaatactatgttggtactctaactcaaagatcttggactgagaatcaggttgtttgtgttctaatcttccttctgcagtgaaattgcagtttaggcaaatcaatttctcaagtcattctgcctctctgtgactgaatcaaatgaagcctaatgatgcttataaagttgttttaagacataaaagagctctacaaggataagatgctgtcattttcatcactggctttcagctaaaagctcagcctgatatatttttaccatttcagggaaggcaatcttcctctccagttcaagtatgtagcataatatcaaagaatattgatgttaaaatgtggacttcatgatcaacatattgattagacactattttgaatatgttaagagagaaagcttcaacctacacatccctgtcaaccatcaaccaaccccaatcataaacatctttagcagaagactgaattctccttttcttgaaattccatagtgtgtgttgctttattccaattacacgatgtcttaacatgaaactgtaatgcgattttcattcagttcttaatttcagatagccagaatatatttctttataaccaatcgagaaatgtgactataatgaagtcagcattacttggtaaaaagatttaaaacaaaatgctctttctctactagtcgaactaaaacttgtctgcatagaggacatctgtaacgtaaaggaggtcaggggcatgcaatgaatcaattcaggagtcttcacaagcgcaatcattcttttctactaaactaaaattgttaagatccttttcattttgaacataatcacttttatagtttccaagtacaggaatctttaaaatctatagctagagatgtgtagataagaataatatattcaatgaacttctttttcatggggtgtaatctgtataattgtttaacacaaggaaaaccacaataaagaaatcatgcccattctctggggaaacagaataaaagcacacagggtcaaatatgcaggttctgtgtgtaaatagcactgatgaagtgcatatcttgcacattttacctttacgtgcttccttctgtgggagaataacaaactccctgcaggtctatagtagtgacaatgattaaaacttgggataaagcagaagaggatctgaaattgttagaaaaactctctgatccccaatctgtttgctctactgattgaaagataccagatttaccaacagctgaaactgatgctgggcttgaacacaggggagaatcaagcagcaaaactcagctttttctttcttgtgccccttctagtagagacagtccataaatatttactgaaggaacgaatgaatcacacagacggagcacagttgggcaagccagtctcacacgtcttccgctgggacgaggacgaaatatttataagtcgtgatcaataaaatcttccctacctgctacctttctcccttctaccccatcacgacacaaaaacctgctcccagttcctctgcttgtaccacctacaaggttttcctagttatcccatgctacttccctggggaagctttcttggccaccaaaggaaagaataaggcaggagttctcattgacaccaatgggaccaattgttttctcccatcactgctgtggttaccaccccaaccctgactgctgccttaaaatacacgcattttggtaagggtgagagaactccgttctacaaactgcttatagaccagacacatgaaatgtgcacagttttaccacactctctgagaataacataatatgccatgaagatcttcaaagcccacactattttattttccttctagttaatgatgccttgggctttagggccacagatctctcttttattttgctagttcagtttagtttccacctcaggccctagctgagatataaaggtatgcaagtagagctgtggagaaattgtgctgtgtgttctacaagaaagggtcacatttggcttttggttgcaaatatcctatttacttccaactgaaactcaataatacagcattctgttaattctatccacatgaactcaccgaccgcctcttatctatgtcagaaatacaaagtcctcctcagttcctctgaaactaattttttcatctcgattagcacatctaggagtcttcctccttcaatcatgtcctcctttgtgtcttggttttgatgatttttctcatcagtcctttccttccactctcaatcacatcagactggcatctcttcatctttcttctttctttttgtgtttgaaaccacaagtgtttttaggattccaagttgattgaactctactccatacatactccaaaattttcttaccaaattgtatttctattctttttttatggctgagtaatattctcttgcatatatacactacatttttgttatccattcatccattgatggacacttaggttacttccatatctttgctattgtgaacagtgctgcaataaacatgggagtacagatatctcttcaatatactgatttcttttcttttgcatgtatacccagcagtgagattgctggatcctatgatagttctagttttagttttttgagaaacttccattctattttccataatggctgtactactttccattcccactaacactgtttgatcgtttccccttgcccatatccccatcagtatttgtccccatacaaatttatttcttgtgtgattgacaacttaattacaatattatgacccttttctaatcagtctgggacaacttaaagtctgcagtggctttaaggagatttccttgagagcaattaattactgtgttgagccatcctgcccattttgagatgaagcttatcttgcactgtgtgaccctggccttgccagtgcattcctaaaatggaagaacagcaagtgaggcgtcagcagtcaatcacccgcctagcatgctcccatgctgaatgcttttccttttaagaaccataatcagatctaatgatttgcaagatagaaaagaacactctcatttatcttgcagagtgcatcaaggtatgtgggaaggatggagatataaatgcaaatgaccttgacaacaagctaagaaaaactagtcagaactttgaactcaatgatgtttaagaaagattcatgggttaagttgtacattagaagttttttgaagtaaagatatacaaaatagagtcttaagtcactccaaggtcaatggagtgagatacttactgaacatgagttaaaattgtttttttttctgatcatgcacattaagatgtgatgaatgaaaagtgtgctgcatagcatatgagagttgaaaggtaagtccaagacaccccctttgattggaccctttattggtacacttaatgataagtgacagaaccgcaactcaaacttgcttaaagaaaaaggaaattttaggtttcataaaattaagaagtctttagactggcactagtttcaggcacgagtatatccaaggattcacaagatgccattaggagcatgtttttctccctgcacctcaggtctacctgtctttcttgtctttatgctacattcttgtgcaaacatgttaccagcatgcctcccttgaactcagggctcctgaacctaaatttctctacatccaaagggctctgatgggcccatcttgggtcccatgccacttcctggactaaatagtgtgtctacaagatggaatattctgtgtgatggcaggcaggctcacctgatgagaagttctactagaattagggggaatagggaaaggtgctaggcagactgaaacaaaaaggaaggggaccagaggaaacatttcctacagatctgcatgtagggatctgaacaagacataagtcatctacgtggtttataggactgacaatgagtgagaattaagtggaaccttttaggttctgagatctctgtcaacgattggacaaagatgaaatatgaagtaggtttttagtttttgcataaaacaaatgcaattggttatacaatatttggggggaaagaatgataaaagtcaaaagaataaaataaaaatatgtaatctaaccaccataaatgtgtttggcaaatttttcttgcattgtatacaaatatgtgtttatgaatcagaattattcagtatctatactgtatttttgtttaaaatattgagaacattttggcatatgattaaagcagtctacaaaagttacaaaagttttaatggctaaataacagctcatctaatggatgtgtcgtagtccataatcaatgtctgttttacatatttaagtttcccattttttactttcataggtaatattaaaataaatattttgacagcacatctcgtcattttctgaaaattgaatccaactagttaaattactgagtcatagatatgaacatataaaagattttggtgtgtgttgtagcatttctatccataatattactatttttaccagcaatatgtggaacgatccttactgtttcccaaaaatgatgatttttcagctattatattgtgagatatatgaagcaagcattcttgtttcccccacaatatctactcttaaaatcacctagtaaacatttattaaattttaaagaatgggccatagcaagtatatgtttttaattctgcattacaaagccaaaagagagagtctgtgttaatgaagtaaatctctgcttattttaatatcagtaacactcattgttgaggatgtagagaaatgactcttctataaaagcatagtatttcatctggcaattgaagagatgtacatcttaaccccaaaattatttatttggaattatatccaaggagatgtttgatcaaatacacacaaatatatttgatatttatcaatgagatctttatagtatcagaaatcttaaagttatttcattacccatctctatttatttaaaatagatcctagatattcattcagtggatgcaatacagccattataaaggaatgccttgagttaaagttggctgtattgaaatcttgttccaccccagcccaccaaataccagccttgtgcccttgcacaaatatcttgtctgtgactgagttccgtaaaatttattttgagcattaagttggattttacatagaaaaaccttaccaagttctaatgtcaaaatttttataatttttattaaatggaaaaaatgttgatgtgaacaagctatcaaatagcatggctaagaatatcccatttacataaaattatatatgtgtatgtctgcatagagatccagaataacattaatcaaaatatgaattggattatttctcatttggagaacattgggtggtttttgctttcctctttatatttttctctattgcttgaattttctctataagtatttattatctgtatgatcataaaaaagttaataattgcatttactttttaaaaaagtcaaattatgtaagaacttctttagaaaggtctgtacttcataggtgactttcccaaagccatgatgccagattgcttcaggatagcatgagaacaaggtctactaatttttgttcatatatttttgttttactaatttttgttcaagtgcctgctatcagctaaaatgatcctgggcaaaaggaaccagcaatgagcttaggctacaacaattagaaaattccaggctttggctgggtgcggcggctcatgcctgtaatcctggcagtttgggaggccaaggcgggtagatcacgaggtcaggagatccagaccatcctggctaacatggtgaaaccctgtctctactaaaaatacaaaaacatttggctgggcatggtggtgggcgcctgaagtcccagctactcaggaggctgaggcagcagaatggcgtgaacccgagaggcggagcttgcagtgagccgagatcgcaccactgcactccagcccgggggacacagcgagactccgtctcaaaaataaaaaataaaaataataataataaataaaataaattaaaaaaaatttccaggctttgaagaaaaaggctagaagttctgccacaattagctgtgtgaccttgggcaaacctcatgatctcccagatcctgtcttttattttctttttatttccaattataaaataattatctgaaaccttctgtacttttaagaacataaaatgatccgaaaactgatgtatttatttatttagttgctagtaggtggttttaaccaaatctcaaaatactagccttggactaagtatttattcagagataagtggaggaattaggtggttgacgtgaatcttcaaaggatgaatttagttaaaaaaaaaaaaaggaaattagtctttaaaattatagagaatttatgatctggaaagtttgttcaagctcaagatataaatagatttcataaagtttcagataagtatgccataggttactgagattttattgctataactcttaaatttgaatcatgagaggcaatcatcgtcccttaacaccaagatcaagagccagaataaaaggggatgaaatgtgtgcaaacacgagctgtccattttgtgctacacaatagctgagtatgtgttgattctttaataagttcgaatgacgacatcaaaaatatacacagcctatgataatcacagccccgaacttggatatttctctaattatttttccttttctcattttactacaaaaatactaagaaaaatacatcctcttaggtacctgcattatactagttactatgcttaggggttacctgtattacctcatttaatccttacacttgactgctgggatgatgttattcctatttacttacaggagaaaatcaagaccagagaggttaagtgcatatacaaatccacggttggaagcaatcgagctggaatctacacacaggttcttctgattagcaatatgtcatccacagttcctgacatattgagctattgctatgtaatgaaggtcacagtgactactgtggagcatgtgagaaaatataaaattacttatctaactgatgagtctaatgaacaccagacgatgttctctacaatcggtttctttgatacagatacgtaactgacttcctttttaattgaacagaaggaacatattattgactcacataacaagggatactttcagaatgtatagtaatttgttctgtgcaagaaaacctgtttggggccacactttttttctgaagggtaaccttcaaggtattttccctgaaccattttttttctctacagattatagaggatctgaaagactaagataaagcactcccattagaagctgtgatgacagacgaacgagttgaatagtgacaggcagtgttgggtccttttcctatttctttcatgaaaatggaaccgtcgttcattcaaccaggagcctggtcaatacggtgagctcctgtgtgtgtacaggaaggggcctttgataattgcataaggcagacaattcatctggaagctctagaaaataagaggtggaaaaatgagctctcaatgtccacctgggttttgaaaaggtagatatttgaagttgtggcaggctgctttgtaattaaactggtcgctgaggtcagttttcatagcagtccaattccagatgtgatcatagcgtcatgagccatgcctttataaatgttacatttcctgggatcaaattatttgccagaatttacttcctaatttaaagagtttaaatgccacattattttgaatagtattttgctatactggtgtttttgtgtcatggaaaacagtcagagggcatggcatggaatagcaaaaaaaggaaaacctccttccaatttctgtagagcagaattcactgcattcgtatcctgctgtccagttttgattcaactggaccaatttctcttttagctactatgataaatgtagtgtttactgaaaaaagctgatcctattttctactctcttatatacctatcttgaagcgtcagaatgctcctgttatctggaaacataatccattatacatagaggttctttctcttctgtgatttgaacctagtctttaatttatttctattttgaactgaatgtaaagctgattacccatcagagaagaagactggcataatcaagtaagacaagggcaggctccttggaatttttcttggatagcttttctaatagactgaaactaattctgagactctacctgtcactatgcacagcgcctaattcccatgcagctgaattagtttgtgtgaaatactctctttctgaggccctagtcacttagaatttatctcagctctgaagcaatgactgttaataacctgaataattgtggaggcattcccctgtactaaaaattatacgcagactaaatcaccacaactcgattatgatggatgcaattaaaataaattatgtaaatgtactataagaataattagaactagaaatgttgatgagttaattgccatgtctatgtacttatgacacagaaatcgaagaaatttggaaaaaatttagattatcttaaagataaaacagatcaaaaagcatgaaaaataattcggtaatggggacaagagaagtctcttcttgacattcactcaggactttgcaaaagagatgaaggtcgcacaattcactacatggaatttagggacttgacaacctgaaggctgagtgacaaagaggcttcgtacaaactaaaggatgaattaggagacagaagtggctttactgctcaataattagaactttgagggaaatctaaggtcagaaagtaatggttaacgtggattaatatatattcaaaaaacaaacttttaaaagaataggaaacataacatcagtgtgaactcaggcttttgtccctcacttttaagctgtgtccgttgtctgaaagcattggcaaccctgcagccctaagtaccactgcagccctcgtttcagctctaaatacaatactgaggcaaatggtgtcatctaaaaaaaataaaaataaaagacctagaagccagattaaagaggctcctgcagacacaggatgagacaaattgaaaatcaaaaagaataatggctgcaactgattaaaacaaattatcgctccatcatttcataataacactcaaaaaaggttttaaaaatttggagcaatgaagcaaaatgtactagacacttttggaagctgctaaggcaccaattcatcatcatcttaaacttgatagttacagggaagagtaagcttgtattctgtccttttagtagaaattgttctttggactaaccaaaagaacttaagatatcagtgaagttttcaaacaggagaaatggtagaaataggaaagcatcattttgtaacttgcagtgaaacaaatttttaaaaacaaattaaaaggtaaaggtgtagttctgttactgctttcaagaaacaagggatatgtaaaaactaatgcaatgagggaaacatttttggatcctgattcaaacaaactattaaaaatattgtttagacattaggggatgtttgaatatgaatcatgtattagatgagaatatgggtttttaaaactaattttagtaaaagaaataatgcattgtattacataagaaaaaaaattttaattcatattgaagaatttgagtaaataacttgatatttgaagttttattgaaggtatcccagccaaaataaaatgggagcagggagaatagacaggaataaatgaaaaaaaatggcaaaacaaataatgtttatgaggcttagtgacggatccatgtggactatattttcaactcttttgcatgcttagaaattttcgtaataaaaagttttttaaaaatcaaaacactgtttaggcataaacacagagagacagacaatagaaggtaataaattaacgtcaattgccattatctattgatttttatgttccctgagatctttacataaaattcaaggttgtaaactctaaatagatgcctacacatgtagtaaatcgggtgaaaaatgagaagtagcagggagttgtgacctcaggcagaaaaattaaccctgctaacttggatggtgacagcttaagtgtatgagtgataagaagtgtcagggagactttagcatagtgacttggggcactgatcttcctgggcatcacctctgtaggggtgtcagacatgaggtagatttgaagaacaaaaacaaaaaagcatattcctagataatttgtcacatttcaaatgtttactgttcggttctgttctcaaaagatccaccagcgttaatagcagccaggcgcagtggctcatgcctgtaatcccagcactttgggatgccaaggcaggcggatcacttgaagccaggagtttgagaccaacctgctcaatatggaaaacccatgtctactgaaaatacaaaaattagccaggcatgatggcacaagtctgtagtctcagctacttggaaggcagaggcaggagaattgctgaacccgagaggtggaggttgcagagagccaaaatcatgccactgcaccccagcctgggcgacagagagagaccctgtctcaaaataataattaatcataataatattgatagcaaacagtagtattacggttaaagccagggccagcttcgtagccatccagttcgcactggttcctatgcttagaaagatcccacatctggtttagtgctgtgctgttgccatcttgggatttctagaaattttaaacaaggagcctcacgttttcattttccactcgacccttcaaattatgtcaaaagtcctggttagagtggcttatatacaaagtttgtagggagtagatttagtgaacttgatgaagttttatagttcattctcccgaaggagacttgttagtcactgaagagtcgcttcacagtatttatttttctttttaacttcccaactcttttggggacagctaagtaaacacagcctctagcagtatggtattacttgggacaatattagcttcataacaatgacacacaaaagcaacatccaatttcaaaacgtgattgttctctagatcaagaattttgttctgaaatataattttcagatataggtgtgcttgctgatagttctaaaatattgagcttgatataaaggcaaacctgtctaaacatatggaattcttttggtagtcttagccatgctaacaaatatgttttctgactacagcttttttttccccactgataaaggaatattttcaataaggaaatgatagcaagtcttgtagttactctttggtatttgcaaggtaataaccagctaacagcaatgtatcaatgattgcatttgtgtagacatcttgaccaaagtcacacagacagtagcagaaagtcacttgtcactgtgcagctggcactcttgcataataaggattaggatagccgatgttttgtcacagtgccaaagttaatcatggtctaaggacattgaaaaaaagctgagaagtgagtgaattaatcatcattaaaaacagatttaaaaagtaatcctgaaggggaacttttaagaaaaaaatactactttgaataatacaaagttctttcaatattaaaaaaatgaaagatgcttctagaagggactccttcctctaagacatcagtattataactgtaggcaggaaatcattttctagaaattaacctttcagggcaattccatcaaatcatgagtttttattgctccaaagaaataaacccttcatcagaataggattctggatccaagtctctttggcatcctccctttagtgtctttatcagagttagctacagaacattaaagttccagaatacttaagtcagtctgtctgttagacttggagggaggaagatgattatttaaatagtcagatagttgtagcatgaaaacaagttattaaacctctggttgaataacctctgaaaaaatgcaaatgttaactttgagaccgatggaataatgtcaccctacctgtttttaatatttgagaatggacacaagcaaggggacataagggtaccttcctcttgccccctgcaaactggctgccaagggacttgtaatgatggcagctgctttgggacagtcaggcaccaatcctctgcccaaatagtcatttgttcttccactcctaactctttgcttgcctgacattttctgagagattgcactatttttcttttcttatgtttttcactcattttaaagaacgcttttttctgaataagctgtttccttaaagtattcaaagaaacaaaattccaggcagaaggaaatttgcattctgatgttgtttagagttccaaagcctgatggatggctgccttctctgtagctcctccaagtcatttcagatctacaggtgcttcatggcctgtcctaaacctgtaagacttgaagtcttataggcttgacttgtaccttaatttccacctccttccatgtaaataaaataaaaaactaatgcctacattagcactggataatcatgaattgttgtttttgttctttttttttaacgtaagcaaatttaaattttctactcttatttctctcagttggctcttgtgtttctagacatactccatagttggtttccttagagcttcaggtaaaaatcttagcctggatcttaataattatacctgatggaccaagagctgggttcagtcacatattgtaaacaatcaaaagctaacttatgaacatatggcaaatgtaattctttgataagaaacaagacagcaagttgccgtcttgattacatagatgtaataggattattgtctttagctatctgttcttgaagtacatacgtagcactttatcaggaaggcccactgaaaaacaaacatgcaactctggaaagatagatttgcttcaaataattaggaaatagaaaaactgtgatgaaagaaaaatagggaatttatttacaccttcaaagtctcttagaatatgtcaagtaaaattgaaaacgaatcaaacacggaaaagaagcaaaattcttcgctgtaagatttcaggaaatacctagctgctaagattcagcaatttaattacaaaactggcacaaaggcacaatttagttgtggtgaggaaatttaattctcctaacatcagctaaaagtctgtttctcgaaaaattgggacacctgttaactgttttacttatctcaccgaaaatgtatctcttaaaagattactgataatgtcacactctcttttctttagttccaagaagttcatggcagccatcatgccaggcaatgagaggacattcctactgctttctctcccctaagctctggtttagtttctgatgccctgaacatcaaggaagagccaaatatcctggccaaagctagttcagctgtgacagttggggtagggagaggtgacgtagtaaggatccttgaccttggttttcagtaagttaattaaatatcttatgactggacatggtggctcaggcctgtaataccagcactttgggaggctgaggcaggcagatagcttgagctcaggagttctagaccagcctgggcaacatggtgaaaccccatctctacaaaaaaatacaaaaattagctgggcatggtggtgtatgactgtgggcccagctacttgcggggctgaggtgagaggatcacttgagcccaggaggcagagattgcagtgagcccagattgctccactgtactccagcctgggtaacagagtgagacactgtctcaaaaaataagtaagtaagtaaataaataaataaaattttacttctagcagccatgggcatttgcttcaggttattctgaagaacaatgctattctttttctttagatttccttccagaaaggaattcttcttagtttcccgttcaatctctcaaggtaataaggtatattttattaccttatttattgttttctatataataagcttttcatgaaggcttaaagagaaagtacaaattattattgtttttctttgacatttacatccacttactgttcctaaggacaattcagtccctcctcccatgcgtaaacctttctatctgattagatccaggttgttactgatagacataaaattattttataaaaagaaattatgttcaatgtaaaaatagtaatccattttaaattcccttcatttctgcagcctgtttctccagacaactcaaaattgtctgaatcccataagacagtttctctgagcatattgtttaatgagagaaactttagacattctgaataaaacaagggaattactgatgtcccaatgctctttgcaatgagtacctccggtttaccattgtggaggaaatattgcattgactttctaccaaaatccatgtcttatctggaagaatgcctactattcattgaaaatcatttccagacctcagataacacaaggaaccagactgccatatcagactcacaaaaatcagagctcttacaaagtatccagctttcctaataattcaaaggatgcagatgatgataaaggcaattcacaaaaatgtctgcgatcactagtgcagctcctcacatcctgtgccacacgaggatgtgggctggtccagatttaatgtttgaggtttctaagtgatgcatgtaggccatcgtttccacaaggaagccattgtggttacgaaacagctccatttgtttgctccataattatatctttgacctaacattttccactgggccatatcccacaaccccaggagttcttcattcatttgctgtaagcaacctagacagactagatacaccccgtaaaaaggatgccacagaaaagggtctcattacctttctgctagtaaataccttcaggaggcctgattagtatgtttccaaggattctttactgggtcatttctctctctctcttcctctcccttctcttcttggacgtcctcagagaagacacgatgggttactaaataagcccaaaccctttccttctcaagaaccatttctatagcaaatgttattacattatgaccttttttaaaaatgtgtgtgcccctctccatatgatgatttatcatttgtaacacactcagagtgcacaaaccatcagaaatccttatctactatggtaaaatttgagcttcacgggaaaaaaaaaaaagaattgaagaacttccaaagagttttcccctcgtctttgtgactggttgcttttactaccctaggaattaaatgtgatttttccctttaaacgtcagatttgggagtattgctccctcttctgctctcagcattcttactcaatgattagtcttcaacattctcacatactctcagccactttgagtaaacgaagatacatcattcaggagtgagaattaattgtaaacaaaatatttagatttaggaagattaaacatttttaccagagttatacattacagtttagaacattaataaatcattgtggctgagttttacaactgtttcagtttcatgtcaagccatgtagataatttttcctggccttctgctccttagaatgaccaagtcctttgaggctgaatctcaaggcaaatggagaaatttcttggttgaagtcaaaccagctgacttaggtagttcttgttcatcaatccattaattcaacaagttgccattaaaccttgtgctctgtggacagtattatcttagattttgggaatactgtaggaagcaaggcaatcatggttctggtcctcatgattctgacctctttataaagacctatagaagaaatcaagaaaacaaattcaactaaagtaattacaaattgtgataagccaaaggatctttgaactgggctttttatagcagttatattcttatgaggttattcaacaaagataactagcacacagaagaagattgcattatggattccggctgctggcattatagtatatggcttagattaattttcatgagattcccaaagaatgaaattaatcatccagtaccagagaaaatcaataaacttcaagctgctttgaaaatactaacataagaaggttaataccttaattgtaaagttatctgaaatggtattaatgacaaatgttttgtctcttagaatacacattggaaacttcctgaatgctgctgaaactgacgtgaattttttcctttgcataatttaatctttagatagtagattccaatcaagattttctgttccaggtacatctttaagcctaatcactttcctctttcctgcttttctcttcccaactccaagcacatgcctgtgcttataaaaaatgacattcaagttctgttttgaatagagtaaggctttagaggtttccttcaaaacagaaagccccgaagtgcctgtttctgtatattcctcctgtacatcctcctgtgcttcaacaatcaccattttaagtacctgccattaattcatccaacccttaggtatcaagccccagtgctgtagaaggctcaaactaggtggttgggggattattgtcacagatgctgtactcgaggaggatataacttcatggggaatatataaataataatagcaccataagttatatcttatcaggcattgagctgtaagattggagaggatggtaataattgtgtatattcaaagtaacacctgaagatcttttaattaatccacaaagcacagaatatacagttctactcacagattaatgatgatctaatgaatccattaaggctagattttcctctgtcgctggaacaaagaacagattcttcagtcaagcaccaaatagagtgggtggctatgtttatgggctatggcatatgaaaaaaaatacatgcatgttaatgcaaaagtcagtcttagtatattaatacagtattagtatattcatatactaactccatgagagacacagggagctacgatgaagacaaaagtaaacttagaatttccatcatagtctcactaatatttgaagtgtatatactcactgagtagatcatgaacacatttatttttctctaatatgtttctctctctctctctctctgtctcacacacacacacacacacacacacacacacaccattcgggtcaacagaaacaacataagaaaagtttcagaaagcataaattaagtgacatcaatggagcaaggaatatatgcaattagtaatagaaaatagtaacaaagtatagctgaaaattcatatagaagaccatgaatattaagcaaaatttggactatattcagtagtttatgtaaagccactgaagatttttgaaacagatagtgacattatgagtttgctgaaaggcaaacaggatgagttcagttgtaagcctactgaatctgagctgctgcggaggcaattagatgcactcatatctagctactgggaagtcctaactagagatgaaggctgatgagccatttccagatgcttttttttttcaatctcttcagtgcctagaacagttccaggcaattaattaactggaattaactgttaattaactgtgctcagtaattaactactgaattaatagtatttatgatattaaggatatgatgcatacataactaaacactgaatggaagaatagatggatgtataagtggggggagggagggagggaggaaggaaggaggaaggaagaaaaggaaggaaggaaggggaaggggaagaggaggaagggaaggaagggaaggaaaggaagaaggaagtttgcctcttgaatttttctagtctgaacctttctactaaatatctattgtgttgttcgacagttatttgtaaacatgaggtcagattctgggcaactttaggcatctcaaaagtttgttgtatgtgcaatcaagagtaaagatccggctgggtgcgatggctcatgcctgtaatcctagcattttgggaggccaatgtgagcagatcacctgaagtcgggagttcgagaccagcctgactaacatggagaagcccccgtctctactaaaaatacaaaattagccaagcatggaggcgcatgcctgtaatcccagctactcgggaggctgagacaggagaatcacttgaacccgggaggcggaggttgtggtgagccaagatcatgccattgcactccagcctgggcaacaagagcagaaactcagtcaaaaaaaaaaaaagaaaaaaaaaaagaataaagatccatgagcagccaatgattgcagctgtgattgaatcactttagttatgagatgcaggctgtttggtggtgaaagctgtggtgttgggagaaatgagagggagaatacgatactttacaaatttttctttttttttttttggagacggaagtggcagtaggaattagaagagcatcttagcagggcatgccttctgacagttgcaaagaagagaagcagctaaaagaagactaaaggtagaacagctctcctctctggggaggcaaagagccgttaaaagttgtcagtcacttctaaggctagcactgtgtttgtgtttctctgaagacttattacatatggcaagttctacgaactggaaagggggtcagaaaggcattgactataagggcaagccaagcccttcttgcttcagtagtttcctggggcatgactgttttgagacagctgaacacttcagtcttcactctcactacccaacacagagcagcagtgtggggagctaagtcaagttgagaagaatattcttgcttgctggactgagagcacaagcctcaaaacagagttcagaggatgttagcaagtatctggcatccctgccttctaacctgcaggctcatcttgctgataaggtgcgtgccattccagttcctgggatcagtccagtgctgagtcaaaacagaaggagctcaaatttactcttggttgcaccctgacactgtgatttctgggttccagcctttattctgtggccgtaccttatactttacctttgctgtgtccatagctttttcccttgttctcaaatctctatctcgtgtattccaaccctgtttgctatgggttattttcttaggtacttggtgtcttgccctacaccatagctcacaggtggttcttggcacctgccatctcagccaccagagcccagcctctacagtgtagagtccctccatctaggagggtcaactgctcctcagtggcccttttatttggctattctattactccaactaaaactctcctgctcagctacacctcatgtctaattttgcttccactccaaatacctaattttcagctataagctgaaagcacactccaaatacctaatttcactcttgaggcattttcaatcctccctgattttatcttctctgttatcacctggattcccagattgacatggagaaagctatgatatggctccctcctatttcctagtggaaggcaaagggtgcctgaatcacaaagttatgttaaccttaaaattgaacatagaattgtctacataaattcaaaaggttgaatgtaggaaaaaaaatggtgagtcaatataatcttggtttatctctgtaatataccattaaaactcactgagaaagatcactagttaaacatattgtaaattctggaaacaaaagctgctgagttctgctgaaatagcccaagagtaaatcacaacacctacaagatgttttatgactaagttaatttttttaaaaatcagaagtcatcatatctctgcttggtgctaactaaaaagccagaagttttggtcagaacaaatgtagttcacaaacactaaggttttggttgttcaaaataaatcacaacaccagaaacttagaaataataaatataaacatagagccctcttttgtggcttttctaaacaacttatttctgataacttcataatgctgctgaagctggtcgaatttaattatgcttgtaaagtctactcatttgtacatgggtaagtcaaacattctggttttaaacagagtaagaatagttttctaaaatatgtagtcagtcatgtcaaacctctggctaaagtactgttattttggtgcacatattctgagtttccatgaaacaaaacattcaacacctatgatattttatcatactcagcagttcaaaagtgccattcatttctgaagagcttgcagagtataagctccatgagagagtggagagagtgcttcaagatatattctctctgtacccctaccagtgcccatctagaagacattcagtaatcacatggtgaataaatacatggaaataaagtttcatatcaattaatcattgggcaagagaatgttttctggctgctttgtccattgttaaatctactatgagaaatttaaaggtaacaattaagatgagacccagaaaagcactcagtgtcatgagtcagcagaggaatgtttttgaaaaccacagtgatataccatgatgcatcccagaatgcctaaaattaaacatatcaacagcagcaagtgctggccagggtgagaaatagcgagttatacatcgccgtttgggatgtaaaatgttatgaacactttgagaaaccatttatgattgcgtataaagtaaaaaaaacatgtggttatcattatgatacatctattttattttcaggtgtttacccaaaagaaatgaagacatatagccacataagaacttgcttaatttgaaatatctcctaattataactaattcagcagtttattctaaatcaacatggaaatgaataaacaagggatgatatactcgtacaatggaatactacccagccaaaaaagggaggaaagaacaaactgctgacattggttacaatatggatgaatctctacaacaccatgaatgaaagaagcaaactcaatgtagttgacactacgattttatttatatgaaattctagaacaagtgaacctcatctatagcgatggaaatgagatcggtggtaggctggggccaagggtagacagaattgaccacaaagaggcacaggaagtttttggggttgatggcaatattaaatgtcttgattgaggaggtgacacagatgtatgcatttatcaaaactaattgaactgtacactttaaatgagtatctcttatggtatgtaaattacacttcaataaagctgattatacactaaataaaactaagacaaatttggaaagttggtacctatgtttataattatagacttttaaaatatattctattatgaataatgcttttagcctatggaatcaattcttcataaaaactcattacataattttttgatattgcttgtaaaatcattcctttagacctattgagtaataacggtgtaggtgaagtagaagaaaggttatatgttaacaagatgtgtccaggttgatcagtatcatgatttatagtcctcctctggtatccgtgagggagagggagagaagggggtagatattgagtctgattcatttattgacatcattggaactttctggattgtttagtgtgcctatggtcagtcttaatcctagccttaatcctgaacttttcaagtacttgaagcaataaattctatttttgcttaagctaattcgtattaggtctctgttcattaattcttttgtacaaaatttcgaaggaacggaaaatttaatgcattaaactacacataaagtttggtagatattttcccccaaaatactatatcttgttctttctcctgtatccctcatctgttctaggtaatcaactaatagttttttatgaataagaattaaatgtttctactttttattgaaagatttcagattactgaaaatgtgacaaaaaatttctaaaataagcatagatgttccttctatgaaaaaagtactgacaatttatctgttgttaaatcatcaatatattgtaccagataccattatttactccctattgacttgttgaagtttaactaaattaactatacttaatccatttctaccctaaacatttatttgaaatcattactacattttaaaacagttgcttgatacaaaagtattttctccatataaataagggatacctttaaattgtttacatttgtaaagtacaatatgtaaacagaattttgaataaattaagaatattttcactgtactacctaaaagcaaacaaacaaacaaaacaaaacaaaacaaaaaacctcaaacgcttctcagacttgcagtttgagctaaataaaccttctttattttggtgtatcactgacagctctgagttgactccaggacaattagaaagaaatttccgtaatacatataatttcctaaggtacaaattttgaagtaaataatggatgccacaaatgtaagttggtcacttatttcttttttctcttgtccattatcttcagatgtgtaatcatttgcaaatatatttactttcaagaaaagccctttttattttactgcttattattactgccactaaataatattattgtttatagggctgtgttctatgctttaaatgcattattatacttaattttccaaacatacatgtaagacagatggaggagattgggagtaccgagagaatgaaaggtgaggctgaatccatagtgtttgcagtatccagataggtgaagtaagaggtgaagtgtcttcatgtgagaaagaattggtgtacttttcagagaaacaaaggctttcttacaggaaaaataagccacagttatagttgcatcatttgtcaagagatttctaaagaatctttcaagataggaaatgagagaaagagaaagaaaggagattatgttttttctatgggagcctgtaaattgaactgaaatgaacagtccataaacagaatggaatatctagggtctggatcctagttccaggcagcttatcacctgctcccaggcagcagaagaacctgaactattccagtgaggaaacaatgctttcactcttgacagtcttccctaaacagtagcaaaaacttcctttcagaaattgaccatgatatcctcaaagttttggtatcaaaaggttttttatctaatgtctcatctgaaaaggttgaagatcacagaaaaatttgagtacagaaatatgtttacaatattactcatcagaaaacatatctatagaggctaaaggggttatgttctgctgctttgcaaaactcagagaagctgagtgggaaggcaaagagttcagatcctaaaatgaaaatttgtaaatcgggaggaagtgtatggctgaacaattcatattaaaatgtatcatgaggccaaactttttaatagtaatctattcatgtcctatatgtaaactctttactatattagtgcttagagcataatttgggcttaatgcatatagattgattgagtgactgaaaagataaatgggaaaaatagaagaatacttttttattctctttctgaacttttgtcattaaaatgtgtatttatttcttatgttcccactgtctttaaaatagcatttctttaaagatgattcatttgaggccacttgtaataggacaaaataagcaattgatgactgatgtgcttattaatggcctcgggtgtcacagaaaacaactgaggcttcaggcaattcatctttaatggcattaatgataccttttgaaggtgtgattactactataaaccagagtcagttgtttatttcaatttattcttcagtatgagctacaaaaaattatgaactgaaaacaatactttagaaaggcagatactcttaaaattagcaaatagctttgctaaattataatataggtcattactgaaaaacacagatgtaaaattccacttcaaagaaggtactttattttccttttccttctagtttaataggagaaataagagattcttgcatcattttaacaaatcaaaatgcaattattcatagaagaaaagcaacatgttaatctttcttaaatttcttaaatgagtacttttggaaatgaaaatgaaattatattagcaaaaatttaattagcacatgtggtgaaagattttatatgattcagttagtagatttggtcaatttatgctaattggcaagtaatacaatagaatcaaattatgtatcatcagaataaagaggaataaacattacaataacatttttcaagtatactttccaaaaggtcatttttaaagaattcgccccttctgaacagcacatactatgttcgctgggagctgaaagagtgtgtcagaattatctggcacttaaacaccagcaaggtgtctggaataactttctcacaagaacacggtgtaaatatcatttttcttctgtttgattattttgaaaaacatgcatacttcatgtgaactatagtgaagtgtctgattatccaaagaaaaagccaatatttgaaaaggtgttattcacaatagagccaaaatagaaacagggtaaaattttgatggaataagtggtagggatgaaggaagagcacagagactatgcttgcatttaaaggcaaagcatacagtaattataactatatttctaggtgaagaagctgtggatgactagtatatttttctccacaagatatctataaagaccattgtttggcttgtattaacatttttgtttgcataatctgacttgggcaagatatgtataagaaatgcttagctataaaacaatagactaacactgggagagtatgggtgatggagtcctctgggttacacggcatgctgtggcatagtgtcctcagctgcaaattagagatgatgatcgtaaccaatttctaggagtgttgagattaaataagctagtacacgtaaatcacttagtatagactcaggaaatgttagctcttaatattttgactctactgacttttttcgtttatttttcctcaacaaagaggacatctttaaagatttgttcattgtccttatgtgtgtgtgtgtgagagacacgatatacacctgtccttttgagcaagagtcaaattctcattgaggtcaaggtgtaatttgtagttcaattccttattcgtaaccattgaatgtggctctgccacaccaaggtaaacgtcttgctgtctccattatgtgcttgggttacaggttgattacacgtgatctatgataatctacaatctatagtctacactactatagtgttgttgtttttttaaaattatttccttgcctaaaagttctatttcaaagttgcaatactgcaccataggtttccctctactttctgtgtaacaagatgagaaaaaacaaaagagggaggagtggggaaatggataagataaacaaggatttttagtttccaaagaaactaaaaaagtcattatagaattaaaatatgcgctaatggcgataaagagtagaatggaactgtttgtgtatttgctttgtggctttctatattttccaaatgttttgatttactatctcagaatagacttagataataaaagtaacaaaaagaaaatgagatttttttaaaatatcttcacaatgatataaaaatatcaagtaattctgcataatctaatggatgtgttagttctctaggggaaaaagtataaaacttaatgagagatataaaagatcgaaataaatagatgaagtgtgatcatggattggaaaactgaacattttaatgatgttactcttccaaaattgatctgtagagtaaatgaaatagcagtctaaattctaacaggcttttctttggtgaaaataaataagctggttctaaactgtagatggaaaagcctagggccaagactagccaaaacattctagaagaagaacatggaagaaatctttctaccatacataaaagcttattgtaaagaaagaatcataatgaaagtgtaatttggcgtaagaataaacacataaattaatggaatagaatagaggactcaaaaattgatatatgcatttataaatgctagatttataaccaaggtagtgacaaagagtagctacagtaaaaataactatgttttaataaatgaggctgagatgaatcggtgtacatttgaaaaaatgaaattggcctgttgcatcacaccatatacaaaaagcaattcttggttgatgacagattgatgtgaaaagtgaaaccataaagcttttagaagataatataggaaaaatcttaataacctcaggttagaacatacttttacacacaaaaaagcacacatcataaggaaaagaactgaagaactgtgcatgaaaagatgctacaaataaagtagagaggaaagctatagaattaaagatattagcaacatataactctgacaaagaactctcatccctaagggggctgaatgagcctttgtggttgattcgtgggtgacatttctaaggcagggaggctacagctgcaagaacaaagtgcctttctattttgttaggccagtggatttgctttgcttcttgttggccttccacatagaggccacaggggcattgtacatagttgaaatttcgttcacattctgacattatatagggtttcatttctcctttgcagtgctgtggttttcattttttctttgtgtcttcatatgtgttttaggcaggatttgaagttgtctggctcaaacttcaagtcagatgcggtcttaaccctttttttttctgttcctaaaatctttttgtaatctttactgtagaattcttaatgttgacataaatttatgaatttgatatattttgtgttttcctatattctctgaaaattatatcacaatattcttctgtattgaaagatagtcctatataatatttctaattgaataattacaatttctttgttcaggttgtaagctaactaatttaccattcccttatcctggggcattttagattccctttttcataaagacaaaaaaaatttcagtgagagacttcttgaataaaacttacaagccataaaattatattttagataagttctctggagtaagataactaggtcaatgtgtataagtaattgtatgcttttaaaatatcttgtaattggccaggcatggtggctcacacctgtaatcccagcactttgggaggccaaggcgggtggatcacgaggtcaggaattcaagaccagcctgaccaacatagtgaaattgcgtctctactaaaaatacaaaaaccagcctggcatggcgcctgtaatcccagctactcgggaggctgaggcaggagaatcacttaaacccgggagttggaggttgcagtgagccgagatcgtgccacagcagagtgacactttgtctaaaaaaaaaaatatatatatataatatatatattattctctctctcgctatatatatatatatatatatatatatatatatatatacacacacaaaaaaaaaaccacaaaagaggtgatttttttccttttgccttgtttctcaactcacagagttgcacagctgcacagttccagtacgtgaattgacttctactttaatttatcatacctgattcagtaagtgattctgtaacctttactttcaaacatctctgacaccattgccttctttcttctccattgtcaccttcctccccagtgaacagaggcagcagtaacctaactggactctagccttgcactgaatccttcttctagcctcagactacttcacattgcctttagagacatctcccacatacagtcataaccatgtcattccacaccctaaaaactccaacggttctcacacaaaatagagccagtccttagcatgtcagaacttccacacttgattcagccacctcatcagagtcatatccacaccctctttgacctgtgatcacacaagtgaattagccattcccctaaaatgacttaattacaaaccatatcccaccacttatgagactgtgcacagtctctaccagattttcagactttctttaagaaagttatatcttaatcatatatgaataccctcatcttcaccaccccatgcctagcagaaggcctagcatgcataggatctttttagctataactaaaggactgaattgaactcaactggattgacggatgaacaatccttactcaaaagatattgaatgttcagtatttttttaatggaagtaatttatgctggtgcagaggtctctttatgacaagagcccatctgagattttgtaggaacacttagaaaaggatagaagtcttgttcattacagaaactgataacacaaactagttagttataactagaggtggtgacttacacctatagccctagcactttgggaggccaaggcggtcgatcacctgaggtcaggagtttgagaccagcccagccaacatggtgaaaccctgtctctagtaaaacaaaaacaaaaacaaaacaaaacaaaacaaaccttgaaattaaagataaatgtgctagaactagtcatcaacatatagtccaaaacaacaactaattctgctctctcaattttcaaactataaagaaactggactaccttctagaaacttccaatcccacataaattcaagccctaatctcttacctggactgtggcagtatactacctcttaactgatccccttccttcttctttgtactctccaaaatattttcagtgccccagtcagagtgatcctgttaaaacattagccagatcttgccccactctcttccagtctaaacttcctaatagcttcccattacactcagagtaataaacaaaaaattttttttaataatcaaccagaacctaaatgacttgattctcactacctcttaaacttcatctcctactaccttaactttcatttactgtgttccaatcatattgacctctttgctgttccctgaaaaatcacccacttccctacctcagcctctttgatttttgttgttttctctgcttggtacgttctcttctcagatatacacacaaccacttccttacttccttttgccatctaaaatttcgactcctcctgccacagtagttaataatgcccttttctgctttattttggtctcttggcacttaatgctatctggcagggtatagattttactcttatgcattgtctgcctcaccaatggagagtaagctccatgtggaaatgaatttttgtcatttttgtttattaatgatttcctgaaacctaggacagaacttaaggaatagcagggaattgattatgaagtcaataatgagcaaataagaaattccatggagaagaatttgctttttggttcactacatgacatagaatgagacagatatgacaacatggtttaaaatgtttaaaaactgagagggttaaaacaatagaatttcttgatggaaattgttatggactgaatgtttgtcccaccccacctccaaattcatgcattaaagcctagctctgtatttggagataaggcctttatggaggtaattaaggttaaatgaggtcataagggtagggacctgatctgctaggattagtcctcataagcagaaatgccggagagctcactggctccctgccatgtgaggacacagcaagaaggtggccatctgcacataagggagagagccctcaccaggaaccagattggatggcaccttgatgttggactttccagtctccagaactagaagaaataaatttccgttaagacacccaggttgtggtatcttgttacagcacctgaaggggactaagatagaaatgtaccttaaaactaatctaacctaagtctcttacttaaaggataagaaaactgaagccagagaagttaagtggctttctaaaggtcacaaagtcagtatataccagaactaaacccattaaccacgtggcagttcagtgctttctctacttactatgctgactcttataccactctatgtagtatatgattaacataaggcagacattcttaaaccttattctcatggaactctgttcttccaaaggctgtagcaggcattttgctattaaaagttaagggtgatggtcttttcacaatatcttatgggggtatttaactgatttttttcactacagttttcactacagttttgtgttttttgccaataaatttttcttttcctataaatacaaaagaaatatatatatatatttatatatatatttataaatatatttatatatatatttataaatatatatatttatatatatttataaatatatatatatttatatatatttataaatatatatatttatatatatttataaatatatatatatttatatatatttataaatatatatatttatatatatatttatatatatatatctgaagaaattctgaaccataattctctaaaagtaattctgtcctttggagatgtagtaggatggatacattaaatatgggtaaattttctgctggtacaattgatcctaattcaaatgacagaattaatgctactcagaattttattgtggggatcagaaaagtcaaaaagagtcccttgacttttcagagccctgcttcctggacttgtttgaaaggcactgatgtaacagcatgacacagctgctcaaaagctattatgagcctaggctgaatcaatagaagataagtgtgcaaatcacagagatctcagtccctctggacttggcactattagaacatgtgcatgttattatatctatctgttgtctattcctggatcctatctttaaggtgttactgactggcattcatgggtaatgttaaaggaatagggaatagtttgggaagtgatgacttaggggaataagaagctgttttcagaactttgaagggctgaaataatgagggaatggatttgttttgtattgtttcatgtgcaaaatcaagctctgtgcacaaacactgcagagaagtagtttttcactcaatataagaccaattagagttgttatccctggaactgttccctagtaaaagtaataaaatgtgttgaaaagtactagaaatgtaccagccatcaatccagaatatacagaggaaatcctgtttaggaagtgatttaaaacagttgatctcaaaaggctattacaacacaaagattctgcccttctatgaatacaaagaactggattatttattataacgaatatgttacaagcaagtgcaatggctgggttttttttttttttttcatgccttgtaaaggggaagagggtaaaggtagaaaggccctggatgactaaaatgaatgtaaaaggaaaaagaaaaaaaatgaatgaagaggaaaaaggaaaagaaactgtaaatgcacaatttgcctaagtcttggcctgtttttcaatgagaaactctgcactgagataaattctattcctggtggctgcccatgcacacacgtggattaatgccttggctgtcttaaaaagtcagctacagtctctgagaccctcaatttttacttagctgctgagatattcatgaatgctatataaaaggagaaagaaaaccattagaagaaatattttcaaggatgatatttcaaattattgcttatttaaataaatattgctaccttacattaaagagataataagatactaaaagcttgaaaattttttttgattctaagagcaggtagaacatacttatccttaaataacaccttttccttttaataacatctaagcaatgagatttttacctttttttcttggtggtttcttctttagtcatttgtttctttctttaatgagtccttcctaatgatgttttatttttcacacttttatctgttttctctttttattaatgcttatagtattcatttttatttttgtagtatattttattctttttctcttttgaaaagtcatacttgaataaagtacatgtctcaaaaaaagacaaggacttttgcattttatattgattccttaattttaaaatttttaggttaagaataattctgtactatccataagtattgctttatgatgactatgcttaagttgttggtatatgttataatatagcatttcaaccccaaatacagatttctgttctgtactcttgggaatttatggaggaggagaagacaaaatttaccttcttcaagtctaaaaattatcacatttgggacacataaatccccatgtatctctttaaggacagcatattatttttaaaattaaaatataaatgtctaaagtagagaaaaaataagttcaccttgtccttatatggaaattaaagatggttgcttaaagaataatttagaatggcaaatgtctgaaggtttgctgtaaattccctgagatcttatatgatgttcacaccgactcagacacatacaaatgtcatctctacagaacggccctgaagagagcaatcctgggagcccggttcccctgttgaggcccctacttgggtcagccctatagggcagcagcttgtacactgggccctgctccccttccctctcctactgacttcaattccattgttttttcaagacctttctaagtggcaggaataaaactgatgatttaatctataccaagacattaatgattaatagtggccccatatattttcccttacatttaatgtttgtattataagggctttttatgccttagctgaaagtggtggtaggaattttaggcccacatcatacacacatctgcaaataaccaatctttttctcatagctataattatgcattggcattttatttacttcctgcaatttctctaagtgcatcattttgttctatatatagtattttaaataatacatctttagcctgatgtatttttgaaatatttgtggatgctaatcctatctctgtcacagagcttatttatacacacacatctttctcctcctgccttaaaccccttggtttattcttcccttgttccagtttactctcctatggaactttttaccatttgatgagatatttttaaggaatttgcagataataggagcttccagaataccttcacctgactcatgcttcggcataaagtccccatattatcccaaaactcatctacatgtttagttttcaattttcttatagccttttgattacagtgccactgaaaatatgtcatatttattgctttatccactgctttctgaacatagacagagacactgtaatatttttctaatactttggaataaaaagaagatagattatttgttgaataaatatgtaaatactaaaacacaagttactttcttgtcatcatgctatagtcttcatatgctttacacagagtatgatttggggtaaaccctagtaaagctgaggaacatataaaatgttcaggaatcacattctggaataatcatttaatgtttatgccatgctaaaagagttgggactattatctgtggaattaaaatttggagaaaagaaatggtaagattagcccactgattgataagccagaggtagcacctgtagtttcatggaggccacagctcagtgatacctcggtccctgaactggaaaataaagctaagcttccatttgcagatgttccagaaaaaaataaattttatatttgtgtttttactgtatttttggtagagacggggtttcaccatgttggccaggctggtcttgaactcctgacctcataatctgcctgccttggtctcccaaagtgctgggattacaggcctgagccaccgcgcccggcctggaaagaaagaaattttatgaaatcaaaggagctgctatatctttttcttttgtaacaaacataggaattttcttactggaacaaacccatagttgacctcttatagtactctatgtgtggaagggagaaaacattggtacttctacaaatgggtttcaccaccttttataataaaaacagaagatattcacaaaaatagctaaaaataaggctagcatgagaaatacacaaattactctttttctattatgaaattagcatgcaatctttttttttgtaagcaatccaaccatttcaaagagggtgtaccctccagataatagtgaataaaaaattcagtgaaagaaagtaagcttatagctgctataattttcagaaccattatgcatcctcttgcagctggttttgttggtgctgctaagcgcatcctcctgggcccatccacttagtatttatgggcatcaactaaggattgaagacgggagattagaataaatgtaaatcttagtggatataagatttttgatgaaaatgtttaaacggtacttgtatgccacacaagaccaatggcaattttcatgttggtcgtaatgtttataaatttaggtatataaatgaaggagaaacgtagagtagaagaaaaaaagatctctgtctttacatataaaagggctgaaacaaataattactctttatgctttgtcagatggtttatagtttattatgatcaatgtaatctcattttttcaagctgttttttagcaatcccgaagtgcaggaagatacacgctgttgcaaaactgttaaatgactgaatcaggactccaagccatgttttctgacttcaagacctgtatttaaattcctatagtattcttggaaaatactagactcagggatgttttcacagagtaatatgttttgaaaaatgtgtctgcgaaactgccttaaaacttgctatctcctgcaagtcatctggagttcaccagaagtctaccttttcaactagtttccttatataggaattttaaaaagtgagcagaaaagcatcacactttacttttgagaaatgtgaggcctccttgaaagcataatctattcccttttaacaaatacatagctcacagtaatgcagagtatgagactaggtagagtgattttagatgtagttatttttcctatttccttatgccacaaaatcattttttcacataccttgtgtaattcctgtgaatgattttcaagggatcttttggcatgtacaattatttatcatcaaatatttgtaaatgaaagttctagaggatgagacagaatatagacagctaatcttacgactgctctgaatgacaggcacagaggcaacacagacatttctgaaggagcaaaatgtcagtctgcaaaattgcctttcctagtttgatattggtcctcactgctcagaaatgaaaacggaaaacattcacgaggcattctagtataattgccagtggctgcttcactatatacagttaattagtatatgcatccatacttttaaaaagcaatacttttacattaacaaaccaattgttaatttaaaaattaacaggttttttttaaagttttaatattataagaatatttctgaggtcagtatttatacctctacagatctacatctagccacagaaaatccaaaatataatttactttggaaataaagtttcccatctgctggtccttaagagtaattgctggtttcactttgaattatcaaaatgacattcaggaccaaaaaataagaggcatgaaactactttcattgctactgtcagcaagtgaatgattcactttgaatttgcctgaagttgtcttacagaacacctgtccaagctcattccggttccccttttgacgcttttcttcactcctctcctagcaaataaatagggtttcttagtctaacacaaggaatagaagtataagaagtggggtctgctagtaataaggcttcaggtatgtgccttaggaagtgttttgtttgtttgttgaatgtgaaagacttagccaggaagggagaataccatttgcatgtataattttccaggttctgtttaaaacaggtattcttttttctacttccaagtgaggagacaggttcctctgaatagagaaatcctacactctgcttaatatcactttctgggacaaatttggttcttatagttctccagtggttacagaatatcaaatgcagcaaggaccctggagcttcagtaactattggtaacttattagttgcctcttttgccaagataatggcaaaaaggaaataatgaaaatgacatatttttatatttctgtatggcagtgctgatattttcttagatcatttttctaatattagaggagctctttatgttgccttatgactgctgacatttcatttacttaataaaatcaagttagcagtagactgttgtagaaaggtagctggacactaagtagaagaactgggctcaagtctcagatttgtcccttttgcctgtggtaatggcaaataagtcacctaactccctggggcttacactgctcacccttgagaaaaagagattggacttgcagcttttacagtggcagtggacatggctagagcttggatagtgctgacggggttcaggaaatactaaggaggatgaagctttgcagatggtaaaattattaatctatgcaatcttcagttatggcatcacctgaagactctcagaatctccagttctatacttaatgaatgactttgaagaggaggatctatcaaaagactggatccctctgcatattgtttacaatcaggttagaacttagattaaatctcaaggaaaacaagactcctaaaagcttactagtcaaggaagcctttcatgcacctgatagaatcctccattcaggccgggcgcggtggctcacgccggtaatcccagcactttgggaggctgaggcgggcggatcacgaggtcaggagatcgagaccatcctggctaacacggtgaaaccccgtctctactacaaatacaaaaaattagctgggcgtggcggcgggcgcctgtagtcccagctactcgggaggctgaggcaggagaatggcgtgaacccaggaggcgaagcttgcagtgagcggagacagcgccactgcactccagcctgggcgacagagcaagattccgtttaaaaaaaaaaaaaaaaaatcctccatcaaagttggggtgactatgaagtagaatctctaaagggggccaggatgttgattttgttccagtgcgtgtctaatacccaatcagaagattatagacatctatctcaccatttgagtaaatgcaaaataaaaataaattactacgaaacatttgaaagttagtgaataaaataggttgaattcagtaagtgctaaggtcatttctaggttcaaatatttttgcaaaatcaggaaggtgcaaaggcaaagcacaagcgtgctaacagcaaatgtgaaaagtatgtcttgcagccaaggcattctatttgtattttgcctgtgtcttagtccattagggctgctacaacaaaataccttaaaatgggtaatttataaataatagaaatgtattgctcattgtttgggaggctgggaagtccaaaagcaaggtgccagcagattgggtgtctggtgggaagccactctctactttacagatagttccttcttgcagcatcctcacatagcggaagtggtaaagaagctctctcaggcctcttatataaaataagcactaatcgcattcttgagggtggaatcctaatgaccaaattacctctgaaaggtcccaacacttaataccattgcattaggggttcagtctcaatgtataaattttgaggggacacaaaaatttagaccacagcagcctgtttatgtcatttcctctgaaccataatcattgctccacccgctaattttactctctctctcctctgccttctcagctatctacaatcaggttgtatagtaactatttatgtgctaatcatctgtgattgtcaccttagggtataatcaagaaaatgatgcataatgttgggaaataatactgcagtttaaatcatatccatattatatttttaagcaaattaagaaatttgaaaccatgtaattagaagcagtatcttcttatctctaaatattcaaagtatggacagtgccaggtacattcacagccattctaatatttgccaaatgaagcaagcctttttcaaatgaaataacgtagttttcacttaaacaatccctagtgtgaaatcaagaaaataatgcataatgttggaaattaatactgaaatctaaattatatcaatattgtatgttttaggtaagttgggaattgtgtgcccatgtaattagcgagttcataaaattatattttaactgcttttccttcaaattgtaggcttttctgagagtttagttgctattgttgttttgtcttcattgttgtttgtgaatttgcaagcacattttaagttttccatttaagaataagttgtatagaaatttaatagacttactacaggtgtccatattacccaagcctctgggctgtttggttctctccaaatagaatgttgagatcaaaatcctttttggtgcttatattagttttctaggactgatgccacaaagtgccacaaactgggtgccttaaacaacagaagtttgtcacctcacagttctggaggccagaaatttgagatcaagatgaccacaagtttcgtttattgctatagacaaaatgtgtcatcccaaaatttgcatgttaaaatcttaacattcaatgtgatgatattaagaagttgggctttgggaggtgattaggtcttgagagtgaagccctcataaatgggattagtgcccttataaaagagaccccagagagttccttctcccctttttgccatgaaaagacacagcaagaaggctgctgtctgtgcaacagtaagcatgccttcaccagacactgaatttactagcagctgtaacttcaacttcccagcctccaaaactgtaagaaataaatttctatagtttgcaagccacccagtttatggtatctttctacagcaacatgaatggactaagacattcctcctgagactaagagaggatctgttccatgcctctctcctggctcctggtttgctgggagcccttagagttccttgatttgtagatgcatcacttcaatctctgcctttgtgttcacatggaattctctctttgtgcatgtctctgggtccagatatcccctttttataaggacagcagccatattggattatagctcaccctgaagggctcgtcctaactacatttgcaatgacctgatttccaaacaaggtcatattttgagatatttgggattagaacttcaacgtaaaaatttttggaagacactattcaacccataacaatgctcatttgttaagataaaaccaaacaaaaaagaacattttaaaacacaaagattatcttcatagccctctacaaactaaaaacatatatatatatatatatatatatatgtaacatataataacatataaaagcataaaaatatatacaggtttctcagacatacacattctcttaatattctgggctctggactaatatatatatatatatatatatatatatatatatatatatatatatatatatatatgagtttttttgagtgcaaagagcttgggtgagcagagtgggaaatgagatgaaagaggtaaaagggtcttggttttaggaggatgggaaaccactgaaggttttccagtaattgaaggttttccagtagacatttgacatcatcggatttgtgtttttttatatatataaatatatatgctgattgcaatgttagaactgataaaagccaggcttaagtgattggcagactgtggtagaagacagctgggagctggcagctggactgtgctgcagtggtggtggtggttgttgataaaaaccatcaccttcagtagctatgtgttgggtaaaatgaacacgatattgtgatgcagtggctgtgggaagagggcaggggaaacaccagggacgattcccactttcttatccacaatgccaagagagaaaacactggatacagaccagttttgtggagaaaaccatgattttatatttgcaaatataacactggagttggatgtggctttgtgagactccagtgcacatagcaagtaggcaattgtatgcttccatctggagctcaagaggaggtcttgatgagacataaattttgaggttgtctatgtacagttgatggaaacctgggtgtgggaaagttgtcaccttcagagagaaaatagaatgaaacaggaagagtggctaaaaataatctttaagacacttcaacatctagcttctaggcagaataacacacttcaaactcaggaagctctggactcaggaaagccaagagaagaggatggctcaggagggaagggggagctgagtgttgctgagaggcccaataagatgagagccaaaggagccagtgaactttgtaatatggagcttcttggtgccctaaaacttactatttggtagaataataggtgggaaagccagaacaaagtaggttgaagagggaccaggaaggacaaaaatggtgaaagcaagaatagggtaaataagcgaaccagctagaaaatataggaggctgtgataagagttggggatgcttgaattagagattttggagctggaaaaaagtgtaataacaatgacatatagtaaagatatacagatgaagatggattaagcagctgaagttaaaaaaagattattaaaaacaataagctacagactgggtgcagtggctcatgcctgtaatcccagcactttgggagtccaaggcatatggatcacctgaggtcaggagtttgagaccagcctagccaacatggtgaaaccccatctctactaaaaatacaaaaattagccaggtgtagtggtgcagggctgtagtcctagctacttggaaggctgaggcaggagaatcacctgaacccaggatggggaggttgcaatgagccaagatcgtgccaccgcactccacccttggtgatagagtgagactctgtctcaaaaagaaagaaaagaaaggccaggcacggtggctcatgcctgtaatccccacactttggaaggctgaggcgggtggatcatgaggtcaagaggtcgagaccatcctggccaacatggtgaaaccccgtctctactaaaaatacaaaaattagctggcgcatgcccagctactcgggaggctgaggcagaagaatcacttgaacccagaggtggaggttgcagtgagccaagattgcaccactgcactccagcctgggcgacacagtgagaaaatgcaatgagatacaaaattagaaatcatattctcagatgagtggcatgcatactctaggatgggcaggtcctcaccagacccaaagactctcaacagtgaggagggggtctgggaggttggagatgacagcaagatggagactgagaggatgatgtgccggatggcatgagcctcacaactgtgacctttatacaagggcttgaggagatcaggcatgactagaaacttaagcctcagttccacccacaaacctggactgctggggatggcagagagaggcagccaccctttgaaaagcctgcagaggaagcagcagcgtggggagtgcagttagtacagagtgggagggaagacttgcaagggagatatttgagagaactcttaagatttttggaatggatttcagaaagcactgtggaggcctggcacattggcacatgcctgtaatcacaacactttgggaggctgaggctggaggatcacttgaggccaggagttcaagaccagcctgggccacactgcaagacctccatctatacataaaatttaaaaattagccaggcatggtagcatgtaactgtagtccctgctactcatgaaactgaggtgggaggatatgtggagcccaggatttcaaggctgcagtgagctatgatcatgccactgaactccaggctggacaacaggccactatcctgtctcgaagaaggaaagaagggagggagggaggaagggagggaaaaagagagagagagagagaagacaagacaagacaagacagtagaaagatttcaagagttgttgggcatcagagaagtacagggctgatgatgggaatagtgatgcatatggtagagaatgaatacctgaatacctgcaggtgtgcgctttcacttcagtattacaccatgaaaatgggattgcaaagcatgtaaacatcagcactggtactgcagatggctggagaatgcatcccactcagctggggtggatgtggtcccaggagtcccaggcaatttggtatgatgtgggtgcttcagtatcagccaggtacagctcacaggatatgtctaaaggagcaactgaatttttcagacagatttgtagacccaattttgtaaatatcactttcatggaaaagtggggagaggtgacacaaagtcaaatcaaatattaattctgtttgaagcgattccaaaatagtcattgtataccacatggttagaatcattaattaatggcttaaattattcattatttttagctgtttttgtattctgtagttatagcctagagctgtactttaacaaaaagcaacaatatttacctatgtgaagtagttatgagtatgaggaggtaattttttaaggtgcttagaaaacaggtttgtaaaatagcagacttttaacaagcaaagaaaatcagtgctgagaaagctagttagtaacatctcattagtaagacttttttcattttataataattaattaggcagccacattaggcaataatgagagctagtaatcacttttttattatggaaattagactggactcattttaaaacaacacttaatgcatatgctgtaatgaatatggaaaagtataagttgcttaagcaaaatgtataagattttgtactcctcccacaaaaataagtgactaaagatgggttgaaaagcagagttacttttctcaacttgtggattgtggaagtacattctctttgtattcttgaaggactgagtttataaggtggactgattttgtattctttgggatagtattattctggacaggatgcatttcattttcttaatcctttgccactagaaatgcaacagaggttattaactcttgttatttgtgcagaatcttggatcacttaaattatttgctgcatatttaagagactcacaactaaatgtagagttttaaacatctactggagtatagattgctctcaagttgtcaatttgatgaatcctaaactgtcctagtcaaattttgcactcctctgaagaccttaaagaggtaacttttgtaagaagcagaatgtataactttaccttctgagaaattagacaattgcaatatgaccttttcaggcatagtggggtgtggcttgaatgcttgaatgtttgttcttaccacttattttccagataagctaacaaatacttagagaaatcaagatgctcaaccagagtcccacacagagaccatacttcagtgatgtttatgctctttgttgctcaaagtcatgccagaatatcttcactgttaatggcactgtaggtccttatcttcattccctaggccttacataccttctatatgcaaatgacatcaaaatttatctctcacaccatcctctttcctgagctgaagacttgtattttcaacttgctatttaatagctcccttcagaaacctcatcagcatctcgatactggcatggcctgacctgcctccaacccccctcatcatcttggtggatgcagcggtgacgcagccagttgctgatgcaaaaaatcccaaaaatcccaggaacctctttccgttctcttactcccacacctcatggagaccctcatgaatcatccagtaggatatactttttttttctttttcttttttttttttttttttttttgagacagtgtcttgctctgtcagccaggctggagtaaagtggtgtgatcttggctcactgcaacctctgcctcctgggctcaagaaattctcctgcctcagcctcccaagtagctgggattacaggcatgcatcaccatgcctggctaatttttttatatttttagtagggaaggggtttcaccatgttggccaggctggtctcaaactcctgacctcaagtgatctgcccgcctcggcctcccaaagtgctgggattacaggcgtgagccaccacgcccggcccaatagagtacactttaacattagaaacgaagtcctatcgttgccaactttaagacctaccctatatctaacttctcaccactatccaaaccacaaacaacctttcacttcctccactgcagtcacttcttggctggtcgttctatttactacatggcagaatattttattttctaaaatacaaatccagtctccccactgctcacaattctctggcatcttcttatcactcttaggatgaaactgtgactcctccccagtcttacccatgactcctctgctttgcccagacatccagccacacaggtgaatgtactgacagcttccaagctcttacctttgccccttgtgatggttaatattgagtgtcaacttgattggattgaagtatgcaaagtattgcttctgggtgtttctagaagagattaacatttgagtcagtggactgggagcgaaagtctcccagtgtgtgggcaccatctattggctgctagcagggcaagaaaaagcaggcggaaggaggtggaaggtgttgacttgctgagtcttctggtcttcatctttctcccatgctggatgcttcctgcccttgaacatcagattccaagttcttcagcttttgcactcttggacttacatcagcagtttgccaggctctcgggcctttagccacaaaccgaaggctgttctgtcggctttcctacttttgaagtctgggactgggactgagccactattggcttccttgctcctcagcttgcagaaagcctattgtgggacttcaccttgtgattgtgtgagtcaatactccttaataaactctttttcatatatacatatatcctattagttctgtccctctagagaaccctgacctactatacccttatttctgcctagaaggttctttccccaaatctttagttgtcatgtctgtttatcattcagcttcccgcttaaatgtcacctactaggaagagccttcctcaactgtcctgtgtcagaaagtccaccacccaccccagcacccctccagccctgctcactttcttcaacatatatatcactatccgaaagtattgattcatttccctatttattttctgtctttctttccaaaatgtgggcaggaggagcttggctttgcttactactgtctccttaatgcctgcatagaggaacagagttcagtaagtatttgtcgaatgaagaatagtgatacacttcttcctataatttgatttttaacctctggagattatcaattggctcacctccctgctaaaaggaaacctgatttattgtaataaccctacgttctctacgctactctatccccaaaactctgctaatcatattatttccatgttgttataattaatgttacttttatcccattttataacttgaatttcacagttgtttagatgctattctatgtttgcatggattcaatattcgccatcatttctctactgtgtcttccttatccatctcatggttgactgtagtttactatttaataactttttaaagaaatgctcgtgagagttaaagtccgagaacacttgtttgttgggtaatataaaccctccacctatgtggcagtttttatgggcatggtcattattggatcataacttccacctctgagcattttgcagacgttccacatctcctaggactgatctctggatacccacagaaatatttgctcttctttttcgataaatttcctgtaatattctcatttttaccaaagcctacaagtattccttggaagtttctactttcagcaaattcagttctctcttgtaaagttacttttctattacattattatttttaaaatgtcatctgttatttctagttgcacgttttgtctttcattatttttgtctctttactaatattaatcaactttttgtccttttccattttattttgttcatttttttctcatttgtcctagatgcctctgatgacattttcagtaaagccagtttctcctcttgctgattttcatttctgtgttgattttttcccttccatttctttccaaaatctatcagttcacttttcaactacctccattgtcctataatatcttacctgggagcttctagaccttctttgggctcctgttacttacatgacatatagtcatacattttatctgatttgtcatacctcttgtttgatatatatagtctttctctggccttctgtttgctgtctctctctctctttttttttttttttttcatttaggtagtatctttgcataggtctcatgctttctttttggtatttactcatcactgaataagggaactaattcggttatgaagataaaaaccagctatttgcactaggagagtataaggaagggacaaggatagtaacccaggacaatgcaacacagtttgcactgtactctgatgtcttcagcatactcatgcatcctctgccccagacataaatgtgccctcagctagcaggaaaactccctgtgaagctgtgagatgcccattgtgggtttcctctgtactcattgagctcttacttctcttcagttggcaaaaagaggtaacttcaggaacatgcgccatacacatgttcttctctacgtggccacatggacaagtcaggcttcagcgaaaggacacggatgtcatttcctcatcaagtctcctcttccccactgctccgtgttgcctgccattccgggcatagagcggcttggcccagaaaccacacaaatgggccttgttgttccaaggtgggtctcctagtgtttcccctaagggcaccacctaattagaagcattctttgcttggtcagctctgcctaagttctacaggggatgtggtcctctctctgtgccccttcacctgcagccttgctctcagaatctttctccacgtattatagtatattattcaggcatttccaaataaagacagagtttcttttttaataacaactttatgaagatacaattcaccactgttaattataccatttaatgctgttagtatagtcacggtgttgtgcaactatcaccacaatcaattttagaatcgtttcagtaaccgaaaagaaaccccatacccatgaataaccattttctatctccgccaacttctcagccctaagcaaccactttctgtatctatggatttacctatcttagactttgcatataaatggaatcattgcaatatgtggcattttgtgtcttgcttctttcacttagcataatgtttttgaagtcaatccacgttgtagtgtgtgtgtgtgtgtgtatatatatatatcttagtacttcattccttttattgctgaataatatatctcattgtatgactatgccacgttttatttataatttatcaactgaaggacaattgagtttacatttttgcctgttattaataatgcttctatgaccattcatctacaagtatttctgtagatatatgcttttaattttcttcatatatattgatgagttgaattgctgggctatattgtaacagtatgtgtagcctttgaggaactgccagactgtttttcaaagcagctgcaccattttacatccccatcaacagtgtataaaggtttccatttcctcatattcttggcaacatatgttattgtccatcttttttattatggccatcctactccaggtgaagtaataattcagggttttgatgttaatttccctgatgactaatgatgggcatcttttcatgtgtttatcggccatttgtttatcttacttggagcaagtcttattttgattttttgcccacattttaattgaattattaatcttctttattaatgagttgtaagagttatttacatattctggttttatcaggtatatggttttcaaaaaatttatcatctgtgtgttgtctttttacattattaacagtatcttttgacgcccaaatattttaattttgataatattcaatttatttattttcttactttgttgcttgtgcttaagtatcatatctaagaaaccatttctaattcaaagacatgaagacttactacacctatgttttcatctaagaatttaatagttttagcagttatgttcatgtctttaatccacttgaattaattttgtatatggtgtgagataggggtcaaactttatacttttgcatgtgtataccaggtgtagcagcttcatttattgaaaaatactgctttttccccattgaattgtttggcactctggctgaaaatcagttgaccataactctgagagtatatttctatttaattgatctatatatctatttttatgccaataccacactgccttgattactatagctttgcagtttttgaaattggaaagtgtgagtcctccaactgtgtttttctattttaagatgcttttggctgttctgagtcccttgaattttcacatgaaatttaagatcagcttgtcaatttctacaaagaaatcaggtggggatttaatacaggttgcattaaatcagacctcaagttagggagaagtcccatataaacaatattaagtcttttgatctatgaatatgtgatgtgttttcattcattcagatttttgctttctttcaacaatgtttgacagtttttaaagtataggtttgtgccctttttgctatatttagtcctcagtattttattatctttgatgctgttgtaaatggaattttctcttagttttatatttagattatttattgcaagtgtatacaaataaaattggttattctatatggatcttttattctgcaactttgctaatttttagttataatagtttttagtggattccttatgatgttttatatacaagatcctgttatctttagataaataattttaattcttcttttataatctggatgtatttaatttatttttcttgcctaattgccatgactagaacctcctataaaattttaaattgaagtgataagcacatacatccttgtcttgttcctgattttagggggaaggtattcagtctttcaccattaagtatgatattagctgtggttattttctaggtgtccttcaccaggatgaagacatttccttctatttctaacttgttgagtgtttctatcattaaagggtgttgaatttagtcaaatgctttttctgtatttattgagatgttcatatggttttagttctattccatgaatatggtatattagagtcaccggttttcagatgttaaaccaatcttatacattcattttattcatgagatatgatccttttcatatattcctgggtttgatttgctagcatttcattgaagttttttataccacaattcataagagatttcagtatgatttttttctggtgatgtctttttctcgtttcagcatgagggtaataatagcctcatagaatgaatagggatacctccttttctatgttacgagtttgttttgcagaaatcaccagtgaagcttgtacttttctttatgggtagttttttttttaaaaacaattaattcaatcttatttgttaaaggccgttaatatattctatttctttctgggtcagttttggtagtttgtatttttttaggaatttgtcctttgcatcttgtttaatttgttggcatatattagttcatagtttcccttatcatcttttttatttctgtaaagttcgtagtaataccccatatttcatttttgattttagtagtttgagtcttttccattttgttttcttggtgagtctagttcacagtttgtccattttattgatcttttcaaagaattagttttgattatgttaactatctctgttattttctataatttattttgtatatctccactctagcttttattattttcttccctattcttgcctagcatttagtttgctcctctttttttaatgacttcagatgctgtttgcatgacatgtgtttttccatcctgtcactttcaatctatctggtttctttgaatctaaagtgtatctcctgtaaacagcaaatagttgaatcttgttttttattttatccagtctcacaatttctgccttttaattagattgtttaatctattcacttttaatgtttttattgacatatttgtacttatatttgccattttactttttgtttcctatgtctcatgtcttttgtttctcaattgttttattactgctttcactgcattaactaaatattttctcctgtttgtcttttcatttctaattttatttgtcagctttcgttggtttcaggtgttcaggtggtaaggagaagcagagaagacattgctcttccattttaaattagaagttatctgtctaaggtcttcaagggcaaatatttcataatacttttctacccccatagtagatatgtgtgaggttcatcacaaatcctcctctcccaaacatcttttcagtttggttcagtgactgagtcattaggtgctagtaaagaaatctgggttttaattctagctctgttattaactagttgaatgatcatggaatattcatataacctctcttggacttattttctgacatataaaatgagagggttgaatttgattttatttaatttcccttttagcactgatatgctaaatttccagtaatactgtgatcatatggatctaaatacataagcacataagccaggcagagttaggcattttgcttcttgcaataggcaatcttatctacaactgattttgaagcataggatttaactagatccacaatatagtaaaataattatttggcccaaactactcactggccagtagcccacagattatccccttatgtgtaagagaccatgatttgagaatagaaggaaatacagactttgaagtgattacaaatataagctagtccaagatgcctcatgagaataaaagctttatgtggagtcctatatctatgtccaataatttgtttaaaggtattttgttagcaaatccattatccattgactgtctacagtgtgcatacctctcaagagtggcttatgtactataacaaaaacacaggagacccgctctaattggcctcattttaaaatgaaagggagaataaacacagtggcacctttaattattaatgacaattgaaggaagccttagcacaaataatcccaaagacatttctatttggcttggaattttaatattgtttttgacagatctatttacctaattatattttatctaggatagtgtttaaatgaggttctgtttgctaagcacttaccaacagagcagtagaagacatggctacaaagtgtattgcttatagcaggaagctggtccaggatttattaaaaaaaaaaaacataaaacatgttttgtgaattatccataacaaggaataccctcatgcagataatcaacaattgaatacgcataaaacacagatgacaaaaaaacaaggaagcttctctataaccaagcacagctgggcaaggatgcacagagatgctgcaggggattcatggggtgactggagtcgagacaattagtctgtaaaagcttcgtgctgatgccctcctgcagcacatttccttaacatctttaaaaatgcaccagtccagctgtttcatggagcatctcaggcttttaagacctccgtttttttgtctcattcattctctttattaccattaacaaagagtgggtcttagacagctgaatgttctacttacttaatgatcaagatcgtggagatagtttcaataatctaatggataaagaatccagaaatatcttaaagtttgtgttttcaggcttattctctgagtgtcagtccctctcaactagttcttacttagtcccaccctgataccatgctgtcaaattacttgctattaacttacaaatcacattctcctgttataattctcgttgagggaacatcagtgtcccccctaatttcacctacatggttacctttgtaaaaaaaactatctgagacacctgtgcttattcatgatactgtattatattgaatggttttagactttagtcttcctttagaaaaaattctcaacttaactttgtttcatgaatacctgtttacttctatatgttgcattttagattcccttcagaccaactaaatatgttcttattgaccatcaatgaaaaaaaaaggtatctaaaaatgggaagtatttaagacttgtactcagtcaaaccctacgtttgagggtttttaagctgtttgataacaaccatcctctgccagcatccccccaatatgtttcataaaatattacttacatggaattttaacagatattttgtcaaaataagttttagaaacacaaagtaaaataatttttttttacactttaggactcttggagctctggatagtataatgtgccttatgaatcttgaatagaggaatgtaatgtaatgcaatctcccaacatttttaatgcatatccattctgagaaatatcttttgtgtgatgttccagcataaattactaaaggtgaagagatacatatttgagctataaagactagatctttttttcctactttcattcccaaataatacaaaaactattcatcaaaatgttaacactaaaacaaatagattaaaaatttcaacataaactgaagaatatggtaatgacaccaagaagttatttaaatcttcagtatcaataattacccttcaaataacactatgttgctactctgagtacttttatattcgtgtctctatcgtggtaatacagccgtaacttgtcttcccacttagaccgaagaaaattaaactaaaaatgcgttagtagggcatatagataatgaataatgtgctcctttagaaaatattaaccatacttctgccaaatacattgttgtcacagtgcacggagaacttcatttcacaaggctttttgcaagattgatggtgtaacttgagtaggtttggcaaaaggagcatgcaaatttcagcaatataattacatcattttcccttatggataccacccaaccgagaaatagatccaatagtcagatgagaaattaaatacagtaccagctttattagtaggtcaattagcatagttttggctacaaggaacaaaaatcaccaaataaaactgacttaaaagtagggtaatttctcatctcaaataaaaagctgttcagaggtaagtttactccaggatgtcagggctctagagatacaactcagtgattctctgggtttttgtcctgtacgtaatggcttcatccttgcactggaagtgagatggctgtgttagctacagatgtaacatctagacatataaacattcagaggaaaaacagaaactccactcttacttaggagtaagaaaaccaaacctttccagtaaggctttcatgaatttccctctcattttattggctagaattgggtcacacactcattcctaaatcctgacaagggaaatggatttaccatgattgatttagacaaatcagactatcctggatgtagggataaaggtatcctctcttcagctactttagaggagtcgattttgggggaaggaaaaaggagagcagagaatgaacactgaacatagtaactgagagtgttcacactattacccagcacacagggtctctgatgaagtctaaccgtgttttcctccttgtttccctccatattgaatttatccaactagatcgcaggcaaagaagatggatgatggtaagcttgctgaagctcaccttctctcacctgcctacacatgcaaaagcagccagtgtaaaaccccaggccttcccataacccatgtgctacacagcaagagaaagaaggagagtttcaggcatgaaaataataagagaattctgcccttatctcagcagttctgtgagtcacttctcctcagggaagagcaattagaaggatagaaagaatggtagacatttacttcccagaatatattagcagagtttcctttttcttggtggaaactccaggaggaaagatgaagtttttctttttgggtaaaagatgaggtgaggggtagaggggaaagcacactagttttaggtgccatcaataatcctgtaggcattcatcctgcaatcatgtagtaaatcataacatttgtcatgcagggaggtaggtactggatgagcattgggaagaagacgtggtcccagctatggaactccaaattctgtgtctccaatgtgatatgggaagtaattataatatgtaagctatttgttatgtctacaaagcattgtaaaaatgtatattaaatttaaaaaaaaggcaagaaatctttttcctgttcagtagttccaaaaagactttaccaaataaatgaaattagtgcagaatttaggaagatgtatagattgtcattagtcaggctacaggaaggaaatcatttcaggcaaagacaagatcctgagtgaaggcccagatgcatgagagcagaaattgtcttccagaagctatgggtaaacctctatggttcaaatatggtgtctagagtgagacacattgctaaggcagaaaatcagcctgaaaggaagattgggtcaagttatcaagtttttttcacaccactcaatattatagttgaggcagaatactattttcctctctccttcctgatctttgccgttaaatctttcagtggaaattatacacagtatgatatatgcagtaagggaaatacttaacaggcctctgtcatgggcatttgtggatgagtacaaaagaaatagaagatacaaattcttcacacaataaatatatagtatgtgtcaaaattaaataagataataatataagacaatgaggcaatagtgccattgcttgtggcaatttttaaactccattttttgagccagtagtgccaaattttgtctatactcccaagtgtcagattcaatcattctgtcatcacatatttattatatgctgtgtgctggataaaaatcttcatcgttgagggaagatttgatttggggatccctcccaaagttatttgtatcaaagtcagctgaataaggtggctgatcatgataaggaatgccattatagactaagacccaactgcaaggaggaaatgagattttttttttgacctgtacactgtgaagcataaaataagaaccataaacttaaggccatttaaaaagagaattatagaaaagcattttaagcaaaggcagctcactttaaaaaaaaaaaagtgactaacttcccacaaagactcctttgaaggacacgcctcatttgggtgtatagatctccctacgtttgttgccatgagccttagtctatcatcatcatacctcaacttagcaagttctatagcatatggaggagacaaaattgcttcagccatttagacaagactgaaatcattgtgggcttccgtgattggaaaaggtctttaaaaagctttgaacccagcatggaccttcactgcaaatacagtcatgtgctgcataatgatgtttcataatgatggaccaataaatggtagtatcaaaatattataatgccatattactactgtactttttctatgtttagatatacacatagttactattttaccattgtgtcacatttgcctgcagtattcagtacagtaacatactgtacaggtttgcagcctagaagcaatgggctgtaccagatagcctaggtgagtagtaggctatcccatctaggtttgtgtaagtatgctctatgatggtcatacaatgacaacatcaactaacaacacatatctcagaacatatccccattgggaagtgacaaagtgactctactggaaaacaaaatatttcgtacaaagcctgggatgtgtgctctgtttattatcacctcaaagaagacttacaaattgggagaactaagatttgtaagagttctcaaacatagagagaatattatgtatcattattatatatcatgcatacattcgtgtatatttacttcttagaaacgtgtatcatgtatatgcatgttaaataggtatgtagtctttggcaacttctatgaagttttttttttttttttaatttttttttttttttattgatcattcttgggtgtttttcgcagagggggatttggcagggtcataggacaatagtggagggaaggtcggcagataaacaagtgaacaaaggtctctggttttcctaggcagagcaccctgcggccttccgcagtgtttgtgtccctgggtacttgagattagggagtggtgatgattcttaacgagcatgctgccttcaagcatctgtttaacaaagcacatcttgcaccgcccttaatccatttaaccctgagtggacacagcatatgtttcagagagcacagggttgggggtaaggtcaccaatcaacaggatcccaagacagaagaatttatcttagtacagaacaaaatgaaaagtctcccatgtctacttctttctacacagacacggcaaccatccgatttctcaatcttttccccacccttcccccctttccattccacaaaaccgccattgtcatcatggcctgttctcaatgacctgctgggcacacctcccagacggggggggcggccgggcagaggggctcctcacttcccagtaggggcagccgggcagaggcgcccctcacctcctggacggggcggctggccgggcggggggctgacacccccacctccctcccggacggggtggctgccgggcggagacgctcctcacttcccggacagggtggctgccgggcggaggggctcctcacttctcagacggggcagttgccgggcggagggtctcctcacttctcagacggggcggccgggcagagacgctcctcacctcccagacggggtcgcggccgggcagaggcgctcctcacatcccagacggggcggcggggcagaggtgctccccacatctcagacgatgggcggccgggaagagacgctcctcacttcccagatgggatggcggccgggcagagacgctcctcactttccagactgggcagccaggcagaggggctcctcacatcccagacgatgggcggccaggcagagacactcctcacctcccagacggggtggcggccgggcagaggctgcaatctcggcactttgggaggccaaggcaggcggctgggaggtggaagttgtagcgagccgagatcaggccactgcactccagcctgggcaccattgagcactgagtgaaccagactccgtctgcaatcctggcacctcgggaggccgaggctggcggatcactcgcggttacgagctggagaccagcccggccaacacagcgaaaccccgtctccaccaaaaaagtacgaaaaccagtcaggcgtggcggcgcgcacctgcaatcgcaggcactcggcaggctgaggcaggagaatcaggcagggaggttgcagtgagccgagatggcagcagtacagtccagcttccgctcggcatcagagggagactgtggaaaggggagagggagagggagggggagggggagagggagagggagagggagagggagagggagagctctatgaagttttatcaacctgcacttttaaggtaacgtgtaggttaattttcacttctcaaaaccctcacttcagatagaaaaaataacttcggaaacagcaataataatagtaataattataataaatagtctaaataattgaaatgaaacctaataaacagacaaaggaaatgatacaaatggaataataatgaacaagagaaaaatttacgattgtgaaaattagattgtaaaatggctttagaggaaaagtactgtaattcacattcctacagttatttgagagaaagggaccaaaccagtttaaaaatgtttttactgagaatttaaaaacaccctttagaaatagaaattcagtttctgactttatttagcaaaaattaaccagcaaaaaccttatgccccccaaaatgtgacctctttctctgtggatagtccagtgtttttcagcctagagcctaattctgctcttgggggacagggtccatgaagcgcaaccctgtgttttgtattcatagaaatgcagccagcaaacttgggtattggatgaactgggcattgtgggtcactctgcccgtggacctgctggtggcaccgcagggaaaaggttagaaactgcatgttctctgccaggcagaggctctactcatgttcttctagggagtcttgccttgtcatttctaccagtcatagactgggagatttgctgaccttagagatagtaatatatttcaaacctcaagaggcaagaatgatatgaaacaaaggatatccctggatttcctctggggctgcgaaagggagtctccacctggctctggaaggctatgtcttgtttccatccactccatttaactcccacttcttggcctgctttgagactgtcagctgggggccaattactgccatttagagaagtggatgctttaatgtgaatacttgtctgcaggaaccacacagagacagctgccttatctcacaagaaccctgtgttgtttatactcagtaatctgccacagagctctctccacaatggggaaacgaatccaatttattctccctattgcctgcacttaatttctttgactcgtttacatgtctgtctttttaagttgaagaaagaatacgaatgtaagttcctctgtggctaagagcatctttgactgtgttcttaacagtctaagacaatggagcaatagtactattgcctgaggcaacccttctgagtttttcaatttattaccaaatttttagatgaattatgatctagtctagttccagatggtgcatctagatctttataaataccagaagcacttacttgaaaagctgccagatctataaagggatctactactatgacttggagttttttcatacattattgtctgttttcataaattgataattaataggttctctaaaagccaagctgttcatggtttaaaaacagctgttagccatgaaaactgtggtgacatctacttaccaaggtatttccagagagacatgtagaatcacactggaaattctgtaccactccctggtgctcttctgggcagggagagtttactccacaatgccacaaaatcttatcagattactctccttttgaaaccttccaaagacttcacactccatctaagataaaactcagaggccctgagcatgaccttcaaggtgctcacccactctcttgcttcagtttttgtttttttgtttgtttgttttatttttagacagggtctcactttgtcacccagactggagtacagtggtgcgatctcggctcactgcaacctctgcctcccaggctcaagtgattctcctgcctcagcctcccgaatagctggggttataggcatgcaccatgacacctggctaatttttgtatttttagtagagatggcgtttcaccatgttggccaggctggtctcaaactcctgacctcaaatgatccacccagcttatcttcccacagtgctgggattacaggcatgagccacccagcccagccctgcttcagtttttaacctcaccacctcccacaccaagctatgtccacagttgcctttttctctgttcttagaaccctacattgatgagcatcagggcacttgtctcacctcataatccagttatcctctgaggcagaatagaaatccagacctggaatctcctcttgtttctgctttccaacagcttcctctcaatcaaaatgacaaatgattcaatatcatttttttttttttgagacggagcctgagttttgttgcccaggctagagtgcaatggtgtgatcttggctcactgcaacctccaccacccaggttcaagcgattctcctgcctcagccttctgagtagctgggattaccagcctggcctcgaactcctcacctcaggtcatctgccctcccaaagtgctgggattataggtgtgagccacaatgccaagcccagtatcattcttgattaattagttgcaacttaaaggagtgaattttctaaatataagattatatcatctaaaaacaaggataatttgatttctccccttccaatttggatgagctttatttctttatcttgtctgactgctctgactaggactttaagtaccatgttgaataaaagtggagaaagtgggcatccttgtcttgttccagatcttagaggaaaggcattcagtttttccctgctcagtatgacattacctatgggtttgtcagatacagcctttattgtgttgagctatgttcttttgtaccctattggttgagagttttttatcatgaaggaatgctgggttttatcaaatgctttttctagcctctattaaaatgatgatatggtttttgtccttcattctattgatgtgatgtatcacttttactgatttgcatttgttgagccatccttgcatccctgggatgaatccacttgatcgggatgactgatctttttaatgtgttgttgcatttgatttgctagtattttcttgagaatcaaatcaaaatggattgagggcttcaatgtaagacctgaaactatgaaactagtaaaagaaaacattgggggaaatgcttcaggacattggtctggacaaaggtttcttgagtaagaccttaaaagcacaagaaaccaaagcaaaaatggagaagtaggattacatcaagctaaaaatctccacacagcaagggagacaatcaacaaagtgaagtgacaacttacagaatgggagaaaatatttgcaaactattcagctgagaaggattagtaaccagaacatataaagaacacaactcaatagcaaaaagcaactaataattgtatttaaaagtagggaaaatagctgagtagacatttttcacatacatatgcccaacaggtatgtgaaaaaatgctcaacatcactaataatcagagcaagacaaataaaaaaccataataagtatcatctcacccaagttaaaatggcttttatcaaaaagataaaataataacagatggtagtgaggatgcagagaaaggggaacacttgcccactggtggtgggaatgtgaattagtatagtcattatggaaaacagcataaaggtttctcagaaaactaaaaatagagctattaatactatatgatccagtaatcccactgctgaatatatataaaaaagaatgaaaatcagtatttcaaaaaggtatctgcactcccaggtttattgcagcactatttgcagtagccaagatgtggaagcagccttagtgtctacctacatatgaatggataaagaaaatgtggtacatatacaaaatggaatattattcaaccataaaaagaatgaaattctgtcatttacaacaatatggttggaactggaggtcattatattaagtgaaataagccaggcaccaaaaggcaaatattgcatattctcactcatgagtgggagctaaaacaattgatctcatggaggtagagagtagaatgatggttaccagactttaggaagggtagtggggaaggaggaataaagaggtgatggttaatgagtacaaaactacagttaggtagaaggaatgagatgtagtgtttggtagcacaatagggtgactatagttaacaataatttattgtatatttcaaaataacttgaagagtgggattgaaatgttcctaacacaaattatatatggctgggcattgtggctcaagcctgtaatcctagcactttgggaggctcaggtgggagaatcgcttgaacccaggagtttgagaccatagtgggcaccataatgagacccctatctctacaaaagaataaaaagttttaaaaaattagcttggcatgagggtgtatgcctgtggtcccagctacttgagaggctgagctgggaggatcacctgaacccaggagattgaggcttcagtgagccatggttacttcactgtactcgagcctggatgacagagcaggtccttgactcaaaaaaaaaaaaaaaaaaaaaaacgaaaacaaaaaaaagaagaggaggaaatgatatatgtttaagaacatggagatccccattaacctgatttttatcattacaccttgcatgctgtatcaaaatattgcatgtgtcccatatatatgttcaaatattatgtacccatagaaattaaaaataaaaaaaattaaagctaaattttaagttttcactgtgttctcagagcacgtagtcattctatccatctatccacccatccatcaatcgagtgcctagtacgtaaccttaaagtgattatatttcttagtaagcacctgctgtatactaaaggtaaaagttattggtctctgtgcatatgtggttgagtttagcagataaggcagaccaacaaacaaatcactatatgatgggggaatagatcaggttttctagaaacatgagtgagagcttctaatatgccctagttggtgatgtgagcgtcaggacagtttttctaagagttgttttgagttaagcattaaatcatgaataaaagatagtttgggttgccagatatttatcaggctttcattgatgcccccttaacatttgccagtcatatgggaagtactcaaaaaatgtttgagattcattctttagtgatatgttcactttcttttttaaaaaaaaaaaataaaaagtagtttgagacttctgtgattctctgtaaataaattttgacttgacatgtctgggaccttggcactgactctcctgggatacctcaattcccctcctttcccctttcctctctctatatatactatatatatgaagtcccattgtcctggcctctccatatggcctctttctgtaggatactggatgatattctgtacctctttgcaatttgttagctgagagccaggaaagtgaaagcaggaactgctgggacccataacatcgaggcccggaaagggcagcgtcacttctatagcattataatgatcaaagaaagtcacaggccagccaagattctggggaggagaaatcaattccatctctcatgtatgtagtggaaaagggattgctggtggctatctttggcaactatctactgcattccctcctcctcaaattaccttattctttctatcctcccaaagactaccatatgtatatttgcactcattctctagatttgacataaattggttgacactaatgacacttccctgtgtctaacccttgtccccatcatccaattctttctgcccttacctggcatctgtaattaatttctttgcctccaatgttacttctctgtttggtagtgcaattgaagaccacataaaaatgctgctagaatgcatctcctttgttagcagatttagtattctaatgtgaaattccttctcatcctttaaaacccagttaaatctgacttctataaagtccttattgactatcccaaagaagaggggatttctctttctaaaatttgtagtaatgtgtttctggaatgtattctagttttgactatggttaggaatacacatgctttacctttctaataattttgaaaactcaaaggcaggcagtaggatatactcattttttaaattttctaaagcaccaagatgagcccattacatagaataagttgagtttttgttgagttgtcagggatctgggaagaatggtttggcttttaggagaggttctcagccaaccaggaaggaaaaaaaaaatgattcagtgattagtgacaacagctttacttctagaatcctcccacctactactggcagcacgagcaggcagcttgccttcctgggacgaacctagatgaggtacaatgtggctggaaagctctctaatactgatctgacatggcatatttcagattaatctgttttctctccttgtttccagtttcagcacatactaatgccatcttgaatcttacttttcctccctggccctcagcttccccatctgtaaataacaaaggctactatttactaagaacctgcatcagtgccagacacagtgctgggcactagtgctaatcctcacaataatagtgaaaggtgcattttttttatttcctccttttaaatgaatatcagatatggaaaggaaaacaacttgcccaagccctctcagcacaactggattgaaactcatcccccatgagtagcatcagggtcaggccagataagctgtaaattcccttagcctttactatgcatctccaccaggatgtaaaatacaatctgctgtttgtcttccaccttctcctagaccagcttttctgcgtcattatttttcttttttgtcttcagctgcagtttctcttatcagttattggctccacaactagcaagtttattttttgctccatattgtattctggtgtgttatgctacaatttgtatagggaatgagacacaatatggtttgctaatgagaaaatctacactgcagagacagaacctatttgttctcagttacttgaaacgtatgttagaatgtagaatctcttcttcattcccgtgtgaggtgctgaggaaggctggaggggttctgattcagtcacatttgattttggagtcaaggtcttggcttcaactcatattgagttttactggaaactgccagctttgttttgggtagacatttgtaaatgtgacagaacagatgactcatctcaagccagctctatgcttttattcaatgtgtgcttaaaaagagtaaacgtggatgttggaaagtattttcttgtaagtactttgtatggcagatgccaagtactgctaaacctaattatttaattcttcttcttaaatagatattatttagttttaatttttaaaaaccttcaactatataattgatatatatcatatatatagatatagatatatatcaataatataattttactttttagcacaccagaagcatattattttggaagatcataggactcagagctctggataggcaaagtagacttggatttacattctctgtgatcttaagaaatctactttctcccttattttcacttttctgtactaaaaaaaacagctgtactaacatgaataatatgtacctcacagggttcatgttgaggacaaaattattaatagataatatgtcaaagagcttgccatataatcagtaggttctttcctgccatggaaaaatttttttagtcagaataggtctcagccaacctctttcatgttccagaatttaatgcatacttgctgattcaatacaggtagaaagtttaatattaatttttattttgttggctttctaaaaaagcagtcttttcacattagaataagtgaatgaaagagatcactaaaatcaaaagttgttacaaatgttattttgattgctatgatttcaaatgcagttttatcttcttataaagttaaaatacccaatttcgtttttaatttatttggaaacaacaacacgactggttgaatactctgtctaaagtaatctctaacaaagaatgactgaagttctactctaccaatgaaaagcaagaaccggggttcctcctttctctttctgtggtatgggagctacatgaaggcagaataaaagagtcagactaggctgggaatcctgttcaagagaggcactcagttacagtgtacatgtcagaattgattgataaagttactaggaagtaggcatgtaaccttagttagtcttgttctccagttttcaataaaatgtggactatacctttgggggttgtgttcatttgtttgtttttaagacagagtcttgctctgtcacccaggctggagtgaagtggcacaatctcagctcactgcaacctccacctcctgggttcaagcaattctcctgcctcagcctcccaagtagctgggactataggcacgtgcaaccacgctcagctgattttttgtatttttagtggagacgcagagtttcaccaagttgcccaggctggtctcgaactcctgagctcaggcaatccacccatctaggcctcacaaagtgctaggattacaggcatgagccaccatgcccagcctactacagtatttttaaagaagagcagtttcacagtgtcaccaaatcatggctttcagatccagagttacaaattgcctcccaactcagcagttcttgaaaatataatattaccgatgtttggctcatgaagactccctagaagcccagtgtcccctagggaggaagtgccaaattgaaaatttttaaataatcgttactgtattttatagcaaataagtatatgattatcaaatatgcttaaaccctttgggaaagaggagcttgaaaacactgtatccatcctttgacagatccatttagcctaattattcaatgatccccatacattttactcgcattcttgacccaaataattcagattatatttgtatgctttttgatatccttaatgtaaaaaaaattcttgattctttttctcattcattcaacaaatacttgttgagtgaagaccatattctccatgagcaaataagtagaagaatctccatgtgggtcctgcattctaatggggaaagagaggctgataaatactaaacgcaagaacattaagtaggtactatgtcagtaaacaaagtatagagtagattagaaggaaaaaaatcaaataatagcaatgttaggggcgaaggagcctggagttgtgaggatggcttataattttaaatagagttgtgggaattggcctcaggaaggaggtgacatttatgagagagttggaagaggtgcagggattcaccatgtgactatgtgggggaagaacattcagatagggagagcggccagtccagaggctcaaggcaagtctgtgtctgagatgttccaggaagaggaaggaggccggtgttcaggagtaaactttgtaacttagtctttcttttctcacattagactttttcgttgttgatgttttactttaaggaaatttatttttgcaaaaatatgtactatttggtttgttaaaataacatctaactcttgaaagatcatttaccttgatagaggcattcatctattctgttaggaagaagcacaggtcagccggagatgtttacagtacagagttcttatataagtaggaaaaaaaaaactgtaataatttaaaaagtaaaaaaaaaaaaagtcaatacaggacctgccccttcctagacaatcacaacgtgtccactcattctactttcagctgccccctccccaccctatccgttcaatatcctgccactctggcaccatcccagccacaaggcctcaggtcctctctctgctctcgctggttttcagagaggcgctcctcagagagagtttctagcactaaaggataagtgattgttatgacaatatacttctttttaaaaaatgcttgtttcatcggagaattttggctggctatgggtaatggaagagatttcacataaaagttgagtccccttctcacaaagcaaatgagcacatgatggatcaaggtgctctgctggtgtagactaacatatattaataatacacacatacctattaagagatctgtgtcaaggaatatacatgtagtatatattaaagacatcagaatataagacaataaattaaattaccttatagtcacctggcttctatggagcaaggagaatttaattaaaccacagaatctgagagaacatttgatccttggttgatgctaaaaaattgtttcactatttgaaaatagtttcaaatcatttcactatttgaaaaaaaaaaaaagcaagttcagatgggagatggactcatagcttatactatgtcgaaatgcattaggaaagattagtttaagatttcatgccaataaaataactttaccaaaaactacctttatggagtactagtctcaccaggggaagttcaaaacatcacattttttaccaggaagttgatgcattcccttggcaagtcaatgggatggtttatgcctagaatctcagagaagaagaaagcctttttagatgaaaaagatagtcatatgtctccaaaccctcatgtgtatttatgtagtggagaggaaactaattgaagcagaaggtagctagatttttaaatgtaatcattaatagtctcacagttgtgttgatagcatccaacagggttaccttctgggcagaaacacagatcactcctactgttcttggagaaagaaaaaggaggaaatgaacacatgctcactgaacctcctagcaaaaaaagtctctctagaaatatatggtccactcccaagctcaccctttaattctccaatgttacttctgtaaaatagcagtcctgtgatattactcactgaacagatgaaattaaaatatttatattctgcacatgcacgcacggaggaaaatctcacttcaattatagcagttaagaagtctgaagtaattttcccagctagcatttggccattccattgagattgaaggaatctggtatgatgatggttcttattaattcaccctctcttcgttttaaaagaatattatagttcctttgtgatgtaaattgtttgggcaatatgatggtgcactgccttgtgactaaaaagtcgacaagctcaaaggacaaagtattcaggaacaatagctaacatttactgttcggcactttttaaatgttctcggtaagataatttttatttctgattcacttttctttttgcctttccaaaagggatttaagttaattactttttctaatgtgactttgatatttcagtcccctcagatcttccaaggaatttacaggtgaaataccattctagttcttttattttcctagaaactctgatattaaatatgggtgtcacactggaaaattccaccagaataaaaagctaaacaaggcataaaatttacattagtaacatcccattaaaccatcatctagaaagcttttgttacatgattttcatcatttattaaattattttggtgtcttttctggtcttttttgcctgtaggactgaaccttgttatgcatttgtctccatcaaaatggtgtagctgcatttggcattattccttcaacattcttctttattttttccacagaagatgaaattagcttggtttaataatagtcattcctgattactctctctgtggaaaacagcttaagaggcacattattcaattaaagaaagtatttgcctcgccctttaaaaccttcattttatataacctattgattgtgaatccaattagtcttacatattaaacttttattacttttagtatagcacttttacatgccatcgggaaactcatcaccatgtaaaatgcatgtagttcctgactttcaaacaagaggtatttcagaagatcactgctaagtcagtgtttcaaatttgaatatacatgttcatcctataaatgatctatattcagcctataaatgatgacatgattatatatatagtcgtcctacaaataatcatcctataaacaattattgggttcctggggtaacagcaaagcaaaataattagaacatttttgttaataatatacctagtaataataatgtagctgggaaaataatgaacaaaataatatagctgaaatagtagtcctacgttttagggacaaggttagaaagaagagagcaccaggggttggagggagagagtggttcctcatatacactgtgataactcagatagtctgcagtcaggaaacaattggtaatccattaattagagagtatgatgcccttttatgaagtgatagtgtagacacaatagcaatattaattagctttcctattgcttccataataaattagcacaagcttagtgacttaacccaaacttattatctcacacaattctataggtcataagtctgagttgattctgctggtttctctgttctgggtgttaggaagatgatgtcaagatgattaacagctgggctgtggaaagaatctgcttccagtctcattcagtttgttggcagaatccagttccatgtgaccataggactgaaattcctatttccttgctggctgtcaacagggaaccagcctctagttcttgcatgtgggccccgacatctcagagccagcaaacatggaatccttctcaagcttggaatctctttgactttctcttcttccacatccttcttctgcttcaagccagagaacactctctacttttaagggttcatatgattcaatatgtcccacccagacaatcatctctctattttaaggtctgtaaccacaatttcgtgtgcaatgtccattttgccaccatggaatacaacatattcacatattccagggatccaggtgtggacatttttaaagggccattatgctgcttatcacaaatgtaacatgttttgagttgttcttcaagggttcaatccacgaatagcttgtatgcacaaaagcacttgtacaaaagatgaccaccagggctccgcgggctgcctgtgtcacagaatcgagtgatgtccactggcctcacagttcagagctcaccagtactctctttcagcagttcttaatcttatttccaaagatacaccccagatatcctttccttgtgtttacatattctcagactctggctgctgtgttaataagtggtgttgagactattgcttaatgtacagtgaaagagttaaagtgattttgtataaaaatgcaacgatctgtttcactaacattgtcccaagcaacagcatgagcagtcgttttttatattactttaacagaatttcccatccacacaggagaagttcatcctctccattttcttaagagtagagagtgtctttagcatctcaaggtttctgtggatcaccaggagccctgccttggagaggctccagtacacaggtgttactgagctggagggcttgagagaggggaccattctgaggatgggggatggagaaagaatgttaccaaggtgaacggaaaggtagcaaagacgggtatgtacgggaaggtctgagattgctgtttggaattgatttttcaattattaattttttcatgtattctgatatgatgaaaaaaatgacagaacacattaatcttatggaaatgtagggtaaaaaagaggatttgagattggaattattctggaaacctggatcttgagctagaattttaaaaataatggagatggttagcctacagttcggtttctgcttgggaactctttttcaaaaattctctggaaattattaaggcaccaactacttgctctgaaaattgataattaaaggggaaaaaactaaatatttattctgactttaaagggagttatatttttcagtaatcaaaataatcacttgatgatgaatagccttttttatggaaatattgcagttcattaatgtgtaagaataaaactcaccattttgcaatgttaataaaataactgatcaaagcaacgttcatcagtgattaaatcctttggataaaatattaaaaagaactagacaatagagggactaggttttcattataactagaatttggaaccctagaacttattttttctcttaagataatgtaacataaagcagactgcaccatctatgaagcatttctgtcaaaagttgaacctaaatctaattgagcctttatcacttacttccagccaccaggaaatagagagggaaggaagcagttaaatgacaccacaatgaaacaaacagagaaatccagaatgaaggacattttataggactactgacacagtttctgccaaaagttaatgacatgggaaaaaaggagaggggaagaaggaggagcacagctgtaaatttaaaaaagaaagaaagaaaaatgacttgggagatttaccaaatacagtatttgaatcttaattcgagcatatcaactaagaaaaagacatttttgaaaccgttagaaaaattttagtatgcactagacatgattccaagacattattgttaatatgtaggtgagataatatcactgttatcttgtgagacaatgtttgtgcttttagagatggatactgaagtattttaggtatgatgttacatgttgctgggatttgttttaaaaatttttagcaaagacaacatatatggcgcagtgtatattgctcagttgatgggtgcaccaggatctcacaaatcaccgctgaagaacttattcacgtaattaaatgccacctgtactccaataacttatgggaaaaaatttaaaaaatagcaaagaaggccgggcgtggtggctcatgcctgtaacccagcactttgggaggccgaggtgggcggatcacaaggtcaggagatcgagaccatcctggctaacatggtgaaaccctgtctccactaaaaatacaaaaaaaattagccgggcatgatggtgggcgcctgtagtcccagctacctgagaggttgaggcaggagaatggcgtgaacccaggaggtggatcttgcagtgagctgagatggtgccactgcactccagcctgggcaacagagcgagactctgtctcaaaaaaaaaaaaaaaaaatagcaaagaaaaaaattaagcagatgtggcttatttttgctggaaaattaatgaatctaaatgatgagtttatggggattcattatatcatcttttctgtatacaattggtagttacagaatttttcattaatttttttttaaaaaaatcagttattcccacataactgtatatcttaaaaccattgttttctacaaagaggtataatattattgtgtggttgctctgtgatggtacgagtaggcatccttattttatcaagtattgtcctcttaaattgcttggtttcttatcatggtggtctaatttctttgaggctctgtatctcaggcctatgttcattgataaagttcctttctctttgaaattcctattaatagacagtcttcaatcaagaacatattagttctgctaatacaatttatatgaaattttaccctactccataatttgcagaagctaatagtgtactaacaagggagcaggagcaataattgatcatatttgctttcccttagagagaagtgcagccatcagtcttagaagactgatgtaatgagtgccaagtgatggatgccccgtgcactcacgattgctagatctcccatgggtgtcctaaaaggaagcacgtggtctgttgggagatgcagacagcagaattatttggaaataggtggagccactgtcaatgagagacgtttcccctatctctattttaaaaaatgcaattctatcttaatcccttccttttttcctcaaaaatttaacaatgctaattctaagcttgtgtgcacttttcccagtggttaattataatccttttctttattaggttttattttgcagccttaaaaaataaaaagaaattaacaaaatggcttaaaggcaaaattagagcaaatctcattttcttaggagactctgcatttcatttattgttatagttcttacttcagagacagggaaggaagagaaggtagcttgatagtaaaataatatccttcaaggtaaattccatgaatgttaagtcaagcagaacttctatttttgtagcattctagagacattgaatccagtttcttgatgtttcttgccgcatttctcactctgttctacagagcaatttggtttacaggtaatttaagcttgggataaagctctggttaattcagtttctggataaaagaaagagtaattcaacttaaagatcaccatagaattttaatcatagagatgagaaagcaaggaaaggcataaacctcgttagtggtataatgggaaaagaattgtctcagatagatggttctagctcttgaagttttgctgtaagctgtaccagcactagaaaaaaggtacaatgggaaatgcagacctttagttttgtccaccttcctgatgttgcctttttcacttcagcttttcaacaacgttgctgaaaaggtctaccagtcagtgcccattatatatacgtttctcttcctttctccaatcccatctaaataatgaattctgtattccagatcttgatcctcattttaaacattcatttcctttatttaaattttacttatattgttattactttataccttaagatattatattttaattatagtgtttttattgaaatgtaatttttacatcatgaaatgcagactctaagcacacagtttggtaaattttgacaaatgtatacacctgtgtatcccacacccatcaagataatagaacattttcatcaacctagaaaattctgtcatgccaattcctaggtcatcagtgcctttcagttcaaaggagaatgtagatctgatttccatcaacagattcatttcacctgttgtggaattttatagaaatagagtaatacagaatatactcttcgaggtctgactttctgcatcagaaaaatattttagagtttactccatgttgttaaatggtatttcattaaataacacacctcagtttattcacctgtttttcagtttgtggccatttgggatgtttctagctttgaaatattgtgaataaagctgctataacatttttgtataaatctttttatagatctatttttttaaaattctacctaggagtggaattgctaggtcataaggtagatatatgtttaaatttataagaatctgataattttccaaaggagttatacctatttacatatccaccagcaaaataatatagttctagttgcttttcccttaccaacatttggtgcagccgtcagagttttaattttaatttggtccattccagtgggtgtacagtgatctgtcattatggttttaatttgtatttccctgatgattaatgattctgggcactgttttatttgcttattggttattgcatgtcttttgttgtttaatgtctgttcaatttgttgtttaatgtctgtttaatgtgtctattttttcgttgctgctttattgagttatataaatactttattctgaatctaagtcctttgagatatatatttgaatgatacatttcctgccggtctatgattttatgatctgcctatttattttcttagtggtaatatgtcaaagaggagaagtctttaattttgattaagttcaatttaaatatttttctttgtggctagcactttctctgtgttatctaaaaaagctttgcctccccaagttcataaaaaatattctcctatgttttcttccaaaagtttcataattttagcttttagatttgttactgatcaatttcaaattaatttgtgtatctggtgtgaggcaaggatcaatttattcatattagattattcagtcatttcagaaacatttgtgaaaaaaacttaaaatgactttccttaatgaattccctaggaacctttgttaaagatgaattgaccatatagctgtgggttatttctagattatcttttctgtcccattgatttatttgcctatgtttatggcagtgttacagtaccttcatttctgagttttatggtaagctctttaggtactaatgtggaagtatctttaaaacagagtgctgaatggaaaaaatgtacagattaatatgtctagcttttgtctaaaaaaagagaaaataacatatgttcatgtatgcttgactttgcattaaaaaccttggaagaacacaaatgatactaaagacatagttacctgtggcaggtagcagtatatagttactagacatatttgtgacaggaatataaagaggaataggaatttttattatatttttaaacaacatgactatattaattatgaaaagattaatttttaaaaagagtaagtgatataggaaatgtattctttctcagagtagataaaacattgagtgggcaattcattgaaataatgttttctaggtcccattagatattttttgggccttgaaatttttaatatctgttttacttgacaaatatttattaagtgccttttatgtatcaagcaatggtaatacagaaggcaacaagactgacatgttcctcatccccatggtatgtatattccagtggagggaaaacacaataaatcataaacaaataaaaaagatattttcagaatgtgataagtgctataaataacataaacatgacagaaagaggcaagatgaatgtgaaatggaagtcctggagaaggtcttccagtgtggtaacttaggaactgagattggaatgccaggaaggattcagagatgtgaagaatttgggtgttggggaggaacctgcaaaggaaaaggccctgaaaagggaaatggctgaagagaaacaggaaagaaggcaaggtggaagagcacggtgaatgtggtgcagaataaaattgcggcgacaggtagggactaaatcaagctgaactttagggaaatgatgaggaatttgggttttattttacatgaaatgaaaaactactaaaagttattggaagttactgaaagagtataatgatctgatcaagattaaaaaacaaaaagcattcattttattgggggaaaaataacagattaagaaggggttggcagtgagaaaggaagaaaatcagaagttacatcacataagccaagaaacaatagtgtttaaaaaagaagaaatgtcccccaaatgttccaactgaggacagagaaactgtccgctagatttagtctcatggaagtcttctatggtctgacaagagcaatttctatggagtcgtgggtagagaagatggactagaatatgatggaaagtggatggactctctattttatactcacctccccacctcactcccaacacatgaaagtgaatgagaaataaagaagtgaagaaagaagatttagatgactctttcaagtgctctatgtaaccgtagatacatggagatgttgtgtatatccaggctggcatatctgtgtgttggtttagcaaatacatatcaaaaattcttacatgaaaagctcctttataacaagatgttctcacttttttagtgacaaaatcccatgaataaatccaaaaagagtctattttatataaaatcccaccctgttggaagtattgcaagtttccactgaaatttttaatctgacttctagatatatttttggagtgttgtctattttgtcagcctgccagattatgtcaaaatgttgatatgtaataacagtttatctcgtgttcctttatccaccctatttacccacctcagctgtgttaactgtccttgactgattccactgcatcattaatactgccatagggaaccgtgccctgatcattcatactgccactaataggatgccaagtggatgtttcaaagttggatgctgatgattatcattgcgatgtatatgacatcgctaagacagcattttcagtcaaaaatatggctgccgtttaaggtgtgagctttttgcctttttacctagaaaaacaatgatatgtaaatttcttattataatttgtattactctactcttatttgctatttgtcaactctgcaagagacaagggttggtacagaaaatatcattttatcagaaggaaaccttgtcttctacagtaggtactaccttcttgagctgattctggataataaagcttgcttcgcaataatccagagttttccaaaccatatatttgactccctttactgactgatatgcaaagttgtgtttaactatatggaaaattgtgaatccttttcatccaagtctacacactccacttgcttttcccttctaccttgaattcatgtgcattcccccagttttctgcctttgtaatggaggcttcagttcttctgcagccacagttgcaggaaacccaattgtaatcagcagctgccctgctgctaaaagctattagtgccaatgttgttaatgaccgacccagttgaatgtgctgatttaaggggtagacttatttcttgtcactccctagggccttgttcttaaatgagatttctacgttgtttagttgtttactcctctagcataaggagtattaaccactaacaaccacacttcgtatatcagcacgttgaattgaaataatggggaggttaagacatatcactacctttgaggtatgaagacacgcgccctgaaaaaacttggctcctacccctaatttttgcctaaagaagttggataccactgcaatttgctctgaagttatacatgttattgtcttcaagggactataggatgagaagggtacagttaggtttcttttcagaactaaacacattagcagtaacctgcaaaaatcaataccaattacttgcaagcaagggcttaaaaaaaaaaaaaattactgaagctacagaatatgcccataggtgaatggcttaaaacaaagaaaatactggcatagctggtactctcacaaaatagaagcaaaagtagtaaagttctcttttatttattttggcattttggtattaatttgtaaaagccaacaactgttatatttaaaaagaaaaataaataaagcagcaaataactcaatataagaaggctattttactgtctccctggcatgactaaggtttgtgttgtctttctagcagacatcaaggcattcagaaggtgtatggggatggcttatctatataaaccagtaaaccttttattcaatacccagacattctgcatgccaatattatgtgtttagtgtctcgagattctatttagcagaaattcactttgaggggcttggtgaagccttcagaggtttaactgtgtagtctctcctttattcaaaaggctgaaataatatttttccggtttctggaattcttaagcttgcatttcagattaaactatcgcagagagtagaatttcttccttccttgtcttctagtagtaaagatggggcacatatctgtaagatgtggacccagaaactctactctcaagtctggctatgatgacgaagtcttgagaagctagtaagccttgctacctcattcaagtccacggtagagttgtgtatgaatgtatggagaggtgggggaagttccaaatactacagaatttccccatagttaacagccctgcttaccaaacaattgaggccatgtggaaatggtacctatcattaaatctcacatcagaaggaacgagttttggcatgtctgtatcgccaatatgagtatcaaaaaaggtaactgtggatcttcttggacagtcattttcctggacttcagtttggtcctccctggtcataaaatgatatgattcttaatacttgaaaaaattgtcccaaaacacaatatcacccaaaaaaaccctcttttaccagcttcctttttttttctttaattgcagagcctcaaatcgatatttaagaagtaagagaagtgaatggtggtcacacaatgcctgaaaaagaaagctctgagtagttgtctgggggacactagaaacaaaagaagtgtgtcacgtgataccataatggcatccagcactttccatatagggaaggcagacagggaaaagaaaattttgcttaacgtggattgaggaagtagtggactcaagtaatggaaaggaaatgaattttacagtattctgaggtactggtaaatttacttgctacggattatactgaaggtaaaatgctgcttaaatagagtctaagattttatgtatcaaatatttacctaatttttaaagcattaaaaatgttaggattcaatagttatagttactttcatcctttgaaacaaaaataattcttgtttcaattttatatgttgagctgttaaaagaaaattgaaagaggcaaacaatatatacttatttgtctctatgggtttgtgcagtttatagatatcctgagcagtgcttctagtgagcgttcttagtagcaccaggttggttgttaatggagtattgacccagcaatttactggggcaagcccttctgctctactcagagttgatgtgttttatattacaattgcatctaataccttattttacaacttcaattaatatagttgggtagaactcgaagaaagtttataacaaagctatgaatagagtaattcattattataaaagtgtactttgagaggagaaactaggattgtttttcctcagaaagaaaacactgatgtatgataatagtattctccaataaaattaaaaataaacatctaaagagacataacatttctgttgagaatagaaaacctgcactcgctgtctgcaaacactgggataatatctttcacaaaatgtttataatccagataaaaagagaagatatatatgtgcaaatcaagagaagaaatgaaatagagaagaaatgagagaagagatgacaaccactaaacaaagagtggagagagagaagtgctctgacagttggagggcaacagagatctctctgcactgaggaggccaaggaaggctttttaaaaagatgatatggggtgtgggtgttgaagatagaaggtgggatgtaaaatataagaaaaagggcaaagtttttgcacgaaaccttaaggtgaccattctcacttcggttccttggtttttgtggagggatagtaggtagtaaaattagggtgagaactttgaggatagattgagggtagtaatttacatcaggctaaggagttgtaggcattctcctataagccaggcaatagaaggccatcagaagtttacaagctgggatataatatgacttttataaacagcaatatgccagttgtgtgaaggatgagtttagagaaagactgaagctgagaacactaagaaaatgttttaacagtgatagggaaaaagtaattggatattttggctgaactccttaatagaaataatgaaaggaacacaaaaggaaaacacaaaatctagttcaatgaatacttaaaatttataagtgatagtataatcctataatttattctgaattaagaatccataattctgattctataattggaactatcccagaattctatgtcctatttgacattagtttgacttaaagattggcttatgtctcaatcaatcaatttgatggtgaccaagaatttcctttcaatttacagtttaatactggccagagaatggaaagtaaaaagccatagcacatgctatatatatgatccatagacttatcaaattcaaatttaatggggagtctaaaacagctatttggcatttataccccaggttttttctaatattttatcagagatatcaaagagacttcaaactcaattcactgactgatataaacagcaagctatttcaacagatagagaacgctgggataaagaaaaagggcttggaatttttttgaagtgaaaaaatatgtgtaaaaaatgcatttctaatagtcacaggacaaaagtggacagaatttcccattacagtaaaatttaatgaattcagttggttcttttaaccatcatatggtctcatcaagaaataagaaagaatatcattaagtggatatccccctttacataaaagctgaatacattttttttttttttttttttgagacggagtcttgctctgtcacccaggctggagtgcagtggtgcaatctcggctcactgcaagctccacctcctgggttcacaccattctccaacctcagcctcctgagtagcgggactacaggcacccactaccaagctcagctaatttttttctattttcattagagatggggtttcgccattcacaggataaaatctgaatacataatacattttaaggactgaaatcccttctataataactttagtaattactcactgttgatgaaaaatatcctaggccaaaagttttctctgtttgccccaagcagatggagtaagggctctgagtcaacctgacttccctctgcatggtgtcaagcactctgtggcttcatggccttgcaatccagttaatccctaggaaccaaacttacccaagtggttgtgtaagttgtacataataaatgtaaagtgcttagcatagcacataaaatgtaaagtgcttaacatagcacataacaaaaaaaattgttgagtaaacgaatattttgctctaaatagtgtgggccacaagatctactaaacaaattagattgtaaaacttctcaagggatatcctcggtgtatttggtagaggaaagaggaaagagatttgtaaaatgattgaaatatgttacttacctttaggattttttttcttgccaagctttgggttttgaacttgcggaatcttagagtcacaggaagaagaaatagatagctcctgtagtgctggctatagtctcatagagcccaaaaaggtaggaaggagatgatttagaaagtatgagagggtagaatgccagggaggtttctgaccagttgttttccaggccaaagcaagtaatgcaatgacttcttgtattaaacccatcatttatttaatcaaagataaagcatatttctattatttctataataatagaaattctacaagaaaggagagaaacctttaagttttccctaaagaaagccattcttcctattcttatgatttctgatgctagctacactgctttcaaaacacacgatcctttagggtacagaggagagaaaaggaattcgtttaaaacatgattttctatgtagatcatcaacgaatgaagaaagaaactagaaaaaagggggaagaaatgggtgaatgtagtatacttatttcagatatgaagatgtgcttccaggtacagcactagaggtacaaattcattctagagctttgttcactgctacttactatctctggaactacagtcactgcagaaccagggcattgaagcccaaggttaatacagattgtagggagcagacaaaattggatcgaagtccagatttccttgttttctaactggaaggggcttgggcatttcatttaataccactaagtttcaatttatccatatgtaaaatgagcctcatagaggtgttataaggaatcatagattactgcattcttccattctatgacataggcacatttcacattttaattgggatgattcttaaaatcaatggcacatcttttttggaagtgccacataaagtcatgaggcatcaaacaataaattctatcttaatttgataaaatacatgaaggtaataaaggcaaagtgcctctgacaacatctggcatctaataagcaccagcaaattgttttggggtgatgctcagtgctgttgctattaccccatgctacaccactcagggaagcatctctttcttcataaatgttcactgatactccagctcaagtgaatgcagtctagtgcgtattttgtgaaagagtaattaaagtcttaaatgtcctagtttctctaatcatctaaaatatcatacttttaatataaaaataataataccttaaaaatgaaatgatacatctttggaacatttatcaccttcaaaggacttgcaatcctcctacataataatggtactatattacttagttcttgggtatgaagagtctgtactgcacatagcactctgctaggcacgagttttccttgttttttctaatacaactttgatatgacctaatttcaccaccaaaaaaaccagcaccatatggcaagttccccatttcccctaaaataatttattgagcctttagtgtgtcccagtgactgaactctttatgctgaatttttctcaagatttcttcaggacatcagaacataatgcagattttttttcaggtggccctctaccaactggatatgaaattggatcagctggaggcaagaacagatggggttgagcagcagatggaaagatcctgtttaggatatgcagaatcactctggcaaaatcaatcatgccacaggagttagtttcagtttggtgaaagaaaatgaactcaagtagacaactgagttaccgggaaattaatacgagctcacactttagaaagtcttgattaagtgtcaataagacagatgagctaatgatgttgaattaaaagtcttaaatgtcacgtttgtcagtgatcataatagctctccatatttagtgcttaccctttaccaggcatttcaggtacagatctcattcaatccttacaaaaaccctgtgagacaggcatttttccgatatcacaaatgcttaaatggaagttctaagtaaattgatcaaggtcataggactctaggtaacagaaacaggattggaacttgtctggctagctggaaagcccacacaaatcatgaacactctactactttccagtgttaaatgatgtgtatacaagaacaattggaggagcatacggtcaactttcagatatcctaaggtcctttccacagtaacaattggaacaggcctgtgatggtcagagtgaccaccgggcatctgcttgaatctttgtggggaatacagagcagcgaggggggccacatggtccccagtaaagcagaggtcacaggtgtcacatacaggctctggtgaatcccacggagtccctgtagaaatctcacatctgcttaccccgagaaggtctcccagaatcctggagctgccttgctccagaagtggatctccatagcaaccttaggccaaaagagtctcatgcacccgttctagtccaaacatgctatgatggactttgtttccatggggcattcaatacatatgtgaatctgagattgtgagtggcttggagtacgtactgtctcagtccattcgggttgctattaaaaaaaaaaaaaaaacataaactaggtggcttataaacaacaggaattcatttctcacggctctggaggctgggaagtccaagacctgccaaggtattggtggatctggtgtctggtgagggggagttttctgttcatagatggctctttctagctgtgacttttcatggcagaggggaaaatgcactctctggggcctcttgtataaggtcactaataccatatgtaaaggctctgcatctcatgacctacttcccccccaaaaggccccacttcctaacatcactttgggtgttaagatttcagcatattaatttggtgggggtcacataaacatccaatccactacatctactttcttcaaaactgtaggcaagctgtaaagaagggaaaatcatttcagcccaagtattcgccctgctttaactttggagcaaaagcaggaaatagaaggaacttatcattcattgactgcctactatttgccaagcatggaaagaccatataatgggttggagggaaaataagataaaagtctgagcaacagatggaaacacatctgccaggtgccatgctctgtacgcattacttcattccatacagcattctcttgtattagtgagttcctgctgactgctacgttactttttcttctcagccaaatgttcaagaagcaggtactggttatgagtaagcatggtgaaaacccattttctaagaaacagaagagatggcaagtgtatcctctcaaagaattaaattttgttttctgccttatttttctcaaacaaaacaagcttttaccaattgcattaccatagccttgctatctatacataggtatcacagaaatcttaatctttgagttttcaagttagaggaattcttattaagcatgagagttaataatctcctgagacacaaatatgcctggtaatatgagaacaataaatgtttgttgggtccaaacatgaattaaagctgtatatgttatgccttaaagacattaaattaatcataaattatagtgattaattacattaaaacagtagcattatgaatacacaagatacaagtttcagtttaaggaaaaaccatattttaataatccccaagtacgcctgtattctgagacactaaaaataattatatgctactaactataccttgaaaacgcatacactcttactgaagacacagaaatgaacagaacagaactaaaaattgaatacattttgtgacacatgatttttttcattgtaatatttctgaaatttggatgcatcttggaatctatgacatcttatagttgccttcagccaggtggcagtcgtgatgtcacaagcaatgcttgcatgtaggagaacaacgtgtaagacacatgtcagcatcttgcaagaaaacctcagagtcaattacagaccactcttattattcctaggacctacttgttttgaaagaagatgggtgagacaatgtattatatatgtttaacatacaggaagcaaaagtaaaaaaagaagtctagttctatgtcattgccaaatgacttaagagtctagcaccacagcattttagttgcttaacagatttaaatgttacattgcgcttgctttggcagcacatatgctaacactggaccaatacagggaagatcagcaaggcccctgcacaagaatgacacataaatgcataaagattccatatttttttggaacacaaaggataaatgcttcaggggattgacacccaattttccatgatgtgactgttacacatggcatacctgcaccaaaatatctcatgtaccccatgaatatatacacctacaatgtacccacgacattaaaaataagttaacattttttaaggaaatattacctcatcttatctcttgatggcatagaaatttatattttaaaactgttatatataattatataattttataatcatacaattatatttttatatttttaaataaatatataatttaattatataaacatttaattaaattatacatttaattatataaacatttaattaaattatacatttaattatataaacatttaattaaattatacatttaattatatattaactatgtaatttaattgtatgtttttatatatttattatataatatagatccattatctatatttatacatatatctatatacataatatatttaatatatattatttatacagaattatatataattaggcttaataactctgagtcaaaaacgtgattcaaagagtcaaactctacatgaaaggaagtttcagaaatatctcacccaattaactttgcttatattttattttaagtatatttaattatatttcaatatatttttatatttcaatatattatattgaaatatattatattgaaatatattgaaatatatatttttacgtttcaatatattatatttttatatttttatataaagcaatatataaaattatatttcaatatatttcaatatattatatttcatattatatttcaatatatttcaagatattgtttttatatttttaaataaatattttataatttaatgacatataaacatttaattaaattgtacatttaattatatattaactatgtaatttaattatatatagttatatatatttattctataatatagatcattatatttatacatattttatatgttatttatacagaattatatgtaattaggcttaataactctgagtcaaaaacatgattcaaagagtcagactctacatgaaaggaagtttcagaaatatctcacccaatttattttgtttatattttatttttgtgtatatgcaataaataatttaaaaatttataatcaagctgaaaagagttctttcagcaagcacaaaattttccagtgattaaaatttactgagtccgtttatttggtggtatttttcttaggttttttttttttttcatgaaacaatgataactgctagcatcgtagatacaacaaaataggggtataaaaatatgcgggaacatgaggagatggtatacaaatctacagaggcatgaaacaatagaaattagcgccaatctggaagttaggagatagagatcccaggcttggttccataattaaggagctgcgtgatcttgagcaagtcacttaatctctccgagcttcaaccataaaataaggagctgtgatagataatttccgagctccagagagcagtgatgtaagcaatcaggaaaatagaaccttccctcgatgctccaaggaagaagggatctgatgtgggtcactatgtgcttatgaaagtgacggaaaggagtcctgaggttgaggaaggccagtcactgctggcctcagcttctctaatggctaccgagggattagacattgcctccaggcaggtcagaaactcaaggaaacttccccacaggtcacagcagcctccggtatctattggtgaactgctaaaggctactaaaaaccctttaggttccaaactctgcatgtcagcaggccactgccccaatacacacttctctgccatccaaatctcccacaggagtttcttactggtcgcatccaagacaaagctctgttaggcaaggggttctgggaaatgtagttcctacactgccagtccctgtgctgtaggagagatcatagaatgaggtaggaatggggctgagtgtcacagacagatatctggtaccccagctggggagcgagggactatgatggcaacgcaggtgaacaagagggaggggacggcatgaagacagattcagaagtcatggagaggaaggtacacatctgaaagacacctcaaaggaagaattgaaagattagatatgggttactttttctttccacactagtgagtcaatataatctataaatcaagtctctttagctcctctgctgactatcatgttctttttccctagctctcctgtaacagggaacaatacaccctttttcttgtagtgcaagaataatgatttgctggcagaagctccgtgaatcagactttgcactgaacatgttatattgtttgggaacccagctaaatttttccatgactgctttaaaagtgatttccatttaaagctaggtggaacaaattcctgctgctggctaaatcttctttttcttttccaatgaacagaatctcataaaaaggactattgctcttttgtacttttctgtgatgcattttgtgttggggtctatggaggaagccatctaaaactacagagtgttgtaaaaataccctcgtaattctactagaattcaactttttaatagctgtctttcttctccttttatatctccttttcaattatttctttccctttggtactctgacagactaatgtttctgggtctttcatagacacctacatcgaccaaatggatccatctcccacctttgagatcctcattaaactctggcagagtttggtggctacatgaactcaaaccccagacgtatggagaaagaatcactttcaatagaaaacctaacatcaccagtacttacaattctgactaatttttgtcataaataaatacagtggacgtcatttatgtccattttgagtctgtatctatgttatatcacactttgcctaataataatgctgctgtcaatttaatgagggttttagcttacataaataacaaacattcagttcagtggggtttatcttaaactgtacagaggtgcttgttttattataattcaactgaatcagaaactttctttctctccacttgctcacactggcttctaaccaactcacgtttctttaatgacaagtgctaaataaacttcacctggggactgatctgccaataaggataaaaaaaagaattgccccggctaccaaagtatcattgtttcatctccaatgaaacattcccctgtaaaaccatttctctctatgcaaggacttggagtaggaatccagccacagaggtcagggaaggccccaccaccaccatccccactgactcagaaaaggattaaaatattttaaagaaggaggaccagaggacaaaacgtcagcatggtcaagaaaaagtgagcagagccatgaatcgagtgatgaagttgtagattcatagaaaacatgtaaaggctatcatatatgtagaggtaaagtgtcactcctcgttttaagggtgaagaaatgaggcttgcaggagttaagtgtcacacagcagatagtggccaagatagtggccaagccaggctgagtcccatgtccaaatcagtgtactgcttgcttctctgtgcacctgtcatctttagtggtggtgaatggatgagcagtattgaggttaataccctaagaaataacacagcaataatgctcaagtgtaatctagtaataataatgattggaaatcaacattactgtagtgacttcaattgtgtgccccaaaaagatatgtccaagttctcatccctggtacctgtgaacatgaccttacttggaaacagggtttgtgcagatgtaatgcagttaaggatctgcagattaagatcatcctggacttagaaatctactctaaatccactgactggagtcctcatgagagaaaggagagagagctttgacacacagagaagcaactcatgtgaagacccatgtgaagagagaggaagagattgaagttctgtggtcacaagaccaagaatgccaggagccatgagaagctgaaagaggcaacaaacctcctcccctggagctgtggagggagtgcagtcctgctgaggcctccattgtggacttctggcctccattgtggatttctggcctccagagctgtgagccaatacattctgtggttttaggccatcaagtttgtggtcagttgttacagcagctttaggaaactaatacaactatgaaaatacccaatctaaaaagcaatccaggaagaaatttttgttgtcctagtggtttgttgttgtcattgttgattttaacaaaatatagctcaaataacagtactttgaacttttcagttaggaataattacacacgtaacggctcccctaaatgttttttagcctaaagactctgtcaacatttaatattatataaaaggctctgtctacctccccagcctcgtgtcctcccagccttccccttcccccagtattccagccacactggtcttctctttggttccagaacatgctaggacccttctcacctcaggcttctatgtgctcctcctttggctggcacactcctcccccaccatgcaccacctccccagtcaacatcagctccaaagtgcaactctacgggaagccctcctgcccctttataatagatcagccccacacatacactctctttgtaaactctcctaacaccctttccctcttcttcacagtcatgatcattgtttgtaatttttcatttatatttctggattgtctgtctttcctgctggactgtcactctctgacggcaggcacaggacattttgctcatcatgacatttcatgggtagcatgatgcctggcatatagcagccactcataaatatttggaaaataagtgagtgatagtatttagccttggatggagctcttgtctgttattcaaacttatagctgttctgtttccaacatataaaattgaaattgtagaaaaatctgtacatagtcataatttgaaaattaacttattttagtaatgtcttaatttttctcctctgagtttctaaatgaattcatgaaagttctgctttgtcccaaaggcatttcataaataagtaagcatagctaaaagggactcaaacctgttacatttcaccatgccatccgagttcatggataggtgaatttgccctaattagtattatccatttatataatcaataagcatgttgggtaccgtattagtccattttcatgctgctaataaagacatatccgagactgggcaatttacaaaagaaagaggtttaatggactcacagttccatgttgctggggaggccccacaatcatggcagaaggtgaaagtcacgtctcacatggtggcagacaagagaagagagcttgtgcagggaaacttctctttataaaaccatcaagattcatgagacttattcactatcatgagactagcacaggaaagacccacctccatgattcagttacctcccactgggtccctcccacaacacatgggaattgtgggagctacaattcaagttgagatttgggtggggacacagccaaaccatatcattctgccccagcccctcccaaatctcttgtcctctcatttcaaaaccaattatgccttcccaacagtcccccaaagtcttaactcatttcagcattaactcaaaagtccacagtccaaagtcttatctgagacaatataagtcccttctgcctatgagccagtaaaaccaaaagcaagttagttacaccctagatacaatgagggtgcaggcattagataaatacatcattccaaatcggagaaattggccagactgaagaagctaaaggccctatgcaagtccaaaatccagcagggctgtcaaatcttaaagctccaaaagatctcctttgactccaggtctcacatccgggtcacactgatggtgggctctcacagccttgggcagctctgtccctgtggctttgcaggctatagcctccctcctgactgctttcatgggctggcattgggtgtctacagctcttccaggtgcatggtagttctccatgagcaccccgcccctgcagcaaatttctgcctggacatccaggcatttccatacatcttctgaaatctaggtggagggtctcaaacctcagttattgacttctgtataccttcaggctcaataccatgtggaagctgccaggacttggggcttgcaccctctgaaaccattgtccaacctgtaccttgaccccttttagtcacacctggagcggctgggatgcaggacaccaattccctagactgcatacagcacagggaccctggggccaccccacgaaaccatttttctctcctaggcctctgggcctgtgatgggagggactgccacaaagatctcttacatgtcctggagacattttccccatagtcttggtgaataactcggctcctcattacttatccaaatctctgcagccagcttgaatatctcctcagaaaataggatttttttttctatcacattgtcaggctgcaaattttccaaacttttatattctgattctctttttaaactgaatgcctttaagagcacccaagtcacctcttcaatgtttttctgcttagatattttttctaccagatactctgaatcatctctctcaagttcaaagttccacaaatctctatggcaggggcaaaatgctgtcagtctctttgctaaagcataaaaagaatcacctttgctccagttcccaacaagttcctcattccatctgagactacctctgcctggattttactgtccatatcattatcagcattttggtcaaagccattcagcaagtctctagggagttccaaactttcccacattttcctgtcttcttttgagccctccaaactattccaacctctgcctgttacccagttccaaaattgcttccacattttttggtatcttttcagtagggctccactctacttgtgccaaaatctgtattagggttctctagagggacagaactgataggatagacatatatataaagggaatttattaagagtattgactcacatgatcataaggtgagatcccacaataggccacctgcaagctgaggggcaaggaagcaagtccaagtcccaaagctaaagaactttgggtccaatgttcaagggcaggaagtagccagcacaagagaaaaatatagaccagaagactaagccagtctagtctttccacgttcttctgcctgcttttattttggctatgctggcaggtgattagattgtatccacccagattgagggtggatctgccttccccagtccattgactcaaatgttagtctcctttggcagcaccctcacagacatacccaggaacaacactttgcatccttcaatccaatcaagttgacactcagtattaaccatcacaggtacctaatagattccaaagattgtattttaaaatatgttttaatctatagaagagaaaaagaagataacaagaacagtaatgagaggtaaatcacagtgaggctgggtggcggtaaaggaacatttccagaggcagtcactcttgagctgagtcttaaagagtaggagaaagtgagtaaagaaagccatgaaggttgttttaggtcagggtttcttatttttgacatttttcacagaataattctttgttgtcaggggctgtcctgtgtgttttaggatcttaacagcatccctggcctctgtccatgaggtgctagtgtgacaaccaaaatgtctcctgaagatttctcaatgaactgaaaacagaactgcagtttgatacagcaatcctactactgggcgtctactcagaataaaagaaatcattatataaaaaggatgcctgcacttgtatgcttattgcagcactattcacaatagcaaagatatggaatcaccgtaagtgtctaatggatgattggataaagacaatgtggtgtatatatgtgtgtgtgtgtgtatatatatgtgtgtgtgtgtgctgtgtatatatatatgtatacacacacacacacacatatatataccatggaatactactcagccataaacaagaatgaaatcatgtcttttggagcaacatgaatggaattggaggtcattatgttaaatgaaataactcagaagcagaaagccaaatacctcatgttctcacttataagtaggagctaaatgatgtgcacatatggtcatagagcatggaataatagacactggaggctcagaaagggaggagggtgggaaggggaatgagaaattatctaatgggtacaatgtacactatttgggtgatagttatcctaaaagccagacttccccactgtacaatatatctgtataacaatactgcacttttaccccctaaatctataaaaatttaaaaattttaaaaaacgaaaacaaaatgtcacctgacattgcaaaatatctcccctggaatgcaccttcttcccagttaagaaccactggtgggggcagaggaaggagcctatctgcagttgggggtgtctgagttactgcagcatgtccaggtagctctaggagagtgcccgggagggagataggagagaaagtacaacactgctcttacacagggggtttcatgtcttatgctggggagtgtggaatttcatcctgaaagcacttatgcagaatcaaaggatcttaagtaggaagtggacatgggctaatttgtgcttaagaaaaatcactctggtcacagtggaaaggaaggatcgaatggagatcagaatgaatttgaaagaattgaatgtaatccagaagagaaatgattcatggggacagaaaggaaaggaaagggaagatagaaaggtactcacatcacatctctaagaccttgtctagaatgggatctagattcttggtttggatgatcagaaagtagaatcataaatcttctccaaaatccacttggaaattagccctcatgactttatgaaaaaaaaaatcaaacccttgaactcagaaaaattacttgtaaagttggttaagcataatctaggtgacctcatgatgtaataaataaaaatagccactacctccggcttcaaattcaattaggccttcagcaaagattatttcagcaaattgtcaaaaatattagtttttaatcaatgtattagaaaactgtagtaaattttcaccccctgcccccaagcaatgtctagacaagtgagacagagagacaaaatgagtaattgaggccatttttcttgcctgattgttcagaaaattgcctcatttctttgctttattttctgagtccacataatgataacagaaaaagttgtatgtgtggatattttttacaatctgaatctttgacagtgttgagagaggtaatcgccaacaaacacactatcacagcatttgccagatcgtctgttttctttcaggcttttgtcagtatctaaggcaagtcctttgtgtgagaactgactagataaaatgtcatgagcacctcctgtgagggaaagaccgagactgagatctcagtcataaagagactccccagctacaggtgctacaaggtgtgcaaaggcaattaacaatttggggcaaagcgcaattttcatagactctgttttgcaaaaaaaaagaccctacgctacctatttcacaaagttattcacatttctagctcatgaggaacacaggatattcaggccctgctaaaggatatgaataggtcatccaggttttgattaagagattgtttgaacaagtcccaagtgggaataattcaaattaaagcaagaatgtgtcaatacatctgaaatgttgaagaatgcaaaaatagtatttatacataaatataaaatataaatggaatttttatgtgttgatcaattatgtatttttaaatatttggcttcaataacaatataagaaaaatgaaattcctactaatccatagaataatgtgtactttcttttaagaaatcaccaaccttaaaatcactaaaatatgatacatttaacaaaatggtagattttaaattataaaccaaactgaattcagaaagtaaaaattatgatacacagtttatattggtcaaagttgccattaattgtttattatcattaaaaataaatacatatgtttcacttcacatgtgttacacaggtgcttaatattttattaatataaatgcataattcatttgctcttcacaaccacaaaaactagatacatgattattcccattttgcagataaggaaattaacacccaagtgaaatactttaccaaaggtcacataggtagtaagtaacaactgtgtgatcagaggagagcattatctccaaacttcgtgagagacacatataagcaattagtcccttacagactaagaaattttgatacagacaatttgttgcagattcataagatagtacagccagttctgtgaatcacagtgttatatttatttccacatattctatgttaataatataatttttaattccatgtattttaagttttcattcaataactgctataagtatatgcagctctgagaacaagggggaagagaataatttcagccatttaaaaatagcttttatatttagatttaaatatttcagttgcatttcttttttttttttttttactttttacttttctttttttttttttttttattatactctaagttttagggtacatgtgcacattgtgcaggttagttacatatgtatacatgtgccatgctggtgcgctgcacccactaacgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgatagtttactgagaatgatggtttccaatttcatccatgtccctacaaaggacatgaactcatcattttttatggctgcatagtattccatggcgtatatgtgccacattttcttaatccagtctatcattgttggacatttgggttggttccaagtctttgctattgtgaatagtgccgcaataaacatacgtgtgcatgtgtctttatagcagcatgatttataatcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctcaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtagatatgtggcattatttctgagggctctgttctgttccattgatctatatctctgttttggtaccagtaccaggctgttttggttactgtagccttgtagtatagtttgaagtcaggtagtgtgatgcctccagctttgttcttttggcttaggattgacttggcaatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacgatggggttttctagataaacaatcatgtcgtctgcaaacagggacaatttgacttcctcttttcctaattgaataccctttatttccttctcctgcctgattgccctggccagaacttccaacactatgttgaataggagtggtgagagagggcatccctgtcttgtgccagttttcaaagggaatgcttccagtttttacccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctctgtttatatgctggattacatttattgatttgcgtatattgaaccagccttgcatcccagggatgaagctgacttgatcatggtggataagctttttgatgtgctgctggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagttcctccttgtacctctggtagaattcggctgtgaatccatctggtgctggactctttttggttggtaaactattgattattgccacaatttcagagcctgttattggtctattcagagattcaacttcttcctggtttagtcttgggagagtgtatgtgtcgaggaatgtatccatttcttctagattttctagtttatttgcgtagaagtgtttgtagtattctctgatggtagtttgtatttctgtgggatcggtggtgatatcccctttatcattttttattgtgtctatttgattcttctctctttttttctttattagtcttgctagcggtctatcaattttgttgatcctttcaaaaaaccagctcctggattcattgattttttgaagggttttttatgtctctatttccttcagttctgctctgattttagttatttcttgccttctgccagcttttgaatgtgtttgctcttgcttttctagttcttttaattgtgatgttagggtgtcaattttggatctttcctgctttctcttctaggcatttagtgctataaatttccctctacacactgctttgaatgcgtcccagagattctggtatgtggtgtctttgttctcgttggtttcaaagaacatctttatttctgccttcatttcgttatgtacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactcaggacttgctttatgaatctgggtgctcctgtattgggtgcataaatatttaggatagttagctcctcttgttgaattgatccctttaccattatgtaatggccttctttgtctcttttgatctttgttggcttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcattagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactctcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacattggcctgccttgctagattggggaagttctcctggataatatcctgcagagtgttttccaacttggttccattctccacatcactttcaggtacaccaatcagacgtagatttggtcttttcacatagtcccatatttcttggaggctttgctcatttctttttattcttttttctctaaacttcccttctcgcttcatttcattcatttcatcttccatcactgataccctttcttccagttgatcgcatcagctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttcttctctcagctcgtcaaaatcattctccatccagctttgttctgttgctggtgaggaactgcgttcctttggaggaggagaggcgctctgcattttagagtttccagtttttctgttctgttttttccccatctttgtggttttatctacttttggtctttgatgatggtgatgtacagatgggttttcggtgtagatgtcctttctggttgttagttttccttctaacagacaggaccctcaggtgcaggtctgttggaataccctgccgtgtgaggtgtcagtgtgcccctgctggggggtgcctcccagttaggctgctcgggggtcaggggtcagggacccacttgaggaggcagtctgcccgttctcagatcgccagctgcgtgctgggagaaccactgctctcttcaaagctgtcagacagggacacttaagtctgcagaggttactgctgtctttttgtttgtctgtgccctgcccccagaggtggagcctacagaggcaggcaggcctccttgagctgtggtgggctccacccagttggagcttcccggctgctttgtttacctaagcaagcctgggcaatggcgggcgcccctcccccagcctcgttgccgccttgcagtttgatctcagactgctgtgctagcaatcagcgagattccgtaggcgtaggaccctctgagccaggtgtgggatatagtctcgtggtgcgccgtttcttaagccggtctgaaaagtgcaatattcgggtgggagtgacccgattttccaggtgcgtccgtcacccctttctttgactcggaaagggaactccctgaccccttgcgcttcccaggtgaggcaatgcctcgccctgcttcggctcgcacacggtgcgcacacacactggcctgcgcccactgtctggcactccctagtgagatgaacccggtacctcagatggaaatgcagaaatcacccgtcttctgcgtcactcacgctgggagctgtagaccggagctgttcctattcggccatcttggctcctcctcccttcagttgcatttcaagtatctttttctgctaagaatttggcctgtctgaatttcaaaaggcatttgggcttcaaactttagttaatggtaaaaaaaaaaaataactaaatatttaatttcctgaaatagttccaaattacagaaacagagagaaagcttaaataccatagaacaaaaattcatagaatagaatttatgaatcatgattcatacacaaaagaccaaacctctcaatgaataactgtattgttgacagtttgggaggaattttaattttgtttttttttctcaaatagtgagatcagagtcggaaaagccttaacatctccatattagagattctgtaactcacatcacttatgccaggctccagctacgtactctgaaaagtatattaaatcagaatgaaaattgttcagtaaaatttctcctagaggtatagtaaatatgattgatttaatacatcattgagattctactggaaaaatggcataaaacagcaacattctgttgccattttataactttcatttttgtaaagtgaccattagcataatatagtaatatcattatgacaatctgcacagatgaaaatatctcaaggccaatattacattttcatcaagtaaatgaccatgtgtttcaataaacacgattatgaatgttaatataccaacagattgagtattttcatttctcagcatcattgtttgtaggggaaaacaaattaatcatctttgagataacaggagtgtagacttttagaacatgatctgtttcactacaactattcttggtttgctgaataagagtcaggattttactccagactgtcctcatctgaggtcatcttatctgtccccttctgaagtaatcttgtcattatgtaaatacctatgcagcattatcaatttagagccagataatttaagatgaatcacgtctttattttgataagtatccacaggacacccatttgtacagtagaaacatgcaaagaaacctcttcctcctgcctgttctattgtcttggacaattcctgaataagctgttctccagccctgcacacctgcgagcaggccagggactctgtggacccagccatgccctttctgtcaccaaggccacatttgtggtcaggaggcaagtgagatggtcatcactttcacttaagtcctttttagcaataggcatgttaggcattggaatggatgtgcaagcgaaatggacacaaaccaaaaatggaagaggcaacctgtctatggccttaccatcccgaatatgcctgatctcagaagctaagcagggttggtttggctagtacatggatgggagaagagataactagctgagacttcagtatctagcttataggctgcttcagccttcaagcacagcttaattatatgtattactggggaagatccttttctggaaagaggcaacattttaagaccattcaagattaacctttacttgagcaaaaagaaatgtttctactttcaaatgctttttggtaaaaatctttaaaaaataataaatgcttcaaagagaataaaacagctaggaatccaacttataagggatgtgaaggacctcttcaaggagaactacaaaccactgctcagcgaaataaaagaggacacaaacaaatggaagaacattccatgctcatggataggaagaatcaatatcgtgaaaatggccatactgcccaaggtaacttatagattcagtgccatcccaatcaagctaccaatgactttcttcacagaattggaaaaaactgctttaaagttcatatgcaaccaaaaaagagcccgcattgccaagacaatcctaagccaaaagaacaaagctggaggcatcacactacctgacttcaaaccatactacactacaaggctacagtaaccaaaacagcatggtactggtgccaaaacagatatatagaccaatggaacagaacagaggcatcagaaataacaccacacatctacaaccatctgatctttgacaaacttgacaaaaacaagaaatggggaaaagattccctgtttaataaatagtgctgggaaaactggctagccatatgtagaaagctgaaactggatcccttccttacaccttatacaaaaattaattcaagatggattaaagacttaaatgttagacctaaaaccataaaaactctagaagaaaacctaggcaataccattcaggacataggcatgggcaaggacttcatgtctaaaacaccaaaagcaatggcaacaaaagccaaaattgacaaatgggatctaattaaactaaagagcttctgcagagcaaaagaaactaccagcagagtgaacaggcaacctacagaatgggaaaaaatttttgcaatctacccatctgacaaagggctaatatccagaatctataaagaactcaaacaaatttacaagaaaaaacaaacaaccccatcaacaagtgggcgaaggacatgaacagacacttctcaaaagaagacatttatgcagccaacagacacatgaaaaaatgctcatcatcactggccatcagagaaatgcaaatcaaaaccacaatgagataccatctcacaccagttagaatggcgatcattaaaaagtcaggaaacaacaggtgctggagaggatgtggagaaataggaacacttttacactgttggtgggactgtaaactaattcaaccattgtggaagacagtgtggtgattcctcagggatctagaactagaaataccatttgacccagccatcccattactgggtatatacccaaaggattataaatcatgctgctataaagacacatgcacacgtatgtttattgcagcactattcacaatagcaaagacttggaaccaacccaaatatccatcaatgatagactggattaagaaaatgtggcacatatacaccatggaatactatgcagccataaaaaatgtcctttgcagggccatggagaagctggaaaccatcattctcagcaaactatcacaaggacagaaaaccaaacaccacgtgttctcactcataggcgggaattgaacaatgagaacacttggacacaggaaggggaacatcacacaccaaggcctgtcgtggggtggggggaggggggaaggatagcattaggagatatacctaatgtaaatgacgagttaatgggtgcagcacaccaacatggcacatgtatacatatgtaataaacctgcacgttgtgcatatgtaccctagaacttaaaatataataaataataagaataataataaattatttttctgatttgtttaaaaaaaatcactgtattccttggctgcagcacagcagcaaatgtagctagtataagaactacttatcctgggtcccaaaatatagttgcttgaaaaagtctatattgcgaccttaatttttagtgctttgcctctttgggaactccagtgtgaagagaggtatgcacaacctcacggtcctcaggttgttatcacatggccgaacactttacaacatgaattcatgaattatgtagttaattattacatcaaagaagatctcgccgcacttatcacaaacactcttagttatagccccacaaccttaattgttattgccaagaatttctttccatccactcttcctattttgcaaactacaattacagaggaggtatgaatgaaaagttttctgtatcattccaaaaatatgttaagatgttctgaaaagttctgattccttgatctacgagtgacttagcaacatgattagatgagacaaaacccatagctacacatctttctctagaagtcttaatgtcgactcttgacaaaatttcagatccattcaaaatttcaaatacgttaaaataaaaaaattaacactctaatgttgagattgagtagactatacaaagccttccttaaagattacattttttgcattttctagttttcattcattgcaagaatgtttgtaattgctcagtgaatggctaatttcaaatctgtaccaggtaattctcacatctctgtcatctcacggctgacacctattgattttctttctttttctttcattcactttgagatcttcctggtccttgacattgtgagtgactcttggttgaaacctagacattttagatattattttatgagactacggatcctctgctggttgaaacctagacatttaagatattattttgtaagactatggatctgctgctgtcatcctctctctgcttttctttttcttctccacttactcctacccctttaatccagtgctcaagtaggaccagggaaacattaaaagttggcccacagatggaaggaacattgtacttcatgtgtcacatttaaattctccaggaagaaagggcttgtcaataaagtgtctttttaagtcacagatggcagtaaggctgtgctactcccaccttttctttctattcattgtctcctaatgtcatttattttctgaagtatctaagtagcaccaccactatccaagactgacagtctccatttatattcaatcataactcactagtgaagattaattggggaggagacaagtctgaattagaaatcaccaaagtagtattttaaaagaagtgcagatttattgcattcaattctagacctaattcagagacatggctagaactgttacgaaggaaatgtcttaaacggcctgatttaaagcatagagacaacccatttgtacattagtagaaagtaatgtgttttaaatctttaacaatggttttcttgagtagattaactaccgctttaaaaatcctatttatttatctcctacactaagtaaatttcaacacaacccttttctgaattttcacaaatactacaggagaggaatctaaattagaagctcgattatatatgttatttctgtttaaaaggcactaattaagctgctttgccctgtgagcactagaatttgggttggcacagtcatttcataatctgaactctaacacaattatttctggatgaaccattgccataaaatttaacaggctatattagctgttggttggcattgatgatctataaatactaacctttatctcttgatattttttctcattcttttttatggttaatttagaatttcactgattaggcatttgcttatataaagtgctttgttaagactcaaaacatttttaagcatgtttatgctgcaaagtgaatgagtgttgcaaagtttgacttagtgtagaaagattgtaagactagaagttacttttagaaaacctaaactatcttgtagaaaaattatctcacggtttttaaaaatggcgttcaaaattcagagagaacaattcaagcttgttgctagtggaaagttaacagtggtttagatcagttgtacacactgtgcaagatgtttatgtgctgacagcttgtgtgcctacctccacatcaattcggccattataccagctaattcttctatctaggattcataacataaaaatgtgcttcctctttctgagggaaagttgactatgggtagagaagagttgccgttatttcaccttgaagaataacaatataagctcatgtgcaatgaaatagcagacttattggaaatgattactagcttcttgaaagcaaagaagtatatattttttaacttcataaggatttagaagttgatcattcatcatccccttctgcactctgagtgctgaaccaactgaaaaagagatggaagcaagtgtcagacagaaatcaaaacagtagctcagactgtgtttctcttgtgacataggcccttcaaaccctactttttgaaagagtggctaggatacatgaagtcattacagtatcaactgcatacccacaacatttagaaaatataaaactccccagcccctacttcaaggttatgttctcagaaccagatatatagtgcagtctagccctgcatcatccagcacagtggttcctagccacatgtgactgttgagcactcgtaatatggctactgtgacagaggaattgaattttcattgtgttttaattaatttaaaattatatttaaaaactgattctcaattcactattggaagactttgaagtctacttgaaacaatttcaggtatgtgcatctactttttcaaccataagctacatggaacctaagtataaattagttatttctaattagaataattaattccattaaaatgaaaaggccaaattgagatatgctctcagtacaaaatacataagaattttgaagacaccgcccaagaaagagaatataaaatagcccatttataattgtttacatgttgaaagaattgtattttggatatacaggattaaataaaacacgaaaattgacttttaaaaattcatctgtttctttttacttctttaacacgattactagaaaatgtttaattacatatgcggctcacattgtatttctattagactcactctactagagtgtgatgtagattcaccctctagttggtgtgtaaaagtcatggtggagatttcattgtatctaggggaagaagaacaaactaatgaagggggagaaggagaaaaccttctgactcccaggaagccaactggtctgggccagtttgtgtctctgcatgacttctgagcctgaacttaagtggaagaaatctcccaccaagaagttacttacattgccaggtgtttgtttcttctcagacctaggattactgagctctgagtgtcatcttacctggatgcttcttctcctactcttgtttattaaaagctgttacttctctaggctttgattaacattaactattaaaattacagtgtaggctcggcatggtggctcacacctataatcccagcactttgggaggccaaagtggacagatcacgtgagatcaggagtttgagaccagtctggccaacatggtaaaacccggtctctactaaaaaaaaaataagtacaattgcaaaacaaataaataaataaatctgcagtgtaaaactctcttttactctctattttcctattgcaacataattcagctttccctgggtagccattccttaatcctaggtgagaaaaaatatatattaaagatgaaacatctactaatgcccagccctgcaaaaaacttatactcccatttctggtggaggcaacattgaaggttggctctctggtgtctaaaaagatgttctgcccatgtcgatttgaacacctattttttgtaaaaggccttgccctttccacatggactatgaaggacccacagaagtgaaactgtgtccccagtctaaactccctgggagaacctctcctgactcaataaagaattggtttttctgcccaagaacagagctctgcttgattagtttgaggtcgaggagaccacctggatcaccaagataaatgctttttcttgctaacccaacgcagaaacaggtacatttctcagttcttcaaccggccgaccctgctgcctcctggagcccatatagggtttcttgttcagccatagttctagaccttggctgcattttggaatcacctttctagtctcgagcataaaataaggcccagagcccaggccagactcactacatgagcattttcagctactaaggagaacttgaagaaaagaaattggccaagcagcggactcatgtgtgccctggcacttttcctatctcactaatcgcccttctcatatcataactcacccttctcatgaaaaaatagaatgaataaatgtggacggggaaatgccgaaacaccctcctcataacttgcacacgaatcctcctctatgttcgaaggcagggaaagagagaaaatggtaccaaagatagcctgtgtgcagtacttgaggcaaggctttgcatgtttcaagcgcccaatacttatctgttgacacaaagagtgccgtaattatgttagaattagtttggctttttttttttttctgctctagaaacattttgttcgtataagtcaaaaattagaaagaaagtttggaatttaatttcttatcaggcaatagccaagggaaaatatttctgttaaaggagtaatcatacagaacagctaaaattccaggaataataaaactcaggaaattttggggggagtggggtggttaggttttggaaaatatttgtcagtaatatttgaaaatccagatcttccttaaaagtctacagatttgagtgtacccctcacccaaggaaatctgtctcaagagacagaatcagtccatttttcagggttccccaggaaagtttgtcacagccagacataaatgtgatgaaaggcaggaaagggagagacagaggctgggacaaagaagatgacagactttattggtaacattaggccagaatgataaccataacccaggctgtgttttcaaagttgttgttgtaaactaaatgttttggtatatttgtcagaactttttatcttggttagtttaattaaaataaagtcggtagccaaaataaaattatgtaaaggttaatcaggatgtttcctgtattttttgacataaaccaaattaagtagttatttttctaacacatggaattcttacatttgtctccgtgcaagatgtatgttaatgttagttgttttactacatttgaaattcagtcttttaaaatgggttttctctgttctcctccaaggctatttgagcatctaaatatctacatattacatggctgttggcaaaagttttcaaatgctattcactcaatttgaaaaaaatttgcacttcttataaagctagtatgaatgtgactctaaaatctcaccaattggcactaatcaggttcatcatcaaaataaacctgataaatattaaaactaaattgttgagttggttttgtaatgtcaggattttcaagacaacaaatggccaagaacttggcgtcagaggaagtcctgctttcggttgattcttgatgctgattgagaacaggcctcctaagcactgatgggaatatttgcctctaagaagtacagcccatttaccacttagaagctaaagttcagaaataaaactctgacacaacaaaatatcaataaagccagatagagcactagaaaaattcgtaaatctctaatatgaatatacatctctaatacaaattacattcaagcaacagtgatttgcctcggctgcaagtaattatgtacctattgttaaaatagtgtgagtcacagcaagaacatggacaatatcaattcccttcagagactggactctgtgaagcctttccagttctaactacacagtacgatctttttaaaactatcagctttgcactcatttcagacccaagtatgttgaactggatgaggtattactttcaaggacaaggactggacgttaatcaaaatgaaaatactctttttttcttttttgagatggagtctcactctgttgcccaggctagagtgcagtggcgtgatcttggcttactgcaacctccacctcctgggtgcaagcaattctctgcctcagcctcctgagtatctgggatgacaggcgcctgccaccatgcccagctaacttttgtattcttagtagagacagggtttcatcatactggccaggctggtctccaattcctgacctcaggtgatccgcctgcctcggcctcccaaagtgctgggatgacaggcgtaagccactgcgcccggcctaatcaaaatgaaaatactttcaacatggaaataaagctttccagtgctaaagcttctgttttcttagagcaaaagagctccactaagaagaaaactgaatgttattgagatgttgtttaataagttcctggtatgtagattgaattgtgtcactgccaaagaagataggttgaattcttaactcctggaatctgtgaatgtgaccttatttgggagttgcagatgtaatcaagttcggatgaggtcatactgaagtaaagtgggccctaattcaatgactggtatcctcataagaaagacatgtagacatagccacacagggagggcgccaggtgaggacaaagttagagtctaaaagctacgtgtacaagccaagaggaattaaggattgctggcaactaccaggaactagtaagatgcatggaaatattctcccctagagacttcagagagagagcacagccctgctggcacctgcattttggacttttagtctccagaactgtgagaaaattaagttattttgtttgaagctacccagtttatggtaatttgtttcggcaaccctgggaaacttctatataaggctatgtcagaactcctcttatctcttaggaaaccaaagttctatccttaagcgaatataagatgtaagttcacagataactcagaatgtcctcccgcttctcaagaactagtcctgggtttgcattatccttataaatgccctaagatgattttttcaagcatatgttaccaagaagtagggaagtttcagcattaacaatacatagcttcgtaacaattagccatctgtttataatgctgttagggatcgacagcatctcaatggaagcagggaaaacaacagaaatatcatatctgccaagttctagtcatctgttatgttacatagtaatttgtcatctcatgagatcaccaaggagagaaaaaagccatgccgtgctacaaaataaactctgtaaagcaggtagtttaatagcaaattaatgatgtgctgacaagatcaagaccaaaaaaaaaaaaaaaaaacatgtcatattttctgcagtgcagctaataatgcaagtttgtaagctgtctcacaagaaggtagtatttattttttccaaggagctatttgaaaaccagagagttaacatattttaagacagttttcctcaatgtcagtttattttaaatattactagagttcagatattatcttgctatcactcttaatatccatcttaattatgggagtccctgtggtaaagtctaacctctttcaatctcatctcttgacttgatgattcatttcaaagaatgtgttagtacaatggggcttcttctcaagagcaaagtaactttgaataaaatttacaaaagtaaaagaaataaagcagatggcaaatattgcccacagaattggttatagtatcattatccattaagaaatgaattttgtacaatagatgatttaggtcttacttatctgtctctcataaatatgtatatatgcaatattaagatagatatactgatattgcaaactggcaataaaaaaggtggctttaatatttcgtatggtttggctctgtgtccacacccaaacctcatcctgaattgtaatttccatgtgtcaagggagggacctggtgggaggtgattgggtcatgggggcggtttcccccatgctgttctcaggatggtgagtgagttctcacaaaatctaatactttgaagggatttggagactgggtgcagtggctcatgcctgtaatctcaacactttggaaggccaaggtgggcagatcacctgaggtcaggagtttgagaccagcctgaacaacatgctgaaaccccatctctactaaaaatacaaaaattagctgggcacggtggtctgcgcctgtaatcccagtgttcaggaggctgaggcagaagaatcgtttggaccaaggaggtggagattgcagtgagcagagaacacaccactgcactccaacctgggcaacagagtgagactccgtctcaacaacaacaaaaaaaattagccatgtgtggtggtgggtgtctataatcccagctactcgggaagctgaggcatgagaatcacttgaacccaggaggcagaggttgtggtgagccgagatcacaccactgcactccagcctaggcaacagagtgagactctgtctcaaaaaaaaaaaaaagtgtttggcagtttcctccttgctctctctctctctttcctgccaccatgtaagacatgccttgattccccttctacttctgccatgactgtaaatttcctgatgcctcctcagccatgaggaactgggagtcaactaaacctctttctttataaattaccgagtctcaggtcattcatggcagtgtgaaaatgcactaatacaatatttggaaactctatgcaacaatacagggttcatatattgtccagcctgaattaaagtgctatgtgttatctctcctatcaaactatctttaagatgatgacaaagggatttcaggtgacaacttggaatgaaagatactgacccactgtttgctttcctgtagcttttcctcaagtggataaaaacaattacagctttttttcactagtctactaaattgaactcttaatatcaccccagctgcttttcttgtaggtgttcctttctatgtcaaccacacttctgtttgtgataaggattttcacctcatctgatgaaaagagcagtctactgtgagaaagaactaagcttctactcccaaagcacaagcagtttctgtcaaagcaggaatacaaatatggtcccttggaacctagcccattgcctttccaacataatggtggttattgagccatcagaccatgctttcagcagatacttgaacttccactgtgtatgaatcattatattagtgtaatagagctgtagagataaataagacctagcccatgcttataaatgcctcataacacaaaggacagagaaattatgcataaataaatgcaaaataaatgcagataaatctccatggctgttcagttacacaggcatccaacacatccattgagtatttaccacataccaactttgtcctaaagactgatgatgacacaaattgaaccagatttaggcaaccaccaatctcacaaagtttgcaatccaattagaagagaaaagaatttaaaacagccattgcattatagaatcattaatgcaatgaaaggaagattcccaagtactaagagaaggcaacgctgggacacctagcctaatctaaagggcccaaaataaatatccttaaagtggcatataaattaagacattaccaagtgtggtggctcatggctgtaatcccagcactttgggaggctgaggcatgaggatcgcttgaggtcaggagttcgagagcagcctgggcaacatggtaaaaccccatgtctaataaaaatataaaaattacctgggcatggtggtgtactcgggaggctaaggtggaagaattgttcgaacccaggaggcagaagttgcagtgagccaggatcgtgccattgcactccaacttgggcaatagagtgaaactccatctcacaaaaaaaaaaaaaaaaaaaaaaaattaagacacgaaggataggagttagttagccaatatggtattttgtggtaatgcagctataatctaatcaccgatgaaacagtattccagcaaaccacttcaaggaagctttgaaaaccgaccacatccttttggcctgtccatcatcaaaaaagataatagcccgacaaaccatgggttataaaatgcctgacacataactgtgattacagcattagaggtttaaaatgcaactaggaaaacttgaaaatataagcaccaatttcaaatcactagtcatttgcatcaatttcaaccattcccccgtactcctccaagcattctatttggcttgtgtcgtatccaagaccatccgaaatcacagaataaatttcctataacatgcatctttcgtgtgcataataatgcatactaacaatttacaatttgttataatgtcctataatgtacttctttattgcatctgtgtgactaaagagggcagtcgggagaaaatctaataggagaacttcctagggttgaggttcttcagcttaaaatctttataactgggaccccttacattagcactcagctttggccagtatgtctgagaccactcatatatatatacatatatacacacacacacatatacacatacacacacatatgattgttttgtcattgtaccttgtaaaaaggtatttgttaccaaaatgataaaaggaagtgaactttaaaaaatacatgtcttattactgtcatttggagtattcctcaaaccactgattgtatatgatatagctacctctaggaattcaagctcaagttattcacaacactaaagatacaaactgatttccaaaggtattatccaagaaattaaccgtttataagggaagcaaagtatctttccatttcttttatatttttatatatatatattttaagttctagggtacatgttcacaacgtgcaggtttgatacagaggtatacatatgccatgttggtttgctccacccatcaactcgtcatttattttaggtatttctcctaatgctattcctcccccaggcccccactccctgacaggccccagtgtgtgatgttccctgccctgtgtccaagtgttctcattgttcatttcccacctataagtgagaacatgtggtgtttggttttctgtccttgtgatagtttgctgagaatgatggtttccagcttctccacggccctgcaaagaacatgaactcatccttttttatgactgcgtagtattccatggggtatatatgccatattttcttaatccaatctatcattgatggacatttgggttggttccaagtctctgctattgtgaagagtgccacaataaacatacgtgtgcatgtgtctttacaggagcatgatttataatccttttggtatatacccagtaatgggatcactgggttaaatggtatttctagttctagatccttaaggaattaccgcactgtcttccacaatggttgaactaatttagactcccaccaacagtgtaaaagcatttctatttctccacatcctttccagcatctgttgtttcctgactttttaatgatcaccattctaactggtgtgagatggtatctcattgtagttttgatttgcatttctctgatggtcagtgatgatgagcattttttcatgtgtctgttggctgcagaaatatcttgttttgagaagtgtctgttaatatcctttgcccgctttttgatggggttgttttttttcttgtaaatttgtttcagttcttcgtagattctggatattagccctttgtcagatgggtagattgcaaaaattttctcccattctgtaggttgcctgttcactccaatgatagtttcttttgccatgcagaagctctttggtttaatcacatctgatttgtctattttggcttttgttgccattgcttttggtgttttagacatgaagtccttgcccatgcctatgtcctgaatggtattgcctaggttttcttctggggtttttatggtttcaggtctaacatttaagtctttaatccatcttgaattaatttttgtatatgatgtaaagaaaggatccagtttcagctttctacatatggctagccagttttcccagcaccatttattaaatagggaatcctttccccatttcttgtttttgtcaggtttgtcaaagatccaatggttatagatgtgtggtgttatttctgatgcctctgttctgttccattggtctatatatctgttttggcaccaataccatgctgttttggttactgtagccttgtagtatagtttgaagtcaggtagcatgatgcctccagttttggtcttttggcttaggattttcttggcaatgaggggtcttttttgcttccatatgaactttaaagtagttttttccaattctgtgaagaaagtcattggtagcttgatggggatggcattgaatctgtaaattaccttgggcagtatggccattttcatgatattgattcttcctatccatgagcatggaatgttcttccatttgtttgtgtcctcttttatttcattgagcagtgttttgtagttctccttgaagaggtccttcacatcccttgtaagttggattcctgggtattttattttctttgaagcaattgtgaatgggagttcactcatgatttggctctctgtttgtctgttattggtgtataggaatgcttgatttttgcacattgattttgtatcctgagactttgctgaagttgcttatcagcttaaggagatttggggctgagacgatagggttttctaaatatacaatcatgtcatctgcaaacagggacaatttgacttcctcttttcctaattgaatgccctttatttctttctcctgcctgattgccctggccataattcccaacactatgttgaataggagtgatgagagaagacatccttgtcttgtgccagttttcaaagggaatgcttccagtttttgcccattcagtatgatattggctgtgggtttgtcataaatagctcttattattttgagatacgttccatcaatacctagcttattgggagtttttagcaggaagggctgttgaattttgtcaaaggccttttctgcatctattgagattatcatgtgttttttgtcattgattctgtttatgtgatggattacatttattgatttgcatatgttgaaccagccttgcatcccagggatgaagctgacttgatcatggtggataagctttttgatatgctgctggattcggtttgccagtattttattgaagatttccccatcgatgcttaccagggatattggtctaaaattctctttttttgttgtctctctgccagccttcggtatcaggatcatgttggcctcataaagtgagttagggaggattccttctttttctattgattggaatagtttcagaaggaatgataccagctcctctttgtacctctggtagaattcggctgtgaatctgtctggttctggactttttttgattggtaggctattaattattgcctcaatttcagagcctgttattggtctattgagagattcaatttcttcctggtttagtgttgggagggtgtatgtgtccaggaatctatccatttcttctagattttctagtttatttgcgtagaagtgtttatagtattcgctaatgatagtttttatttctgtgggatcggtggtgatatcccctttataattttttattgcatctatttgattcttctctgttttcattagtcttgctagtggtctatcaattttgttgatcttttcaaaaaaccagctcctggtttcattgattttttgaagggtttttttgtgtctctatctctttcagttctgctctgatcttagttatttcttgccttctgctagcttttgaatgtgtttgctcttgcttctctagttcttttaattgtgatgttaggatgtcgattttagatctttcctgctttctcttgtgggcatttagtgctataaatttccctctatacactgctttaaatgtgtcccagagattctggtacgttgtgtctttgttctcattggtttcaaagaacatctttatttctgccttcatttcgtcatgtacccagtagtcattcaggagcaggttgttcagtttccatgtagttgtgtgattttgaatgagtttcttaatgctgagttctaaattgattgcactgtggtctgagagactgttgtcatttctgttcttttctatttgctgaggagtgttttacttccaattttgtggtcatttttagaataagtgtgatgtggtgctgagaaaaatgtgtattctgttgatttggggaggagagttctgtagatgtctattaagtctgcttaatgcagagctgagttcaagtcctggatatccttgttaaccttctgtctcattgatctgtctaatattgacagtagggtgttaaagtctcccattattattgtgtgggagtataagtctccttgtaggtctctaaggacttgctttgtgaatctgggtgctcctgttttggttgggtgcgtatatatttcggatagttagctcttctttttgaattgctccctttaccattatgaaatggccttctttgcctcttttgatctttgttggtttaaagtctgttttatcagagactaggattgcaacccctgttttttttttgttttttgttgttgttgttgttttgctttccatttgcttggtagatcttcctccatccctttattttgagcctatgtacgtctttgcatgtgagatgggtctcctgaatacagcacgctgataggtcttgactctttatccaatttgccaatatgtgtcttttaactggggcttttagcccatttacatttaaggttaatattgttatgtgtgaatttgaccctctcattattatgttagctgtttattttgctcattaattgatgcagtttcttcacagcatcgatggtctttaccacttggcatgtttttgtagtggatgataccggttgtttctttccatgtttagtgcttccttcaggagctcttgtagggcaggcctggtggtgacaaaatctctcagcatttgcttgtgtgtaaaggattttatttctgcttcacttatgaagcttattttggctggatatgaaattctgggttgaaaattcttttctttaagaacgttgaatattgaccccaactctcttctggcttttgggtttctgctgagagatccgctgtttgtctgatgggcttccctttgtgggtaacccgacctttctttctggctgcccttaatattttttatttcatttcaaccttggtgaatctgacggttatgtaccttggagtggctcttcttgaggagtatctttgtgatgttctctgtatttcctgaatttgaatgttgacctgccttgctaggttggggaagttctcctggataatatcctgaagagtgttttccaacttggttgtattctccccattacttttaggtacaccaatcaaacgtagatttggtcttttcacatagtcccatgtttcttggaggctttcttcatttctttttactctcttttctctaaccttgtcatctcactttatttcattaatttgatcttcagtcactaataacctttcttctacttgatcgaatcagctgttgaagattgtgcatgcatcacaaagttcgcgtgccatggttttcagctccatcaggtcattcaaggttttctccacactgtttattatagttagccattcgtctagccttttttcaaggtttttaacttccttgcaatgtgttagaacatgctcctttagctcagaagtttgttattatcaaccttctgaagcctacttctgtcagcttgtcaatgtcattctctgtccagctttgttctgttgctggcaaggagctgcaatcttttggaggagaagaggtgctctgatttttagaattttcggtttttctgctctggtttctccccatctttgtggttttatctacctttggtctatgtgatggtgacctacagatggggttttggtgtggatatcctttttgttgatgttgatgctattcctttctgtttgttagttttccgtctaatagtcaggtccctcagctgcagttctgttggagtttgctggtggtccactccagaccctgttttcttgggtatcaccagcagaggctgcaaaacagcaaatattgcagaacaacaaatattgctgcatgatccttcctctgggagcttcatcccagaggggtgcctgcctatatgaggtgtctgtcggcccatactgggaggtgtctcccagttaggctacacaggggtcagggacccacttgaggaggcagtctgtccattctcagagctcaaacactgtgctgggagaaccactgctctcttcagagctgtcagacagggatgtttaagtctgcagaagttgtctgctgccttttcttgagctatgccctgcccacagaggtggagtctatagaggcagtaggccttgctgagctgtggtgggctctacccagttcgagcttcctggccacttcgtttacctactcaagcctcagcaatggtggacaccccacccacagccaggctgctgccttgcagtttgatctcagactgctgcgctagcagtgagcaaggctccatgggcatgggaccctccaagccaggcatgggaaaggttctccttgtctgccggttgctaagaccttgggaaaagtgcagtatttggtcagaagtgtcctatttttccaggtacagtctgtcacggcttcccttggctaggaaagggaaatcccctgaccccttgcacttcccaggtgaggcaacgcctgccctacttcagctcaccctccatgggctgcacccactgtccaatcagtcccagtgcgatgaaccaggtacttcagttggaaatgcagaaatcatccatcttctgcatcgatcacactgggtgctgcggaccagaactgttcctcttcggccgtcttggaatggagctctatctttccatttcaatgcagccactttagcagttctcttaaagctgaaaatatatagaaaaagataaaacctttcaacagctacagtgatcctgaagtaaattactgtgtatatgacacagtgcattatcaaattgttgctgcatcagcatgtcattttcaaaatgaaaacaagtctattaaagtgcatatcgaaggtataaagtaggatgatagtgtatagtttgatcatgagatattgcttgcagtgtaagtttcatagaagaaaaatggtttgagaaaatggatcaaagggaaatctccaagttgacaacaatgtgttaagagaatgagaatttcaaagtacaactactgaaaaagccaaatttatgcagacaaagtgaaaaagaaatgaatcaaccctggaagagggagaatcagcacatcaccgtcaaggaaaacaagtacaagaataaatggatgttaatttcagctcacaagacagtagtaatttcaaaataactaaggaagggaagtgaaaaaataaactgcagtgtcataactgactcttgatccggagggatgtataagtgtccctgaataatgactgtagttgtggttttgcttttctagcctccttgcttgataaaaaagcctatggaatgatgtaaaacatagattgcagataataagtttgtgccaaggattggctggtttagctcaatttcatatcaacttacaatttaacctagagtattttacatcatctcatcagtttatccatttaaattgattatcttgatcttcttttattttttaagatcatccagtaagtatgtattcagcatctaacctgtactaaatattttgctaaggttgagggagacattaaactcacaacactcctataagatggacattattattacttccatttaacaggtgaatgactaaggcaaagtcatattagatgcccaaggtaacacagctagtaaatggcagaattgttgtgttagttcaggtcctccaagaagcagatgccaagacaagaatatatgtgcaagagatttatggtattgatctatgttgaaaatttggtgaggaagttgcaggagcctaactgagagagactcaggccataacgctggtctgaccctatggaggaaagagggaaggaaggaagattgggtaggaaatttcttagtctctggtgcagttctagaaaattttggcaaggctcatgggaagtccttgagctaaagtagcccatatgaggagccccacatcttgcagaaatgggcctgcctgagtatctctccctgctcagcattgcctggggcagcccatggaaagggtggcccagaaattgatgtggtggtggatcccaagcagctgaccatctgtcattcacactcctgcaccaggaagttgagaggccatgttactggtcccacagctgagatctcaacccataaaccttgtggcagagaaaacatgctcaaccccaatgccaaggcaatcctggcattcaacataaaatcagagaatgcaaatctttatatgccgcaattcataaattctttgcatttttttagtctgcttctgcttatatcagagatagaacatccaaggccaacaatacacttcttgtccttgagaacaggtggaagtcacctaggaaaatggaacataaggaggatgggatcctcttgtggcatctgttgtgaccctaggagagacattgtggatggcgaggggatacaaattctggcttacctccgtggtctgaggatagggggatcctttcagagtccctcctatccctcaggctaaccaagcatctccccctaccctcaactattacctggtcccaggtaagaaaggaaggaggctttccagcatagccttacttttggctgggcttggcaaagaaggtgtttggagtaattatggcccctcggtcacccatgaactcagaccaaccatcactggcctcccttccagatgatctctatttgagcagtttggtaatattttggaaagtacatttcactcatttaatgggaaaataatttaaatatgatttagatatgtattgaaagaatttactagatattttaaccatgtgacttgttgttgttgctatttgtattaggggaaagatgccagggaaattaggtaactagtctaaagtcttgcaaaagtaggcaggatttgaacttaagtctgtctgacctgaaggccacattccttctcctccatggccccctgccccagatattttactgggctcgggctttacaaaatgcttgtacatgtgctatttcatttgaactgtaatattagctactattttccagtccagtattatgggacttaaagacgtcagtgccagaaggtctattggttcttttcccctcctgggactcctcctctgcctcagttgccctcattggggtatcagcccccactacagccattacaaccggcttggcacgtccacaggggctgctgcccactgaagtgggtacaatttctttatccacccattcttctccattcctttctcttttttttttttttgcccctttttttaaccctatcttcattcttgagttcattcctgccctattactcctccaaagcacacatgctatccactcttcttcactttgagactatgtgagtcgtggccgaatagttcgggaatttattttgcacaatttgcacaggccagctcctctcacatctgcttcaatgatctctgtctttatcttcccagttctggtgtctttccttcagctctggatttcttgctttggttggagccactacctcgacatgctcctgggtaatgcttttttcgtacgtgttttaacttttattcacatgagtgaaattgatttttaaattaccactgtccctagcaggaaaaagccagtggcagagccagaaagagaatctactcctccttggcccaccctacattctttgactatcacaaatgccctgtggagaaagagaaacctgcccaccctgtgtgttccaatttactgaaataacatataaggcatgatttggttattttggaattcctcaatttctgatgttatcataccacagaattttgggactatttatcagttgagtgttaacatatcagatccaactttgtaattcttctttttagcagttgattatatttttgaagcccacaagcaccaatttcagggaaaatataagcctaaaatcattcactagaaaactacagaaccgaataggagagtaaatattatttaacttatgcttatgatttgatgtctttatttcttttttattgtgaagcagaattacctttgcctagcattctactgactcaccagtctaaccaatctaccttctgagggtggcagcaagatgggcaaatctggagatgagctctttcaacaaataaacatcatgatagattcctggaaggatttttggtgttttggccgtaactttctagttcaaattgctcattcatgaatcgtcacaaaatgacattcaaaaagaaagtaaatcttgattcaattcattatactatgaagcttttgacttaagaattagaaaaaaaacctttatccaacaaacacccttttttgggggcgtagattacttcctcaattccatcttaccacagaatcaaatattcccaagtatcaagtatccttctcatgtgaaattcttgctataaatgccaaacaagaggaaaaaagaaaaatgtacaaataattaaaacacaaatatatagcatgttagtaggcattgtgtgaatgaaaaaatagttcatgtctctttagatttatgcacagataagagataccattcaatacatgtgctgatcaaagcctaaatatgaacattcaataaagtaaaagtgctaacaaaaatttgagtttggcattaggtcaccaataatgttaattgattgtacttatacataataaaagctaacattttaaatctatcctgatagacaggaataggaatccacgctccagcttgggatcaagaaaactaaaattagtaacactaactggactccttaccactaaggagctctaaccagaaacgtttgttaaaataaaaagatagggagtgtatactagtatgcctttggacttagctaagaaaaatgtaaaatataaaattgtattagtccattctcattctgctaataaggacatacctaagactgggtaatttataaaggaaagaggtttaatggactcacagatctacatggctggggaggcctcacaatcatggcagaacacaaaggaagggcaaaggcatgtcttacatggcagcaggcaagagagcatgtgcagaggaactgccctttataaaaccagccaatcttgtgagacttattcactatcacaggaacagcacaggaaaaacccacccccatgatttaattagctcccacagggtccctcccacaacacatggggattatgggagctacaattcaagatgagatttgggtggggacacagccaaactatatcattctgcccctggctcctcccaaatctcatgtcctcacatttcaaagccaaccatgcctttccaacggacctccaaagtcttagctcattccagcattaactcaaaagtccaaaatctcatccgagacaaggcaagtcccttctgcctatgagcctgtaaaatcaaaagcaagttagttccttcctagattcaaggagggtataggcattgggtaaatacacccattccaaatgggagaaattggccaaaacaaaggggctacaggctccatgcaagtccaaaattcaacagggcagtcattaaaccttaaagttccaaaatgatctcctttgactccatgactcacatccaggtcacaatgatgccaaaggttggctcacacagccttgggcagctctgcctctgtggctttgcagggtatagacccccatctcagctgctttcatgggctggcgttgaacgtctacagcatttccaggctcacggtgcaagctctcagtggatctaccattctggggtctggaggacggtgacgctcttctcacagctccactatgcagtgccccagtgggaactctgtgtggggggttccaaccccacatttcccttctgcactgacctaggagaggttctccatgaggggcctgtgcctgcagcaaacttcttcctggacatccaggcatttccatacattctctgaaatctaggtggaggttcccaaacctcaattcttgacttctgtgttcctgcagactcaaaaccatgtggaagctgccaaagcttggggtttgtgccctctgaagccacggctcaagctgtactttggctccttttagccatggctggagcagcttggacacagagcaccaagtccctaggctgcacacagcaggggggccctgggcccagcccatgaaaccatttttccctcctaggcctctgggccagtgatgggaagggctgccatgaaggtttctgatatgtcctggagacattttccctgttgtcttggtgtttaacattcagctttgtttgtttgtttatgcaaattcctgcagtaggcttgaatttctccccataaaatgggtttttcttttttattgcatcatcaggctgcaaattttccaaacttctatgctctgcttcatcttgaatgctttgctgcttagaaattcgttctgccagataccctaaattatctcactcaagttcaaagttccgcagatctctagggcaggggcaaaatgctgccagtctctttgcatatcaagagtgacctttcctccagttcccaacaagttccttatctccatctgagaccacctcagcctagactttgttgtccatatcactatcagcattttggtcaaagccatttcacaagtctctaggaagttccaaactttcctacatcgtcctgtcttcttctgagccttccaaactgttccaacctctgcctgttacccagttccaaagttgctttcacatttttaggtatctttatatcagtacaccatttcccggtaccaatttactgtatttgtttgttctcatgctgctaataagtacatacccaagactgggtaatttataaaggaaagaggtttaatggacttacacttccacatggctgggaaggcctcacaatcacagtggaagggaaaggaggagcaaagtcatgtctttccgggcaggcaagagattgtgtacaggggaactgccctttataaaatcaacagatcgtgtgagacttattcactatcatgagaacagcccaggaaaaacccagccccatgattcaattacctcccaccaggtccctcccacaacacatggggattatgggagctacaattcaagatgagatttgggtggagatagagccaaaccatatcaaaaatgcttccagtgaatagacctggggaaaataaaacaaagtaatttttaaaaatgcttaacatgaccaggcacaatggctcataccgtaatcacagcactttgggaggccaaggtagtaggataccttgagcccatgagttcaaggccagcctgggcaacatagtgagactctgtctctacaaaaataataaaaataaaataaataattatggttttaaaaatgcttaacataaccctttctacttcagcaggagggatagatttacattttgggatgttttcagcatcagattactctgggtgaccctaccttcagaagcagataaaagtggtaacaacacaattaaggagtattcttcagtgaataaaatatttgagagtacagaggtaaagaataaaagttctgtggtcccatctagggctaaatgtcaacaccataaaaatcatactgaatcactctgatcctatcactgcagaactgaaaattattccatttattttatacacattgggacccaaataagttccaacttatataaaagaatgaaaagtaaatcctgacaacctaccggaagagaacactctgccccgtgctttccattctccttcgaatgcgtgagtgtctctccctgtctctctgtcctgctctctcacgtcactttcttttctccatctttatttcactcttctttggtgtctcctttgcttactgacatgtattgggcttttttcttatgcattgtcctcctcttattgcttattattattagtgctgctgtgcgaaaagttttgtttctttttttatcatttcaaaagcagaggagaaaaacgtttaaatgtatattgctcagccaaaataatgtttatttgcatgggaacttcgatttgtgtgtgtttgtgtggtataccagagagaatggggacagcaatttttcctattgtagaacgagaaaaggaccaacccctcttcaataacaccagataatgggtaaagtggctgaagttagttattatgtgctttaccaaaccttggaatcaaattgtaatacaaatattattgttattccttcctttccctccacatttttttttaaatagcagttagggggagtgatattcccctactttgctctgtttggtcaatctctggctcatcataaggtagagacgatgttttctaggaagcctgaacgtagggtgcttattattggtgtgatgtttagtttgttaattcccaccagcctgagaccaccaggagcacaccacagaaaggtgggtctgtgggcttgcaagaacaggaacattagaggggggtgtgcactgtggggaactacggggcatccttgtaagggaatgtggagaggaggatattataggattggggctggtgtcgggtgatttcagggagtgaagatttgttgtggattgggtggtgctcaggaatggatgcaaattgatagcaggagggcccacgtggggctgtttgtcattgggaaaaaagtggtagccagtcaggttagccagatgagggagtttttcggttatttttgtggccacacatggttttggtgttcagacacaacgaaggcttttttgtgttgtttggccatgatcatggagtgaacctgtttgattattgctgatagtctatggaattgtattatgttcaggagtctagctgttacctcagtctggctggtacctgcaaactgccagctgccagagcctttttgtttttccttctttctcaggtctcagagtaaatgttaaccaatcggtcagtccatccatgtgtaatagctgctatgcccagcactgagctaaacattatgaacaccatatggggactttctcattaataaaacacccacatttaaaaagtaatggaaaagaacataaaagaactagagaatacttaactaatatttgaaaccgaagtaaatattctatcactcatccattttgtgccctagaaggttctaaatgaaaagttttggtaaaacccttcatttatttcatagctaagagaaagggtactgtttgaaaattaatttttataaataattgaattgttcctcctcctagataagctcaagacactttgttaaatgaacacctgacaaaggctttcattttttctaattacaaattagagatactagctgggttgtgtctggttttttttcattgtttttgtttgtttgtttatctttgttgttgttgttttttacctcttgcagcagttgaaatgcatgtggtctttggttctgtatatttaagctctagtttattacttctaatctttaaaagatattaaatcatttaaattggcagacaccagtgtttgctggctgctcgaatattaccatttaataccctacattggagaattaaagcatggtgccctgctataggcaaagtttagaagagtcctgcctgtcatcttgatggtttccaacactgagttttctaattactatattttggtagggcgaaactgagtatgctgatggtttttgcagctatggtagtaacatttttccagccatctttaggtatgtttttcagtggaaagtttagcattggaagtttagggtttttttttttttctttttcttttagtggagtgatgtataggtattctattttattactcattggaaaattatctatttgtacagtgcctaaaacagctgaacacctagtaattgttcagtaaatgatgatgatgatgatagtgatgatgatgatgattttctcttcaaattaaggacaatgtcaaattaattcttgttctctagcttctaatacagtatttgactcagcctccctaccagccacttgactttgctaattacttatgttgtaatcatttgatagtaatttgaattattctttttttttgagatgtctttgtattccttgaaagaaagttattgtttgttatatatcaaaaatttttagcaatctttagggtcttttttctctgaaaactcaagtttatttttgtctttttatcaaatacttttatagatttaggaaataacttattctagtttaataaattatacttggcccgttattgttactccctaatctttctttgtttctgatggggagaaaggatccttttagattctttttaagtcactctgatttcattctggaaagaataaggcaacatacatcaaatccttttgagaatattcaacatgagatagttttcttttaagtctgacagtggcaggccataatactactgaataaattcttaccaaactgaagcttctgggctcagtttcaatgttttatttagtattgttctcaccagctttcttctgacagggctcaatgaagatgttagttaatattcttgcacattgcatttggatgggtttgctctttttggtactgactctgttacggttttcacaatgacacacacttctgttggtttattactaaccatagttgttattgaagagaacctctctttcggcctcagtgatgtagtaaacggtaattttgcaatccttacaaattcacccttatacaatgtatggtacatttctgaacatggtaatttttaagtgctttcaacttgcaaagtagcaaattgatacacaggggatttccgacagcttcttctccagactgaatgtcactcatgggattgtgattccatgtgaaataaggcaacattggccggaggagctgccatctggactttgacgacgaaggcatcatttacacagggctggcattcagagccagggtcacaaagcagctctttccaggagcaaaatgaagttgtcaagcaagtatttgctctgactctgccaggcaccattcagatatgacaaacttgccttcctctttttattacagcttactaattctggagaaagatggaaatttttttttttaatgcgtgctcttccaaaggtcaaaacaattttaaacaagggcaggcacagtcctgcaataaaaattcagcaatctagttgtgcaataagtccgtgtaggggctgagggaagtgtcatgtttacctctctggaaagggcactgtaatcaaaagactgatggcaagaggagctttgaatttgttgttctatttctcccacatctgcatgaaattgtgtctttgaaactatatattatggagatgagtgatactggagagaaacacatgctctgaagtaaacagaaaaatacagcagcataataaaatgctttgcccacttttacagcctctgtggtggccatgaaataggagatgccaactgatggggatgtgagtggagctgtttgaggggtggatttttccccattactacacatagatgcttgcatctttccctaactgtgtatttccttaggtgggtaatgacagtcagtggaaaagccagtgcctgctgttcaaacacagtgtggaaaaaatgaaattgaaaacagtggtgatgagatccagttctccaatattcctctcctagacagactaaaacctttcttctcccgcagcgttagcgctcactctggtcctctcagctgcaaagcagatggatttctttgagaagtggtcagaatttccttgattcaggagctggacctcacgccctcctctagggctccatcatcaccacacaggcacacggccacacctgagtcccatacacagagaagggtggtcatggacaaaagaaacagtggacaaagttttgtgtatgacaattcctggtggctccaatagcaggatggatggatttgggctattaacagaggtccaaaatcccaaaaagtgaccacatgtagatgagacagtcatgacttttatgtgcatttgaattgggcttgagatacctaagtggggatgcctaatcgacagttggatatgtgagtctgagtctcagaggaaagagctgatttaaacgtacaaatgagtgagtcctgtgtctactgaaggcctgaatatggatgagacagcacagaaagcagaagaagagggagcatagaaagacgggacttggaaagtgccaactttttcattgtttgagttaaaaaaaaaaaaagttaagactaacagaaatagcaaccagagaagtaggagaaatcaggaccagctctcgggacataggttaagtgtaaagactgttccaagacaaaggaatgacagggacaatattgagcatcaaatgctgctgagaggtctggtaaaataaaaaatgcaaagatctattggatataatgaaatggaaggaggagtagaccttaacaaagaccattttcatgtgatgattggagttgggtgtgtgtgtgtgtgtgtgtgtgtgtgtgtgtgtgtgtgtttccaagtaagataatcagtcttagatgccagtgggaggaatcctaagagaaataaagaataaataataatgtacatctcctgagaagatggagaaagggtagaaccctaccataagaccaggaagtggccagaggtaggaggaaaaactgctgtaagagacaggagaagatggtattcctacagacagaatggtgaggcatttctctctgatatcctgtatttttccatgaatttaaaaatgagatcagttgttgaagaatgaaaaggaagttcctgagagcatagacacaaatagatacatgtgttttgttgaaaggccaaagagtgaaaccattggaattgagtatatgtagcaccaccaaatgcagaaatctattaaattgttaagaatatggaactggagttcacaggagggagagagagagtgggactagacttatgtggcattagcattaccaaaggtgtgtattgtagtcatgggactgaattcatgaagtcatttaatatatactgaattattatgaatcctagtagctgcagagaatatatactgagttattgttatgaacctttgtagctgcaaagataaagtgagatggcttccacccgctgagtagtcgtcggtctagaaagaagctgacatttacacaggaaataggcagtgtgaccgaggctccaataagcaggacaaggttttataaatgtttgtaagaaaatgcacctctctttgctagaagaatagaatagttagaataggaaaacaatgtttgtatctatacataaagaaaaagcaggccagcaccgtggctcacgcctgtaatcccagcactttgggaggccgaggctggcagatcacctgaggtcatgagtttgagaccagcctggccaacaacggtgaaaccccgtctctattaaaaatacaaaaattagccaggcctggtgatgggtgcctgtagtctcagctactcagaaggctgaggtaggagcatcgcttgaacctgggaagcggaggttgcagtgagccaagattaagccactgcactccagcctgggcgacagaatgagacttcatccacccctcatccctaccaagaaaagaaaaaacagtggcaaacttgatgaagaaatgagaagaatatttctgttaccgagaagaggtgtgaataatgttgttacaatatatgcaatgtaaagaaaatagacatgtggcaatataatccaattaggtcacttctgaaaacataatcagaaaaaaaaatcatagaatcatgaaataataaagccagaaacagagatcatcaaagtccatgccccatgttagacagcaggaaagagcctgaggaagaaatggaacgttatgatcataatggaggtggaatagagtccagatctcctggctccaatttcagtgatcacctcactcactgatctctatttcacagccactcttgcactggctggaatatgcaggatctgtaatatccttgggaaggaacagaattctctggggtccactgtcaaatagtggacatctgaatcagctgcttcaggtgaggtggtgctcagccccctgcctctgtccacagatagagaacagagttactttgtgagcctctaggctgtcaacattacccttgcagatctgtaggatttatgctatgctggagacataactgccgacctagtgggaccagagtggaggtaggaaggcttccgagtctctctttgtaaagcctgtgactacgagccaggctttaacagaatccctgctttactccctttttgtgggttatgccatgtacctctatagtctcccaagaatctgtcaagatatcagcttttattactcattaccctaaacctaaagaagacagacaggacagaacccaggaaatccaataagtggatttcccagaaatgaaagtgcatagaacctagaaatccttatatgtgaattttcttgtgaataaaaagtataatagaaaaacaatttggtttgacaaatatatacagaaatcttttgtttgtgtgtatgtgtgtttatttaagattcgcctgcttttgtaaatgtaatcagctacatacaatttttaaatttctcacttccgtaaaattgtctttccttgggtcatgattctgaacactgatataactgtacagcatgatagatagggtaggtgtagaaaattgtactgaattgtcattgagtgttggctataccagggtctcccagaatatagaaagccttgtgctagttagaaaatgggctcctcttctctgcaggccaattagtttcagccagcctcatgagctgactgcatactgaagtcagccccaaatcctgccctcccaaatcaacctgcactaccatatcttaagagtagactgtcaaaacaagtccctggtttactcttttttttgagacagtgtaagacacaagtagattattgagcttcctgaaaagatagattcagagtaattaaaatttgattttaatgctgctaagaaaagaatagagatgtgatataaagttatgacacaaggaatacaaataagattatcacttatggatgatggctgtttgaaagataagcccaattatgaacaccaatacagattctgcaaatgtatgttcagagatggttatataagtggcataattgctgtaccttttacatagaaaaattgcagctattctttaatcaactgacactgggagaaactgattaggtgtgataaagttgcctcaggtgaaatccaatttcaactgatagactgaggcataaagaaaggaaaaaatacaccgaaacaccagaattcaaaatgtgcgcatgatttttaaaatttattttctcttttttctttttttaaaaatgtgtttagatatgaaaaaagaaatagaataatgacttgaattcgtgcatctgaaaaatgtttattaaccacctaactatggacaggtgctatttatcagaaaccaaaacaacagctcaactctactggatcataaactctagtgggaggggacaaaataaacaataaacaaaacagtatctaatattagaggtggataaatgcaaatagataaataaagtaggataagggttatggagtgaagcaaagatgctctttggaggttattaagtgaaagccagcctaacaaaatggcatttgaagaacatctaaggaaggaggatgaaaggtccttgaggatattaaggaaagagaatttcaggtggcaaaaatagtccctgccaagccctaaagtgggaatgtgcttgggtgtttaaggagcagcaagatggcagaccggctggaacagcgtgagcaaaagccttgaacaatgaaagaggtcagtgataaataaggaattcattcttcacagaaaatggggcgatgcatccaggcaggttataaagattaagagttgaaatcagagaggcaggtggttttgatgttttgagatttgcttcctaataggcatcttaatcaaattattcatccagagttgcaaagcagcaataaccaaaaacatatctgaatattgagtaatttgtcacattcattacaatcaaactgatatcatttgcctcgccagaaaaaaaaaaaaatgactaattgacataatgtgaagagctttgaagaattgcatttaataccagcaggttaatcaaaaggctaacgaaacaagttttagttaaatacatacaaggaaaaatgtattctgtgtctttcctgctgttgtcaggaaaaaaagaataagggcaaattttagtgatttcactgtttatatgtgtcccttttacccacttgaaaaatctgccacttattattgttattgaattttccgtcatcttactgctcttctgtgagattggaggactttgaatttgtgccacttttattaactgcttgtgccatcgagaaaggctttagcatcttagtttcctgggaggaagaccgggtaatggatgaataatgtgtgactctgccagtttgatgtgttataaacaaaaaaaggatttgtgcccccactaaatagcaggcttgatatgagacctcaggttttgagctgcataagcagcgtcttgctctgctgttgaagaatggatgcatttttcagatagtaagtaacacatgactgtctggagagtaacaagtattgggttggtgcaaaagtaattgcagtttttgatgttactttcaatggtaaaaaccgcagttacttttgcactgacctaatagggttaaaggtcaaggctaagtattttaatgtcatcaattttattttctttcttaatgtgttaaatagtagaaaagaagaggccaggtcagaaagtctcaatattaaggcttatttgtctcccttgtccttttctggactctcctggtcgtgtcttcatcaaattgggttaagaaaccaaactcagcttgagatattctccaaggcaatgtttatgtggagttggttcaggccccagcacgttgggaagaagtagtaaatatcataatagtgattgtagttattgatcagtattggtccaatcatcagagctttgatctttccttctttgtcaatttcttttacttttgactacagattcattcagaactccaccccccgccaccccgccccatcttgcagaagccacactttctccttcatcaccctttggctggtctgtctctctctccttatgttcagaaggcttttctgttttgatcattcatgtttgctttcttatatcaccttaacctcttaaagcttgatcacctgaaacatgagtctgccgctcagatgattctaatcctcaaatctgatgatgtcggccaacctttacccttggaacactggaacatttacctttctgaaacactcaccgctcgtttacctgctagaagctggagtacagaatcagtgtccaggtggaactcccagtctgtagggaagatgagcacataaagtaactgcaacacaatacatgaatcagaggaagaaatgcaataactaagttctgcatgaactgtggcttaacacaaatagggaacaaatactagtggctgtgggaaatgagaatgaaagcagatttcagagaagtaacattcttcaaatcacgttgcctagacccttcccattttgtagctgctttcctaaattctttcttcctctcctgttgctgcagcaccctaagaggtggggccttagctagccatgtgccccattccacagactgtcccatgctcaggcatcagttgtcactgtggatgactcacagaattaaagatgcggttctggctgggcgcagtggctcacgcctgtaatcctagcactttgggaggccaagacgggtggattgcttgaggctaggcattcaaaagcagcctggccaacatggtgaaaccctgtctctaataaaaatacaaaaaaattatccaggtgtggtggcaggcacctgtaatcccagctacttgggaggctgaggcaggagaatcgcttgaacccaggaggcagaggttgcagtgagccaagatcatgccactgcactgaagcctgggcaacaagagggaaactccatctcaaaaaaaaaaaaaaaaaaaaaaaaaaaagatttggttgtaatctctctctctcttgaagtcgtaagtcccatctcttgtacatcctcatttccaagttgctatgtcagagggcttctcaaccagggtgctactggcatttgaggtgtgacatttattgtgcagaactatctaacacattgtaagacattcagctttcatgggacctgaggcactacatatcagtggcaccttacacatgtttccgaatcatacctgaggaggtagtgccagccccagttgagacccactggcacatcaaattcaccctctataaaattaaactgaaaaagtgttcatttcccccaaaattaacactctcctactgacatttctttcaaaatgttcagatttgcgtaatcgtgaaaccaagcatttaccactagctgatccatcaggtcaacacatcctactaatgtccttttatagtatgttttccctctgtctgttaggcagaatgtcacatccatgatactccaagtctttatcacctaatttgtagaatagttcctctatttactgttgcctttcctttatgtcacattgtataataaaatatcaccttgaccatgcctctcccttgctttaaaacctacagtaacagacttcgactatacaattaaggccaaatagatacaacaaaagtgctcccccataaacatttttaaaatgcataaggccaggcgtggtggctcacgcctgtaatcccagcactttgggaggctgaggtgggtggatcacctgtggtcaggagttcgagaccagcttggccaacatggtgaaaccccatctctactaaaatacaaaaattagccagatgtggtggcaggcacctgttatcccagctactcaggaggctgatgcaggagaattgcttggacccaggaggtggagattgcagtgagctgagatcatgctattgcactccagcctgagggacaagagcaagacttcgtctcaaaaaaattaaaaataaaaataatttttaaaatccttttaaatgtatgattgagcatgcaagaaattgaggaagatccttgaggcctaaaatgaagaaaaatcatgaaccaaggttataaatgaatgccaaagccagaagctgacctaaaggcttctgtcagttccatgcaaccagcagcttttctttcagtggctatatgaggaagaagggtccatgccaagtaataaattatatcaaatatccctgtatggaaaacaaaatccagggggttagactctcaatgaaaaacaaaactgaaaatggaaaaatccactctacaaaagaagataatgtaaaaattttgattatctgaactttagctcagagtacaaagaagaaattatcccttgaagctatgtaatagaaagccagttctgatgcatgtttacagcctaacttcacagcatttgaatggttggagaaaactcaagctgaaaatatattttaaagaggtcccagattggtaatgtctccatgtatctgagaaaagcaaatgcagatgatctgagagagacataccttctactgaacctcacaggattctcacagacatatttccaagaaacatgatctcaaaagaaaaaataatcaccaaatgtatggggaaacaagatactgtaattgtgaatcaatagagataactaatagcattttcagtcctacagaatcttcaggtattgaaattattggattgaaaaaaattttaaagagaaaagtggatatactattaaaaataatgggtaacatttgaaaaagaaccaaataaacattacaggaataaaaacataatagataaaattaaaagcttaatgttagagataaatagcagtttctacccagctaaagtaggaacaatgaaattaaaaatagattctgaagaaatttcccagaaatctgcccagtgagagttgtcaaatatgaaaaataaaatattaaaagcaaggagattagatcacaaccaatcaatacatctctaattggagttgtgaaagaagagataagagtggtgaggccttattttggtgaatgatggctaaaaattgaccagaaccaaaaaaacatgcaaattaagattcagattaaggcatcatagtggatgtaagccagaatgaaagcaatccccagctagacagaaattacagattatttacaaaagaattgaaattaaactgaccattgacttcttgacaatggaaccctgaagaaacaaactattgtgagaaaataaccattgaccttgaatatgccacccagaaaaaaacacatatataaagtctaaataaagactttttaggacaaaataatgataacatactaccctctgaccctagagaaaaaaagatctcataagaatagtctgagatagaaaaaagagggaacaaagaaaatagtaaaatgtcagtaaatctatgcaaacattgacaatattgagcaataaactttaatttgtgatatttaaggaaaacaagatgaagctaaaaaatagatgaaataccttatatgtaaggaacagaaacaagctataaaattgctgtattgtttaggaagagaataaatatactatgttgagacactgttaagttaaatatgaaatttaaactttctagggtatctactaaaagaatgatatttaagagaatgcaaaattctaaaccagtagaaaatatatggaatgaagaaaaactatcaattcagaaggaagaaaaaatacttaaacattagtaacaataaaaagcaaacaagagagaaaaaaaggtacaaatatttggaaataagtccaagtcagttatcacaataaatagactagactctccagttaaaagataattttagacaattaaaaagaaaaactatgtgctgtacacaagagatattaaaaacattaaggacaccacaaagtctgaaagaaagatgatagaaaacaaggccaggagattacaaattccaaaaagctattgtgagcctattgatacgaatgcaaatgaaagagaaaaaaaaattacaattcagagcattacaatagcataaaaatttccaaattactgaaaatacctaatgctaaacttgggaagattgaaagatatagtattatagaagaagcttttaatattgatgtctcagtaattataggtcagaagcctttaaaaatcattaagtgtacagagcagcagtatccaaaagaactttctgaggtgatcaaaatattttctgtacaatatggtagccattagcacatatagctagtgagactgaaaaactaaattttaaatagctgcgtgtggctattggttacctactgggcaacccagataggattaaatagcataattaataactgtgagtcaatgcacacatagtactattagaaaataaatattttttcaagcacatgtaaaatgtttttgaatattgaccacagactcgattctttaaaataaatctcaacaaatttcaggttattggtatcataaatcctgttttctatgaccaattaaattttaaaaatcagctaaaaagacacttttacaaaaaaagcttaaagcaaaacatataattagacattttaaaaatacttctaaataatccctgcactgtgggagactgaggcgggcaaatcacgaggtcaggaattcaagaccagcctgaccaatgtggtgaaaccccgtctctactaaaaataataataatcaaaattagtgcatattatcaaataatgatgacagcataattcaaaacttgagggatattcctaaagtggtattttgatagaatttatagtcttatgtgtatagtaaaagcttagaaaggctgaaaattattgatccaagcatccatcttaagatattagacaaagaagggaattcttgtacacttttggtggggatgtaaattaggacgaccattatgagaaacagcatagaagttcctcaaaaaataaaaatagaactcccatatgatccagccatctctctacctgctatgtattttttaaaactgaaatcagtatgtcaaagaggtatctgcattcccatgttcattgcagcattattgatagtagcccagatgtggaatcaacccaagcgtccatgaatggatgaatggataaagagaaagcaggatttaaacacagtgatttctggaacacagaagaacatagaatacattatgttgagtgaaatgagctaggcacagaaagacaaataccacatcatctcacttatatatggaatttttaaaagttgcactcatagaattagagagttgaatggtggttaccagaggctagggaatgggaggttgcagagttgttgatcaaaggatataaaattttagttagataggaggaataagttcaagagatctattgtacaacatgatcattatagttaatacagtgcattgcattttgaatattgctgagagtacacaaaaaatgataagtacgtgaggtaatgcgtatgttcattagctccactgagccatttcacagtgcatacatatttcaaaacatcatgttgtatgtgttaaatgtatttaatttttatagatcaattaaaaactattttttttaaaaagaatagactaaaggattataggatatatccaaaggaagtagaacaaatgaaatgcatgtaaaagcaggaataaatgaacaagaaaatcaaccatacagtaggtaaaaatcaacaaatagatttttttttttttttgagacggagtctcactctgtcgcccaggctggagcgcagtggtgagatcttggctcactgcaacctctgcctcccgggttcaagcgattctccttccgcggcctcccgagtagctgggattgcaggcgtgcaccatcatgcccggctaatttttgtatttttagtagagacggggtttcaccatattggacaggctggtcttgaactcctgacctcctgatttgcccgcctcagcctcccaaagtgctgggattacaggcatgagccaccacgcccagccaacaaattgattttttgaagagactaacaaaatcaataaacttctggctagactggtcagaaaatagcaggaaaatatattagtagaaatgaagaaaagggatataaacacaactatttcccaatatatttaaatatttaaatgcaaagagcaaattcatttaaaaaaaacaacatctacctggaatataacataaattagaatataaacttatagaaatggatataagaataatcttataatgaaagatactaaattatatgagcctcagatagtttaccaaataattccaacatagccccccctaccattctttgagtccagtattaacttgataccaaaaacataatgatagtacaacaaagggaagttataggccaaagtcattcatgaatacagtggcaaaaatcctaaacaaaatagcaaagcaaacccaaccatatgtatgaagaatgatttatcacaacaaagtcgatttttttaaaagtactattattagaaaaaatctctgaacgctaaaaggagaaaaaacttttatcattttaataagagcagacaaaggattgaataaaatttagtattgattcatgcaaaaaaaaatcctaacaaatgagaaatgacaaatagcttccttaaacataaagatgaactattcttaacaggtgatagcagcatctcaactcaatggttacacataaaagcgttttctttaaaatcaggaagcacgtaaagaccgtcatcacaacttagtttaacattgaactaaatggatcatatccactgcattaggacaggaaagaagacatatttttataatagatagaggttggaaaggaacaactgttgttaaaagaataagagaaacaaaaagaatcaaagaaacaaatagcatatgtttccattccatcactttggtattaatcacacttgtttctggagaccatggtgtaaaggaatgagccaggattactgaagggtcctgcagtgccagtgaccacaagacaagccagaaccaagttaacttagagtgaattggcctattctttaatactgctcagaattacaaactcccatataatctgtcacttaaattccattcaaattaataaaatctaattcatttgaataagacttaaagtgatttgattctactgcatcaaattctgctcagtggaatcagtccttgattgaaatctattaagttcaattcagtaaaataaatttaaatattatgcaatacaattaatttttaattaattaccatttcagttcaggtccattttgatctgaacttcaattctacatttctaaatttggtccctattcaaatcaataaaatgcagcaaaatccagtgtaattctaaaagatacaacctgaagctaatcaactgcatttatttctattcacccctaatcagatgagtttagtgacattcaatcacagaaagataaaatgctcacctttaactaccaaattgaatgtttacattagaacttcagaattaccaggttttcccaaactcacatcaccatctgcagtagggactccacaggattttatcttgactcattctttgtttggcttatatattaacatagaacaatgtagaattggatggttaggaaacaaaagagaatattgctatcctgtttaataagctgaaatcataggtaagttgagataatagacttttgcatctatgagaatgccaatacatgattttttattttatttttaaagttcttaatttaaatagtaaaagacaggaatttttgactccagaccatggttataaaactgagaaaaaaagtattaaaaggactgtattattcagaaaaaaataattgggaattaaattgagatgttactatagtaacaccattatcacctctttgtatcttaccaagcaaacaaggtcctggattggtatcccaatggcacccagtcatctgggcctctttgtttctttatagatgttcccaagtgtccagtgaactccacctaccactgtccttttcccaggtcagtatatggcagactggtctgatggtaaggatcacagggacactgagtctcaaactcttcctctgagattcttattctacaggacaggggatctatattgtttacaagatcttagtggaatcatagggaaattgaaaacccttccctatacttacctcccacccgtgggtgaaaaacaaaaaaatcagaagttattactccacggcttcacctcccccacttcatcctcctgtaaggatcctgagacttcagctaccatggcccagatcttggaagtgattctgtgcggattttccacatgtaaaagaagaggaagctgtctgtatttaagccagagaactttaggactagtagcctgtttccatttccagtccctgggggaggggttcccatcaggtttagctttaagcccctatattcctggaagcgtacacatccatactggggaaaacaagaaaattctggccggcttgatcttccaaattacagctatcagatgatttggaggactctatagaggctacagcacctccaaattccttctctgctccatcccatcctggagattattataaaagcttttacctttcttgttatctaggacatttgcactggaaggaaagtttctcacaggtgcaagaatgttttgaatggtctagaattgcaccaattaaggatgcctatacttagtaagtgtatcatcaccattcataacttaatatggattttgtaatcagatcagagtgctcagctgaaatttacttataaagtggagaaaaaagatttggtagtggtaagaaaggaagagagaaggaagtaggagatttttctgagcatgagtcgcttagaaaaaatcctgcactgcaagggccttcaaataaccaaatgttaccagagagcagagcctgggaaggactgccaatgagctgccggcaggggacactgggaacaatagtgaaaagcgtgtttgtgctgcaagggtacctgttctatttcctcagctgaagagcccccagggactctttaacagaatttgtagataaggttgtaattgtacatatgataaaactagttctcatcaagccaaaaagatgcttttacgttttcattttggagattatatacccttgtggtgttgtttttaatatcctatagaaacagtgggaatgaaagaaattaaatgtcccagagactgtgctgggtcttatctcagagggcgccaggatcatatttatttaagcagcctgttaagttactctgtgtagcccagaagttccgaagaacacattttgaaaatcacaggtatgcacctcattttcatcaagcagtccccaagcattcgcccttgtgcttctgaaacaacttcttgttattggtgaaaataaataacagaaatctattggtttctttttctttctttctttctttctttctttctttttttttttttttttttttttgagacagagtcttactctgtcgcccaggctggagtgcagtggcacaatctcagctcactgcaaactccacctcctgggttcaagtgattcccctgcctcatcagcctcctgagtagctgggattacaggtgcacaccaccacagctggctaatttttgtatttttagtagaaacggggtttcatcatgttggccaggctgattttgaacccctgacctcaggtgatcctcccacctcggcctcctaaagtgttgggactacaggcgtgagccaccgcgcccagcttattggtttttttaagtaagtcttggaaaactcctttcctttctagcctattttctttctccctttcccagtttaatcatccacaccataataaacccttcaccataataaaacttgatctgaagtgagtacaaacagtatagtgattatatttaattcatttcatatttggctgttttaatacaatatgccttactttgataatttagctctagttaacttagaatgccattcatcattacctaaccttgttgcagtgaccatagctacttaatatagttaaatacaatcttcatattctgaggttagagaagttcttgaactcttggaaatagataattcagttatttctttcctcaccactttttgcccttgtcttttaaaaaagctttccatttttattgcctttaactgctattccccaaagccaattaacaggtaaataatgatttgtaaagctaaaagtagcatttcattagcatagcactggaataagggaattctttgctcaaaataaattgaaccgttctcctcttgctgaatataaaatacacaacaaattaataatttattttagttacagtgatttaaccaaattagccaatgctaataacaaagtctacaatttcctttctctctggaatacgtttttcttattggcattcttttgcagtagatgtggaaagagctaagttaagcattttgtgctgtattttaacttattttcctaggaaaaagaacagaacaacatcaattttgcatcagcctcactgggggcattcgttatatgaagactaaagtattgtgacttgagaaagagtgagggatgggagaagaagctgggaaaccaggctgctcttgccaggtcactaacttgccacctccttgcacctgtactccttgcacatggaggaaatatttcagatcatccccttaggtcccatcctgttgtgtaataagagtccctctctactgtaagctgagggtctgccatatgagattagcacacagcctggatcccatgcacagctcagggcttctactggaacacccaccgtaaccgcccaaggagttcaccttgcccgctgcctagacagagtcgattcatcaagacaggggagttgcaatagagagagtaactcacgcagagccagctgtgcaggagaccagagttttattattactcaaatcagtctccccaagcatttggggatcagagtttttaaggacaacttggcgggtcggggggaagccagtgagccaggagtgctgattggtcaggaatgaaaccacagggagtcgaagctgtcttcttgcacagtcagttcctggatgggaggcaccagatcagatgagccagtttattgatctgggtggtgccagctgacccatcaagtgcagggtctgcagaatatctcaagcactgattttaggagaagtttagggagggtcagaatcttgtagcctccagctgcatgactcttaactataatttctaatcttgcggctaatgttagtcctacaaaggcaatctagtcaccaggcaagaaggaggtctgctgtgggaaagggctattatcatccttgttttaaactataaactgtaagtttctcccaaagttagttccgcctacacccaggaatgaataaggacagcaaggaggttagaagcaagatggagtcgattaagttagatctctttcactgtctcagtcataattttgcacaggcggcttcaccactgcccaaacaattcaacaatgaaacttcctttcctgggcttctgagcactctctgaaggtacagtgggaaccagctgtctctcttcttttcccctagagtatgttccttgtagtctcattctgaaggtaaagctgattgttatcttctccttttactgagaatgtcctaatttttacaaagaatactgggccacacacagctctctgattcatgcaaattattactgtctgcaatgaaaatgaaacacagtgttaggttgtttctactgatcactcaaaggaacaatcataaattgggcagagattctgagatatataatctttcattggttatttgaggtatgggcaggacaaaggagtcatctgctagacaaacctttaactccacttttacaggtgcccgatttgtttcttctcctccaccaagagtgttagtgtcctctagtttccaaaaacagtgatactaaccaaaaattcctttgagagaatttagcatgaggtcagctttttgaatgcaatgcaaaaaatgaatatgataatcagttttggtaatgtttctatattttcagggtcaggctgtggcctgcccagcctcaaaggcatttcatgaggtcaaaatggaaccatctacctttgtcctctctctataacatggccagagatggaatcagccaagacctagtgtagcttttgggccaaatgaccttaacatttctttcggtggttgagatgctgtggtttccataaatgggatatttcaacgcttatttttgaaactctagacttcataaggagaaaaatttattattggccatgggaagcatcagagaagctggatgctttaccacttaccctgatggaaaaagaaaggagaagcaaatgacttaaacatagaaagcaaacacagcccccgcatgctgggaccaggcacaggtggacagaagacacagcttcagggtggacctttatgtcagaaagcgggcatgtttctccctttggaacagggtactgagctctccctcttgactgtttaccagattaagtcaaatatactttctttaatgtgggtgccaaaaatggtcatgccaagggaaaataataacttccaaattaagtcaacacacagaaaaatcaagaaatttgtttggagggagagaatacctgaataactaactcattttcaaattcagagggcttgctcattcattacattcatcctggactccagtccctgttcattctcaactttaaatcacccacctgttaacaaaattattcttgaggaaaactactggaatatctgagaaagtaccacagtatttttttgcataattccaatatggtccctactttttgtattgtttgtttagatattgtgactgttcacatggtaactttatgattttcctcacctttatttctgagcactcatagagtcaagtgtacacttaacatcccaagagggtggatgagttattaccatggaattttaacccatatacccagatttttttttctttttttttgagacagagtctcactctatcaggttggagtgcaatggcgtaatcttggcccactgcaacctctgccaccgaggttctagtgattctcctgcctcagcctcccaagtagctgggattacaggcacctgccactgagcctggctaatttttgtagttttagtagagacggggtttcaccatcttggccaggctgatcttgaactcctgaccttgtgatctgcccacctcagcctcccaaagtgctgggattacaggtgtgagccaccacgtccagccccagagattttaattgactggctattttggcttactggctgacattacctctgttagattccactcattccccagcttctggcaaggaacctctgttctcttagcataatgttctcaaggttcatccatgttgtcacatattgcaaaatgtcttttttaggtctgaataatattccattgtatgtatacacaaatattatatgactctgcttatatgagatatctaaagtagtcaaatccagctgaatgtggtcactcaggcctttcatcccagcactttgagaggcagaagcaggtgaatcacttgagcccaaaagttggagaccagcctaggcaacatggcaaaaccctttctctgcaaaaaatacaaaaattagccaagtgtggtggcatgtgcctgtagttccagctactcaggaggctgaggtgggaggatggcttgagtccaggaggtcaaggctgcagtgagttatgattgctccactgcactccagcctgggtgacagagtgagaccctgtcttaaaaaaataaataaaatataaagtagtcaaatcatagaaacaaagaggtcaccaggggctgggaagacggggaagtaggcagttgctaatcagtgggcataaaagcttcagttaaacaataaaagtaagttctagaaatcagccatacaacaccatatcattaatgctacattggacactttaaaagttgtcaagagagtggatttaacattaagtgcattctcatatgctaaagtcatattaagaataagaaagagtcatccagtcagacgggttggctcccacctgtaatcttcgcactttgagaggccaaggcgggtggatcacctgaggtcaggagttcgagaccagcctggccaacatggtaaaaccctatctccactaaaaatacaaaaattagctgggtgtggtggtgcatgcctgtaatcccagctacttgggaggctgaagcaggagaatcctttgaacctgggaggcagcggttacagtgagccgagatcgtgccactgcactactgcactccagcctgcacgacagagccagactccatctcaaaaaaaaaaaaagaaagaaagaaagaaagagtcatccattgtcagggtcttcctgctctctgcttccattctttccactgcctaccacgtctaggcttttcttcccgccattcacctgaaactcctttcatcaaaatctctagtgaccttccagctgtcaaattaaaagaaaactcttagttccccatcttaatagacttcactatgaaatctgatggtgctggcccctctgctctctgggaaatcctcctgtgtttttctcccatcaccctggctgccttcgttcttgcactctgctatggtcatctccatctctggtacggtttggctgtgtccccacccaaatctcatattgaattgtaatctgaattgtaaccccatgtgtcaagggggggacttggtgggaggtgactggatcatgagggctattcccccatgctgttctcatgatagtgaggaagttctcacaagatctggttgtttgataattgcctggcacttcccccttcttgctttctctctctcctgcccccatgagaagacgtgccttgcttacccttcttcgtctgccatgattgtaagttttctgaggcctcctcagccacacaaaattgtgagtcagtcaaacctcttttctttataaatggttaaagacccagtcttggatcattctttatagtagtgtgaaatcattcttgggttttggtgggttttttgtttgttttgttttgttttgtttttgagacagagtctcgctctgtctcccaagctagggtacagtggtgcaatctctgctcactgcaacttgcacctcccacattcaagcaattctcctgcctcagcctcccaagtaactgggactagaggcgcctgccactgtggccagctatgaaatcattccgtttttgaaatgatgttgtaatctaaaagattccagcagcatttctcccacttccaatatgttctggtttgccctgatagttcctaaaacatattttcagctcagaaaatcctcctgagaaccagacttctacaatcaatttgtacattttgtgagcaaacccattatcttttcttcaacattccctagacttttgatgatgatcttccttccctgtgccctaccttcatggagcatagtaccatccccattcatacaaaccagaagcctggattaatccacagcactccctgcccatcttctcttctacctaaatcccaacagtcccagccagctataactcctgaaccttttttgtgtgtgttttctcttctcctccatttctactactattttattacttcttttctctattaacataagagcatcacatctagcctccctgaatccattttgcagaaatctatctttcatcttcctgttgatcttttgaaacacaaatttaatcatgctagttccctgcttaaaatcctttactagtttcccattattttcaggataaagttcaaacgtcttaaattgggggaagataaacattgaaaagaaaggataaaccaatgaaaaataacttcttacttggacaaaggtattttgcaatgtgaccttcatctgctgtccatctatctcttactatctactactgctcctctcagcacatctcttcagcccaattctactacatatgaatatagtcctatacatattttccaaatagaagtttacctttctgtctttttacattctgctccatttgcctaggaggtcttacctctcttatgtccttattgatctgtgtaatgcatacttgaccttcaagatgcagctcaactattttgcctcctctgggagaccttcctttatgacctcatttgcctcccccactctcctctgtgttcataatactgataaaactgttctccaatctgtatctttttcttccattctgttgagttgcttctaatgtttggcacattgtgggaacccagtggatgtttgatgattggatgaatgaatgaatgagtgactattaggccaaatgataaaggagagttgggggctaatctgctgtgtggttaaaagaactacttaactcttctagacctaaatttctttacccataaaattaggaggtcatactcaaaaacagtgaaagtttgtgcttagctccaatattctatgatctccatgacttagttcacaaaaaagcatgaccagtcacgagaattgtatggtgtagaatcagttcatggcccatacaccttcattgcggactgaccgcaacttggcttccagtttactaaatagactcctaaatcacagaagtttgaatgtaaaattgtcttccaaggagagaggtacatattcccatgagaaatcttaagcttaacactcccactgatattttttatcaaatatttctactattgacataaatttacctttatgcttatgtttatatttatatacatgtaaaattgtgatatatacttttgaaaactcgtctaagcttaaaagagccttttgaagtatagaattaaaagcttttttaaaaaaaacaaatttatttctgtaggtttttgggtaacaggtagtatttggttgcatgagtaagttctttagtggtgatttatgagattttggtgcacccatcacccaagaagtatacactgaatccaatttgtcatcttttatccctcacccccttcccaccctttcaccctgagtccccaaagtccttgtatcattcttctgcctttgcatcctcatagcttagctcccacttatgagtgagaatatacaatatttggttttccattcctgagttacttcacttagaataatagtcttcagtcccatccaggttgctgcaaatgccattaattcatttctttttatggctgagtagtattccatcatatatgtttgtgtgtgtgtgtgtgtgtgtgtgtgtgtgtgtgtatgtgtgtgtgtgtgtgtgtgtgtgtgtgtatgagaaacagtttatttatccattcattgactgatgggcatttaggttgcttccacatttttgcaatggtgaattgtgctgctataaacacatgtgtgcaagtatctttttcgtataatgacttcttttcctctgggtagatatccatttgtgggactgctggatcaagtggtagttctacttttagttctttaaggaatctccacgctgttttccatagtggttgtactagttcgcattcccaccagcagtgtagaagtgttcccctttcaccacattcacaccaacatatattattttttgattttttgattatgggcattcttgtgggaataaggtagtattgcattttggttttgatttgcatttccctgatcattagggatgctgagcattttttcatatgtttgttggccttttgtatatcttattttgaggattttctattcatagccttagcccactttttgatgggattgttttttcttgttaattcatttgagtttgttgtagattctggatattagtcctttgtcagatagatagactgtgaagattttctcccactctgtgggttgtctgtttgaaataaattgacttttaagagggttgagtgatgttcagactatcagagtattcctggggaagtgggtgtaagtgtggcagtctaatgactgaacccaggtctgtttctaaatatacctttgccttttcttgtagatggaagcccttacacttggtgggttggcaaagccaacgagaagcactactactggggaggctctgggcctggaatccagaaatgtgcctgcggcatcgaacgcaactgcacagatcccaagtactactgtaactgcgacgcggactacaagcaatggtgagtgcctgcgggcagcacagccaggctcaccctcccagtgtgcctttgtgtcaaactcatgtgatagaagaaagtttgaaaagtgctataataatacgataatagggtagaaaggtctggaactaacccaactgacaaatgtcaggaacatactgaaaaatataaaagcagaaagaggtcagtgcgacaagggtatgcatttagaaactgagacataattgatgtgttcatattttattcagagaggaaaataatgagccatgttgtagacagtgatttgcattataaaatgtgctgtgtaacaatagagggatggctgggggcgggaagccagtgtgcatgagtgcaggcagtcaacagcctcctgcggggagcacaaccacctcctgcaatgtttgcgttggggatctggattggaaaaataggagagagagagagagaagggaaaaaacaaagaaacagaaaaaatcattctttgctcttgtcttctgtaagtgcttgcctgtctacttttctttcatacctggaattgtttataactctgatacaaatcagttcaagaaagatctattttgggtttcttcgatccctttgctggcttttgttctgccccgcagtgaatagctgggtctgtgtcagtaacagataaagataagatcagctgccattctttgtgaaaaaggccccagaagtttaggtggaagactataaacctaagtgtgattctttgcagaagcacatatccagtgccggctttctacatttttagaagtgttgagaggctccatttctgcttctgggcagctgtgcacatagccagtcatggtcatgaatttccccatatgcccagccatggttttcttcagttcacctatgtagtatgctatttacagggacagtttacaagacaaattcattccaccagttaaccaaaaacaaattctgagaacgtaactttatatgaatttcaggtaggatgtctgcttactttctgaaagttatatttcttctagtaaatataacaaattacaaagcctatctatttcaatggcttagaatgtgtgtgtatatgtgtgtaaaatacttgtaaatagctatcattaatctttaattatggattattgtaaagaagagatcatgataatttttaattttatttctttgaaagatgtatctacacacacacacacacacacacacacacactgtatacaaagattggaagttgggaatggagttaaaagggcatggtctttgaaattaaccttttattcattcgttcaatcattcattcagtgaatcatccaatcagtcattcattcaacaaatattgatcaaatacttatgagtcagcaactcttctaggcactggggataaaataccaaatgcaaagaacaagaatccctgtcctgactcacattcttgttcttgatgccttttattactagttgtgtgttcttaagccaggcagaccttctcccatccatttgtctatccaacattaattccctacctcttcaggaagctgacattgggttcagcctccccaactaggagaagtgggaacagagccccagctggttcattgtccaggcagcccagagtgccctgccaccatcaccttgtcccaccacagaggagagaagagggattcagaaagagtaagatctagtacctgcacctaagtgaacttcatttttatcagacatcatgctaagttctagggatacagtgatgaatggaacatggtatttgtcctcaggagctccaaaactagttgaaggaaacacacatgtgcacacacaaatagataacataatacagtcagtgttgtgaggaaggtgtgtgcaagatacaacaaaaactaatgaaagtggcggggcgtagtggctcacgcctataatcccagcactttgggaggccgaggccagcagatcacctgaggtcaggagttcgagaccagcctgcccaacaaggcaaaaccccgtctctactaaacatagaaaaaattagccgggcatggtggtgggtgcctgtaattgcagatactcgggaggctgaggcaggagaatcgcttgaacccaggaggcggagcttgcagtgagccaagatcccagatcgtgccactgcactccagcctgggtaacaagagtgaaactccatctcaaaaaacaaacaaacaaacaaacaaaaaaaaactgatggaagaaattttcaatctaactggaggagtgaaggaaggaatccataacgtcttggaggaagaggcataaacttgaaagacaaggaaaagcaagggccctgggacactcgcccttgcatggtggtcttggagaagaagcatgacggagctgggccaggctggggaactgtctgtgcagttgacagttttgaaaacattaaggccctagcatgacatctgtgtctaaaccctgagggctaccattagtagaattacaggttgaaaacatagattttttttttgagatggggtctcactctgtcacccaggatggagtacagtggcaaaacctcggcccactgaaacctctgcctccccggttcaagcaattctcctgcctctgctggcacctgccaccatgcccagctaatttttgtatttttagtacagacggggtttcaccatgttgaccagactggtcttgaactcctgacctcaagtgatccaccctcagcctcccacagtgctaggattacaaccatgagccaccatgcctggccaagatagatctttattttttttattttttatttttttttttgagacaaggtcttgctctgttgcctgggctggagtgcagtggcgcaatctcagtgattctcctgcttcagcctcccaagtagctgggactacaggtgcccaccaccatgcccagctaatttttgtatttttagtagagttgtgatttcaccatgttggccaggctggtcttgaactcctgacatcaagtgatctacctgcctcggcctcccaaagtgctgggattataggcgtgagccacggcgcccagtcacaagattgatttttaaagatatatattagcctctgaagccatttcaaagaacatgtctgaattcagatcacagattagaagacattccattccacccttattcccagacctcctcctctggcaagcttcaattgagttctaacatttcacagttactcagggacttggtcactgctggtgtcttgttctcttctggcttagcagcagctaagacatcccactcctttgcttccgtaaagtttgtctaatatttcataataaaggcactatagcttgagcaaactgaaaagtataatgaatatttttttttttaagagacggagtcttgctctgtcacccaggctggagtgcagtggcatgatctcagctcactgcaagctctgcctcccgggttcacaccattttcctgcctcagcctcccgagtagctgggactacaggcgcccaccaccacgcctggcttattttttgtatttttagtagagacggggtttcaccatgttagccaggatagtctcgatctcctgacctcgtgatctgcccacctcggcctcccaaagtgctgggattacaggcttgagccatcgcgcccagccatgaatgttttttataataaatagctcttaaaatggtcttccctttttagcacaagaaagaatgctcttggagaaatcttcttggtctttgaattcaccagcacctagcaaaggccctccttcctatgtggatgctttagatatttgggagtggatggggttgcttctagagacactttctaaagctctcaggggcagtgaagagaaagttgagcttgatgcgggtagaccttacatccaggcccagatttgccacttttgggggaggcttttaacctctctgaaatttaatttattatctgtataataaaaataaatcttggcaaatttttgtgatcattaagaatatagaatataaaagccttctataaattatactatatgggatagttatttgcaattctattgcattattttaaaatttattttctttatttatttattttgacacagagtcactctgtcaaccaggctgaggtacagtagtgtgatctaggctcaccgcaacctctgcccccagtctcatggctcagcctcccaagtagctgggattacaggcacgcatcaccatgcctagctaatttttttttttttgtatttttagtagagatggggtttcaccaggctggccttgaactcctgacctcaagtgatccatccacctcagcctcccaaagtgttaggattacaggcatgagccaccacaactggcccttatcacaattcttaatgattccaattgactcttaaatgaaaataaatgaaaacagagcgtggcaagtaggccccttcatgctcttgacctgctgtgtcgtaggcctcaagtctaattccacaacgccacatgcagatgttatgaaacaggctttactagagaaagttataaatcagggatcatcatcagaagagcaagtacaggtctccaatcccatcatccctcagggagacgtgcgaaagccaggctattccgctgaatgcaccaagggcattcgttaccaggaagcccctgcttctctcacttctcacaaagcaaaaatgacagcaactttgtcagtaggggaaaatcagatgcatggggcaccaggcagtctgggcataggtgcctgctgtttacaagtgttgtctgggagtcagagcccctccaggaacagggaggaagccagagccccttcttgaagctgactttgggtgtagtctctctaactaggagaagtgaggaacactgtccaggcaacctggagtgcactgtcacgatcattgctgttcagtttttttgtttctccaaacacagagaagggctgggagattatgggaaataaaaatgtagcacatacatccaaatgaaactcacatatgttaaaccacgtttgttgtaatgtcagggtaaaaataaaggttctattaaatctcatgcttttagatgctttgtccagttaagaaagctattttcaataatctgaatcacaaagcatcattggattaagatgaactaagaccaaaatgaggacaaagtacccgtgccacttcctttctgtgtgatctaagtcaggatatttcacatctttgttttcttatcagcaaaatagaaatagatagtatagtacttcccaagtcatgtaaggatcttggtaaattgctgtcataaatgaaagtttaaaattacagtgtgatatattatttttattattatttgaatgttgaatggaaccttagctaaaaattattttaaaatgtcttaaattacagatgcataaattggggccctgaaaaatgtaaattactttcaaaaaattacagtagaaatgaggagtagaaagaagaccaaagacacacatctccaaacacccaggccagtgttcttccacaatatcaggatcaaggaagtttttttaatattgtttttatctatctttttaatgatttcagaatgtaatttttaactagcttatatgtaagctttaaatttaaagcttaaaccacagaccacattatatgttctttttctaagaactctaaaacttagattgaatacttattcttatttactggtgtaaaatgcataaaaatggagccaggataaatgagattgcagctcagagcatgattgggtctcacaacgaagctgcaatggcctgtgagtacgatcaccatttcaataattgcctgattatctatgctgggagaagttttgcgcagttatttctgagattgaatgtaatttaacatttatgatttactattcacagcaatagtaaatattcccacctacagtgccagaattctaattacacgagtcttggtctcagctaagtggccactgctgggtaattcctggtctcttgcagcctgactcaatgagctaaatcaccatatctgaaattagcaattcgaaaatgaaattatcagggaaagaattgccattcattgcgtgagtacccttctcttattgtagaatttctggatagttatgtcctggccaagatgggcacatacatggtggaaaataagtgaagtgaaaagccgttagcacagtctttgtgttacaattagtcagcagttcccacctcaacattagaaaggccaaatactagccgttgtgctctctttcgctgaccctaaatggaattggcttgtctaacagcctttttcttcctgggccaaaaataatccatgaccaacttttatagcagctgaggggagttaactaaaaaatatcttcgatatttcaaagccagaaacatatttatttggttgggtcagcttactatccaacacctaattctgaatatttttaaaaataatcgttataattttttgtccttgtttataagaaatttgattgaatcttagtgacttttttcatgaagttttagactgcctcttactcaaagtgaaatatttatatatgcattctcattcgtcatgttgtttaaataatagtagttacatgtcagccactgttcatgtatgtttcatatactgtgtcatttaaacatctcattgactctatgccaaaggtactacatattttgtctttattttagaaatgctccagagagattaatttctcccacaaggtcatatagttaaaaagcagtagagcagagattcaaactcggggcaagcaactttagactcatccttaggaattacacaccaagactgtattagcctgttctcatgctgctagtgaagagacacccgagactgggtaatttataaaggaaagaagcttattggactcacagttccacatggatggggaggcctcacaatcatggcagaaggcagagggaaaagtaaagccacgtcttacatggctgcaggcaagagaacttgtgcaggagaactcccatttataaaaccatcagatctcatgagacttagtccctaccaggagaacagtatgggggataccacccccatgattcaattatctccacctggtcccgcccttaacatgtggggattattacacctctgggtgagatttgggtgggaacacagccaaaccatatcaaagatgtaagttctgtataaatttttcacctgtgtactatatacagcacaatttcattttttttccaatttttattatggtaaatacacataaaatgaactatcttaaccatttttacttttacaattcaatggtattaaatgcattcattttgttgtgcaatcatcaccatcatccatctccagagccgtttttatctagcaaaactgaaacgctatacccattgaacagtaattccccatttccctctcctcctagcccctggccagttaaccttaaataatgagttcagaaaatgtgattaaatatagagtttattccagctcaaagcctgaggatagccaccagggaaacaccaactccaagtgaatggggtcagctttccaaagtgggaaagttaaggtttcacttacataggcagaaatagagaaggttaacagggttgcaacatttgccatataaggccagcacagatgttacggtcatttgattggttacagtttgctatgttccaaggaagattgctttaacattccataaggaggggtaatggtctcgaggggtcttatttctggaaccatttggtcttttctaatcatttacaggacagaaatgaggaagagatttaatctataatcagagaagcagaagttgcagctgcacgtggcataactcaggccacataaccacatttctctcaaggctcaaaataatgtaaagttccaaccattttaagtttgaattatttgatttcacaccaccatcgttctattttctgtctctgtgattttgactgctctaagaacctcatgtgagtgaatcatatagtatttgtctttttgcagttggcatatttcacttagtataatgtccttaagttttgcctattttgtagcatgtatcaggattttccccctttttaagatggaataatattccattgtgtgggtagaatacattttgcttcttcattcatttgccaagggacacttttatttccacattttagtgactgtgaataacgctgctacgagcacggtggtacaatttctttttaacgtctacttttactcacctctgtagtgctcctgatttggtttctaaaaatctcttattttaattttatattaaaagtattcattatgacaaatacattcaaattattttctgaatgtgacctgatttcaaatcctagtcctattgcttgctagttcagtgaccttcagcaagttataaaagctgtcaatgactgtttccttaaccacagcatttaaatggcactcacagctacctcacatggtagaaagggagtttaaatgagaggatactcataagggagaaggcacatccatatttcactagtaaatgctcaagaaatattgattccaattacacccaagcacacacagataagggttagctcatgggttccccaggagcagcctcttcagtattcaaaaacaactcattgggcccctctgttctgacctccttgcctgcatgccttgctgccaccctgctgctgacactgccctcctgagatccttactctgccagctgcagctgtctcagcctgtgacagtcactgatgcccttatggagagatggagagggccccctactcaacctcagtgcagtggaaacgaagctatggctttcagcaagacttgacaaggattggagctaacagaaattttacactgagagaaacttgcaactgcttcctgaaatagccactcttcaaatccaggcaggagcccagcccctgagaccctgccaagctcccagcgaagcctcctatgggtctcaaccctgctttcattaatgaggctcctcaggcatttggatccaagccaaacctcctccaagccccagaggaagaagaagttcttcttcatcccaagccctacctcagttcctacaggaggaacatttgcttctcaggctgattgatagtgcaataattaaatcccttaaggaggaaattcccagcttaagccacaaaggtgtgcgtcaatcacctggcctgaacgggagcatcgctgtggtctgttctgggacctgggtttgttgagtgcatttctccaagctaagattccagtcttcagggacgcctcctgtaggacaacagtctaatgcaatgtgtgcagtgacaatatcagtcaagttttatttcatgatgtctcctcataaagagaagagaaggtaaagtcagcaagctcctccttctatgatttcatgggagaaaaagccaagacaaaaatgtaacacatgtccaaaggataaaaaggagcttccagggataagccagtttaaatccagatttattgggggaggaaggagcatctctcatactgctggcacaaggtcctgctaaatttacagtattcaacagaaaaatcacttcgcaaggaatattccattttaattcctgcccccaaattcaggagcaatatggaagtacttgccaggcatgtccacagatgaaaagccacaaaagtgatctctcaggaaatagagattttaccctcagtgacaacactggaaatcactttataaccactgcttccattccacctgctcccaccttagacaaacaaacacaaatggtttttacagcttcagatttttagggcccaacaacaggcagttcaatgaaggaaagataaagaaacatggacaatggatatttaaaaagaatttctgtttcataggttttaaaaaaggtttctaacatcagtctggaaaacagaaaccttaatacgagacagaaggtactgcacgatggcagctaggagcctggctatagagtcagaccatctacgtttatgttcctcctccaacactcagccagttagtaagacctgcctgtgcctcagttttctcttatctacagtggagatgaaaagagcgtgtctccagagatgatgtgagaatcaggggacccaagcaagctgagcatcattctttgtcctgtcagtggcaatgggactggaaacataacctttagtacaactgggtaggaatgtatgactgaggttacttttttgagggctatttgggaattgccatcaaaacttgaacactacattctttgactgaatccttcaccatatggcatgtaccatcttaaaaaaaatatatgttctaaggtggcatataccattttttgtagcagtcaaaaaaaaaaaataacctgtagacagcagaaatgtccatgaatagagtttcagaaaatgatgttataaggctggccaaggaatgaagtagatacataaacacttgcacagaaagatggccaagatgaaagtgaaaaaagcaagttgacaaatagcaggtataatacgagtctggtgtttcttttttaaaaaaaaaattatttaggctggtcgtggtggctcacgcctgtgatcccagcattttgggaggccaaggtgggcagatcacctgaggtcaggggtttgagactagcctggccaacatggtgaaaccctatgtctactaaaaatacaaaattagtcaggcatagtggcacatacctgtaatcccagccactcgggaggctgagacaggagaatcacttgaacccaggaggcagaggttgcagtgagccaagatcgcatcactgcattccagcttgggtgacaagagcgaaactccatctaaccaaaaaaaaaaaaaaagaaagaaaaaaaattatttttgagaagggtctcactgtgttgccccagctgaaatacagtgacatgatcttggctcactgcaacctcgacctccccaggctcaggtgatcctcccacttcagctgggactataggcacaaaccaccacatctagctaattttttgtattttttgtagagatgggggtcttgccattttgcccaggctggtctcgaattcctgggctcaagcaatctgcctgccttggcctcccaaaatactgggattacagttgtgagccactgtgcccagcctggcatttctctaatgtgtataatccataacctttatacatgcatacataatttctagaaaatctacaaaagaaacaattacaacgcaatagattaaggatgtaggactttatggaggacctggcttgtcccattgtacatcttataagctctttgaattttttgccatgaacacatttaacctgatcaatttaagtatttaaaaatagtttagaaattaaaataaaaaataagaatcctagccagcatcccagtacataataaaacaatactaaattcttattttaagaaaaatcagatcaaagactaattttcacatcatcaacaacaaaaccaaacaaagcatcttactggctctcctggccccaatattggaaggaatttctcagcaagctggaggattcctccgctcagcgggcgccgtgaaactgagaatattcataccattagccctgtaaccacatgcaaaacaaaatagttttttcattgatctgagttctgtggaactcatgtttgtgctcttaaatcttttggaatccttctggggaacaatcacttgacatcccaatactcagtggtcttattcgtgcatattataggaatatgatattatgaggagtactggtatcagttatgacaccagttgctaaactgaccagaaagattgttgatattcaaataaatgtgtgtgcatgtgcttgtctgtgtgtgtgtgtataaaataaaatgttaaaatggacagctatcaatatattttctttctagatacataaacggagatgccctcctgatctcatgaaggccattttcattaagttaagctttgttcattttcattcagttaagctttgtttaaaaaaaaaaaaaaaagatattgctttaccagtgatctgggtggcgggcgggggtgaagaagaagaaaaaaaaggaaactcttaattttagtcctatttagccccaaagcatgtgtttcagtattagagcatggccagagcagttttcaaaagggttacaccatcccgtgtacgttactccttatactgactccactgtggtttacttggcagatttgagctatgctgaagttgcctcttaacaggagattcctagagcgtctaacagctcaactcttttaggagcttaactactttttaatatgtgggtcagggttaagagcctcaggcaagggcttctgccctctttcgttaggaatttaccttggggatgaactaaaaaacttcaggaggctcatccaggcaggttccagatagctcaaattgcaaagctacctggaaagccactgtgtttctgcagccctgtgagtgaaacacctgttattggcaatggggaaggggaaatgtcctgtctctcccagttccccaaagaagcataaaaatgatgtattatatactgtctcagggacattttggtgccaacccacttggcacagcatagaatcctcctgtcacctcatggattgtatcatgacagaagggtaattgggcaccggagaagatgtcagcagagtgtcaatacggtttggccactgcccccaaataatattgatgacagcaaagagagcgattaatcaggtgtgatcctgtcaaatgttcagagtgtgctgtgggtactagaaatagatatagcctaccaacaaaatgttaaatggacttaaacaaaatagattatttagtcattttgagaaaagcagaactaagattcaaaagagctttttttctgaaaaaaaaaaaaaaaaatacagtgtatttcccattagtatttctctccacttgcttgaaaaagagggagagctgttatgttttctgaaaaaaaaaaaaatgcattctgcccaaaaaatcaatcatggaaaaaaaaagatcaaattaaaagagatgtcatgggatctaaagaaaagtgcagacgcagcaattgtaaaacacgttataattgtggacctatctgtttatttattctgtgtcccactgaaagttcaccctcacaccctccctaccaggccagccatctcctcccattaccccctcttgatattaatgatgctcgctcacttgtagtttcccacgtgtaaaaccccattgccttatgtattatcagttgttcaccattttccatacatggattctgtctcccctgggcctttcacagacacctgaccatctgtgaccatggcctttctcctagttctaaatctaagcaatggtattgcaacaatcttccaaaataacttccagccttaaaactctcttatcctacaactctgtctataactgtggccatcactggcttcacattagaatcacctggaaaacttaaactattacttatcattaggccctgcctcagactaattaaatcaaagtctctggagattatttttggccatctttgattttgcaatttcctgaggtttctaatgtgtagccaaggttaaaaaccattgatatagggctaggttaagctgcatataacagaaaaataactaaacaagagtgcttaaacaagatgaaagttagttcccatgcatgtaaaggaagtccaggctccttccagctctctgttctggtgttattcagatttgacatcctcctcaggatccaacatggcttctagagctccagccattatgcttccattccaggcagaaggtagaaaagagaggaaagagagcatgccttttccttccaagaatgactttacataccacttccatttacgtatcattggctggaactttagttaaccacgactagcagcaaagatggctgggttctgtagcctttaactgggcatgaatatgccttcctaaaaatgagcattctgttaccaaggaagaagaggaaaatgagcattaaggggcaactaagagcctctgtcggaagtgttaattcttcaaaggggccctgctagtctcctgttcacacctacagtaggtccctgtgatctccagaataaagtccagactcctgcagttctggagtccctcctcaccttgcattctctgctttacctcactcacactggggccattgtaaggatatttgtattttctcatcgctggtcctttacctacacctaaaataactcttcacatatctgcgttttcaacatcatctacttctgcagaaccagcgccagtgctgcttcccaaggaaacctccctgcctttgcccacacccctcatgtctagcaaaagtccatgcataaaaggcctgcttcctgagggtctcaaagcaaattacacttattttaaagttattttctctcttatctgcaattagatgcctgggtatctgagttctctctcaaattacaagcttcaggaggtcaagcaccatacctcatgtgtattataagtcattcatgcctgtcacttagcagctagtcaacatctatttgcaatgtaagccaaatgtgtagcactttagagaatccggttttttgtatgtatttataaactttctttttgcattgagtcataaacccacatagacatacactcatctctgctttaggctttgtagatggttttagttcacatagcaaaaattggaaagttactttatattcaatagtgaggtaaatcatccaagtcagtttttaaaaagataatgggtgtgtactaatatgtatgtccatactcacatagacactgacacgtgtatacaagtatattacatgcacatcctacattactaaatgtgatgtataatgactttattaatttttttggaagcatgctagttgtcttaggctaatttaatgcccggtattaaggtgaaatcaattactaccttttttcatcaggactagaggaggaaaaaaacaaacagaaaaactacccttatgcaggaggaataattctaaagacagaaatacaggatgtttggaaatgaccatctgtgacgatatttacctgcttgtccctgtcagccctgggaatggtgtgtctttaccttaggttactatattaggcagaataatggcccccaagatgttcacattctaattcccagaacctgtgaaggtcctacttcatgtggcagaagggactttgcagatgtagttcaaggtacagactttgagatggagagattatcctggactatcagtgggtgcccagtcaaagcacatgacttcttaaaagtgagaaaagaccctttcctggctgtgatcagaaagaaatgtgatgacagtagtaggctcagagagatgctatattgctggctttgaaggtggaggaagaaatccatgaactaagacataaaggcatcctatagaggctgaaagagacaaggaaattgactctcacagaggctccagaaaggaacacagccctgacacaccttgatcttaatacagccagacccatggtctgaattctaatctacagaaccataagataatatgtttgtcaggttttgtttttgttttgagacaggtctcactgtgtcacccaagctagagtgcagtggcgcgatcacaactcactgcagcctcaacctccctgggctcagatgatcctcccacgtcagcctcctgagttgccaggactatacgcatgtgccaccatgtctggctactttttctttctttttttttttttttttgagacagagtcttgctctgtctcccaggctggagtgcagtggcgcaatctctgctcactgcaagctccgtcccctgggttcatgccattctcttgcctcagcctcccaagtagctgggactacaggcagccgccaccacgcctggctaattttttgtatttttagtagagatggggtttcacagtgttcactaggatggtctcgatctcctgaactcgtgatccgcccgcctcggcctcccaaagtgctgggattacaggcgtgagccaccacgcccagcctacattttctattttttgtgtttttctccgcgttgctcaggccagtctggaactcctgggctcaagtgattcacccaccttagcctcctaaagtgctgggattataggcatgagccaccgtgcccggccacatttctgttgttttaagctacttcattggtgttaatttgctaggcagcaataaaaaattaagtttccttcctacggtggtgatgtcatcaaaaagaccccgtaaagctttattttttcctctcacattggtatagagtgaaagttcactggtaaaatagctttgcagaaaccttaaaaagtatgccttggccgggcgcggtggctcatgcctgtaatcccagcactttgggaggccgaggcgggcagatcaccaggtcaggggttagagaccagcctgaacaacatggtaaaacccgtctctactaaaaatacaaaaattagctgggcgtggtggcacatgcctgtaatcccagccactcaggagactgaggcaggagaatcacttgaacctgggaagtggaggttgcagtgagccgagatggcaccactgtactccaacctgggtgacagagggagactccgtctcaaaaaaaaaaaaaaaaaaaaagcatgtctctgaaagtgattttgtggctaacaccctgtttccctgcctgtccatcacttgctgatgctgagagcttccagcctacgaagaggatgtgcagggccttcgttcactgataaccagctctaccagtgaaggactggttgtctgtgcctacctgtgatcaggtctccttcaagtagatgattatatagcagttggcaggaattttttaaaactcagaaacattcatttatacatccaatcattcagctcatgtctgagtccctgctatatatcaggcacagtcagactatctggcagtccttggaaacacagggtgggtgggtagttttaagtcatatgcctcctgctgaaagacagatttaagaatgtgtcttcacaatccctacaccactgcaatttcacgtatgtgcttctgctcctgtcttttttttttttttttttttttgagatggagtctcactctgtcacctaggctggagtgcggtggcgtgatctcagctcactgcaagctctgcctcccgggttcaagcaattctcctgcctcagcctcccaagtagctgggactacaggcacccgccaccacgcccagctaattttttgtatttttagtagagatggggtttcaccatgttagccaggatggtctccatctcctgaccttgtgatctgcccacctcggcctcccaaagtgctgagattacaggtgtgagccaccacgccctgcctccttttttttttttgtttaacaggcagagaaatgattagataatgaagacgttatttattttttattttcataataatgaattaaagaggatcttatggacattctgagctttcccattgtaacagcctcatttatggcagacgccatttgcctgctgtccacaccgtacttaatttggcctcaatctgtatctttggtgtattaatctcctcatgatccagataacctcttctccattaacaatggggttttatagctaggacagtgcctggaaagttataagcattattattttctattattattatttaggagatgttttgggcagcttactacattgcacagaagctatctcatttcctagggactttgatgcaatagtcaattgtaaaatagacttttccaaagtcattcatttcatccattcctttaaacacctaatttttgagttcctgttatgcacaaggtagtctgctaagactaatgacaatgataggtgaatgccacccctgctattatcatctttagggctttgagaagttacttgacttttctcacttcagtttcttcatctttaaaatgagaatagtaatattactgaccttgtgaagatccccatgtttatgcaatatgggtattgttttatcaggcctttgtatttcagaagtttataagcctcatgaacaggagcaggggaccaactagacaaggaaagaggcagatctattcaacaaacatgtgttgagtacttactatgcacaaaggcaggatatcaatatggggggtaggaattcaatggtgagtaacgctgagacatgtggtgggattttagagcacacattttgcaaatcaaagagaacttgtgaatccctgtaacagccctagtgaaaattgttaagaatgattctggcaagtcccatattagccatatacaaattatccccattatagacttcccatagtgtatatctctagtataaaaagcattacaataatcacatttaatccttgttacattttaaatacgcatgtcgatgcaaattacaaatatcgaaaggaaaatgaagacagaaggaaaataaatcaagaaattcatttagagaaagaaaaatcacaatataaaacagccaatctttcttgttaagagcagccctcacatttctaaatgtatgaattggttttgtgttgactgtgccccaaccctgcttatagtatgtcaatattgggagaaatccatcactgacactaacatggcagccctctgaggagtcaagccaggggcatctagaggggcaatgcccaggcttcactccccctccttttgaaaggctcaggttgccttatagtcttccataaaaatactgagggcttttccaggactgctcactgtgtgataggaacttacatctatagggcatgtggtaacatgcaactgaaagcttagatttttttctagtgatgggtcacattctacactaggtccatcttgccattggtgccctgaagtgctttgtctaggccaactgatgcagtccacagagtctaaagaccactcaaactactcataacgtttcttgtggctgcccatccattccagttctaggagtagtttagaccatgttcatctctattaattatctcaagtctttatgcagaaacagcaacaaaaataggctatagaggtatgagaagtggttttgaattgttagtaaagagaggatgcaaaaatcagtttgtttgttgtcatttatttcaagctcaatattagatgccaatgttagggactatcaacatacaaagaacattttttaaaaacactcttaatgacaccttagtcaagtgtccaggttataggagtttccagcaagcatcagctagaccacacctgaagaattataaatagtactaaaaaaccaaaacatggaaaatgaggtcaggaatttgataagtgtccaatataatgataatgagcaaaaaggaaggaaggaagggaggggagggaaggggaggggagatgagaccactgtccatgcaataatccctttcccagtgttaacagttgaattgtgtccccacaaaagatatattgtgaacgtgacatgtttttgacatagagtctttacagatgtactcaggttaagatgaagtcattattaggtgggccctaattcattattactgttatcctcatgagaagaggaaagacacagggacagacacacatggagaggagaatgccatgtgaagacccagactcaaggagaacaccacgttgggagggaggcagagatttaagtgatgtgtctaccttccaaagcatgcccagggttgcctgcaacaccagaagctaagagaaaggcctggagcagattttcccctaggcccttctctccgtttaaatttatttttaaaaattttttagaggtggcatctcggtctgtcacccaggctgaaatgcagtggtataatcacagctcactgcagcctcaattgccagggctccagcaatcttcttgcctcagcctccgaagtagctaggattataggcatgcaccaccatgcccagctaattaaaaaaaaaaaaaaaatttctagagattttcctttgtaggaattttctgtgttgcccaggctggtctcaaagtcctaggctcaagtgattcttctaccttggtctcccaaaatactgggattacaggtatgagccaccatgcgtagcctcctagagccttcagaaaaaaacgtagtctgcaaacaccttgatttcagacttctagcctccagaactgtgagaaaataaatctctgttgttggaagccacccagtttgtggcattttgtcatggcagtcataggaaatttaatgcattcagcaatgctgccagagatggccattcccctctgccagcacattcctaatgtggtgccagtctcctaagccagtctgatgatgttggacagctccaggcatttgctgagggcttcccaaatgctgggcaccactctaagcacttttttcttttcttttcttttctttttttttttttgagacagagtttcactcttgttgcccaggctggagtgcaatggcacgatcgcagctcacccaacctctgcctcctgggctcaagtgattctcttccctcagcctcccgagtagctgggattacaggcatgtaccacaatgcccggctaatttttgtatttttagtagagacagggtttctccatgttggtcaggctggtctcgaactcctgacctcaggtgattcgcctgccttggcttcccaaaatgctgggattgcaggtgtcagccaccatgcaagcccacactaagcactttatctgcatttccttatgtaatcttcacaaaaacctataaaataggtacaattacttttccaactctgtaaataaagaaaccgaggcttagagaggataattaacctgcacaagaccacaccattcataaggagtgaacgggaggcaatctgatgctgcagccatgatactccacctcctgtagagaaaaggggaatgagtgtgatggttaagagaactgaaagtaagccgggaagatggaacagagaaggaggcatggagaaaggtgaaagatgtaagcccagtcttagactgtccttgtgcagagtatgagagccaagctgtacatagagtagacagagggagagtcatccacacctctcaagtcagaaagaaagagaatgtggcaaggtgtggtggcgcacacctgtaatcccagcactttgggaggcctaggcgggcggatcatgaggtcaggagatcaagaccatcctggctaacacgatgaaatcccgtctctacaaaaaatacaaaaaaatttagccaggcttagaggcacgagcctgtagtcccagctactcaggaggctgaggcaggagaattgtttgaatctgggaggcagaggttgcagtgagccaagatcatgccacggcactgcagcctgggcgacagagcgagactccatcagaaagagagaaagagagaagagagagagagagagagagaaggaaggaaggaaggaaggaaggaaggaaggaaggaaggaaggaaggaaggaaagaaggagcagttttaggttcacagcaaagtaccccctaccccctacacatataatgcagacaaacacacacaagcgcgcgcgcacacacacacacacacacacacacacacacacacacacagctttcccccatgatcattcaacacagggtagtatatttgttatactcatgaacctacattgacacattatcatccaaagtccatcatttacattgggtttacacttgctgttgtacattctgtggattttttattttttaattttttttttgagacggagtctcgctctgtcgcccaggttgaagtgcagtggcgtgatcttggctcactgcaagctctgcctcccaggttcatgccattctcttgcctcagcctcccgagtagctgggactacaggcgcccgccactcggctaattttttgtatttttagtagagttggggtttcaccatgttagccaggatagtctcgatctcctgacctcgtgatccacccgcctcggcctcccaaagtgctgggattacaggcgtgagccaccacgcccggccattctgtggattttaacaaatgtataatgaaatgcagctatcattagagcatcacacaaaatagtttcactgctgaaaactattctctgtattccctccattcaatcctcccctcccctcaactcctggcaacaactgatcttcttactgttttcatagttttactttgtccagaatgtcctatagttgaaatcataaaggatatagccctttcaggttgagctaattttattttagtgataaaaaatgttaaatagtatgtagaagaatttagggatgctgacactgtgaaaacaaatatatttaattacgctctacttggagtttgtttaaatcagatgtaaatgatatttgagctgattataccttcttcaaatggagtcttatttgaaagtctagtatgaagagatattaaaatggagcatgtctgggcaaagggaaaaagagattaggagttccaacaactccacacctctccccacgcctcatcctccatgatggaccttggagacttacatgaagcctccagtgcttcatgaaacacagcattaaaaccagatttcagagattaggactttaaaaatttagtgaatttataatagaagtatgatgaaaatgtccttttcttccataataaaatgggaaggtacattctataaaactgtcaaagtttacctgatgtttgatttatgcttttaataccttcacatacactttcttgagtttgttcaatactaatagtcaaaattcaaagaaaattaaagtcaacatctttttacttgttgaacacattaagtcactgtgatctacatgtaattccatcctctccaaattaaaattaaaattaaagttggattgactggtatacagattacagttcatgaagtctcgttatataacctttgaaccaaagtttatcttataaacacgtaagataaatgtcaaacgggaaagtaaaaaagattttataaaggaaaatagaagaactgaaggcacaggataaatctacatgaaaaaaacaaagagcgtttttaaacacttcttcatgtgaattcaggtgataatacaatggagttattttactcttaagacagattgacatatttaaacatagttctgatgatgtggagatgtctacagaatatatttcctctctaatttaaattatttataattgcatagttagttacaaagaataaaatcaaattaattactaataaatgccagagaaacatgtttaaattgacattcacttccaaagtcagctcctgcataatcaccacaaatttttaatatttgctacaatatgacaataaaacaattgcgtatattacagagtagaagaaactccttcaaagataaatatgcatttattctatttagttgtagaatgataaagataatttttttagaatggtctaaggataactttttcaagaaaaaagatgaaaaatgttctgttcccccaaactatcataagcctgccagccacacctctgccttatcatattcaacctgagtagatgacagtcgccacttatgccatattgagaaaaactctgatggtctgattagattcattgaaatactttcagtattagtagctaaatagggttctttttaaagtttaatttaacctaagagttgtaaaaatgaaataaatattattttaaatattgtagaataagtcaaacacttttagtttcaaatggattgtcaagataactgatgtactccgtaaatatatacatctactatgtgttcacaaaaatttttttaaaaagaattggtaggcataggctagtaaattgaccaatatcttcatttgcttaaaataaatttctaaaaccaagttgttccttgagacatatgcaatatcttcagaatttcatgccataagattaactatacttgatcaataaactttgaaattttaaaataaatacagaaaagttctttctcaattcagaaataactactgatattccctgggtgacttttttctcagacaagttagaaaaccaccaatttgactagattgggaaattccttaaaaggaaattagtgcaatggccgagaccttgactctgggatctcctaagttagagtcccaggactacctaccgattatcaattaaatatgcagtcttggtgatatggtttggctgtgtccccactcaaatctcatcttgaattgtagcttccataattcccacatgtggtgggagggacctggtgggagatcattgaattatggggcagtttttcccatactgtcctcatggcagtgaataagtttcacaagatctgatggttttataagtggtttccccttttgcttggctctcattctatcttgcctgccaccatgtaagatgtgcctttcaccttccaccgtgattgtgaggcctccctagccatgtgaaactgtgaacccattaaacctctttttctttataaattacccagtctcgggtaattagcagcatgagaacagacactcctaatatacttgggaaaattatataacctctttaaacctcaatttctcaaagtgagggatggtgaacagcagggcgaggatgagaaagaagatgctagtgtaagtaatagtacctccttcacaaagctataatatagattatatgaaattatgtgtaaaatgcatgtaacataatcagaagtgttaggttttactgctactcatgagtagcttatttatttattttttctcattagaagaaaactttaaagcgatgaattgtcttggtgaaaagtattaggagactcttggctatgggtaaaaatgtcagaaaacaatctataggctagagtcagtgcaaaggaagttatgtttttggtagcctaatataaatgtaggtcgtgtttcctgatgtcagcaacattctaagaggcggtcagttactctcacacttggaactgctctacctgactatgtagtgggttttgggagagtcctaaaaaccacatcttataatgtgtcttctataaaatgttccacagagttttttataaaacctttaaatcggccgggtgcggtggctcacgcctgtaatcccaggactttgagaggctgaagggggcagatcacctgaggtcgagagtttgagatcagcctgaccaacatggagaaaccccgtctctactaaaaaaatacaaaattagctgggtgtggtggcacacacctgtaatcccagctactcaggaggctgaggcaggagaatcgcttgaacccaggaggcagaggttgcagtgagccgagactgcgccgttgcactccagccggggcaacaagaacgaaactccatcccaaaaaaaaaaaaaaaaaaaaaaaaaaacctttaaatctttatatgtgatctgtttatgtattgagttctgctcttattgatcatgtgtgtccatagaggcaagatagagcagtcaaattgtgatgaccagtatgagctgcatttgaagttcagctacacagaattttagaaagggatagaagagatattattcacataaatatttaaagactaattggacactatagggacagcatgtaacatggaggtgaggagaaggactcctcccaatgcttcaacaagaacacagctgtgtagataccatctaacgctgcctctttttcagaaaagaatatcctacaaactcaggttttactatcagtatcacaaaataataacattattatgaaataatgtgatttaaacaatatttaaagatatgaaaggtacagtttcaaaatacaaagtgttatacaggtccagccatttagagatagactaatccattatctactaacttctggtttttgcaaatagtatactagaattcatcctgtaagtattaaattttataaatatccaaaatgcctgtattttgccaaaaagtaaagccaccctatttcaaattttttaatctcagtacctacttttaggtaagcccattgtaaccacaaagaaaatacatacagagcagtgttccccagcctttttagcaccaagggacagttttatggaagacaatttttctatggaccagggttggtgggggatggtttggggacaaaactgttccacctcagatcatcaggcattagttagagtctcataaggagcacacaacctagatcccttgcacacgcagttcacaatggggctcaagcttccatgagaatctaatgccgtcactgatctgacaagaggcggagctcaggcgggaatgctcactcgcccgcctcacctcctgctgcatggcctggttcctaacaggccacagactggtaccggtccatagcctgggagttgggaacccctgtatagagcacatacaaaagaaaaacagaaagaaaaaaaaacaggaaaggagaaatgggacaaaataaatacaagacaaacaaacaaacaaaaaaggttaacaaaatggcaatagtaagtcaataattaccttaaatgaaaatagactagactccccaatcaaaagacagagtgactgaatggatttgaaaacaacaacgacaaaagatccaattaaatactgtctacaggagactcactttaagtttaaagacacacataggctgaatgtgataggatgaacaaatgataatctatgcaaatggcaaccaaaagagagcaggagtggctatacttagaatagattttaagtcaaaaactgtcataagagacaaaaaaggacactatataataataatatcagcagaaggaaggctaattcaccaagatgtaacaattttatatgcacccagcatcagtacctctaaatatatgaagcaaacactgatggaactgaagaaagaaatacaatattagaagacttgcatatcccactaaatagcagatagacattcagacagacaaatcaataagaaactatagaccaagtggacctaacggacatacacagaacatcccacccaacagtgacagaattcacatccttctcaaacacacacagaacattctccaggatagatctcatgttacgtcacaaaacaagtttcaataaacctaagattaaaatcataccaggtatcttttctgatcacaatggaatgaaatcaaaaataaataacagaaagaaaactgaaacatttacaaatgtatgaaaattaaatgaaatactcttgaacaatgaataggtcaaataaataaatcaaaagggaaattagaaaatgtctcacgacaaataaaaatgaaaacacaacataccaaaatgaatgcaatacagcaaaagcaattttgaaagagaaatgtatagtaataaacagctgcataagaaaagaagaacgcaaatcaacaacctaacatacctcaagaaactagaaaaaggaaaacaaacttagcccaaagttagcagaaggaagaaataatgtagattagagcagaaataaacagagtaaaaaaaaaatagaaaaacttgaagaaatattttctaaaaagataaacaaaattgacaaactaaaaaaaaaagagaaaaaaactcaaataaataaaataaaaaatggaaaaggagacattacaacctgatggcttcaatgctgaattccaccaaaaatttaaagaacttatgctaatccttgtcaagatcttccaaaaaattaaagaaaaggggatactttcaaactcattttataaggccagcatttccctgacaccaaagccagacaagaatattacaagaaaagaatactacaggccaatatccctgctgaacatagatgcaaaattccttaataaaatactagcaaaccaaattcaacagcatatcaaaaagatcatacaccacaaccaggtaggaagaaggatgtttcaacataaataaatcaattaatgtgctgcactacattgccagaatgcctaggaataaacttaagaaggtgaaagacttgtatgctgaaaactatgaaacattgatgaaaaaaattaaagatgaaaataagtggaaagacgtcccacgtttatgacaggaaaacttaatatcattaaaatgtccatactacccaaaggaatttagagtttcaatgcaatccctatcaaaattccaataacattcttttttctttattttattttatttatttatttatttattttgagacagggtctcattatatcacccaggctggagtgcagtggtgcgatctcagctcactgcaacctccgcctcccgtgctcaggcgatcctcctgcctcagcctcacaagtaactggaactacaggtgcatgctaccaggcccagctaatttttttattgtttgtagagatgaggtctcactatattgcccaggctgatctcaaactcctgggctcaagtgatccacccaccttggccttccaaactgcgaaacttacaggcatgagccactgtgcccgccccagcattttttacagaaatagaaaaaacaattccaaaactcatatggaaacacaaaggatcccaaatagctaaaacaatcttgagaaaaagaacaaagctggaggcatcacacttcttgatttcaaaatatattctgaagcttcagtaattaaaacactaaggtactgtcataaagacagctttatagaccagtggaaagagggcccagaaataaacctgtgcatatatgaccaactgatcttcaatagagatgccaagaacagacaatggggagaggatgatttcttcaataaatagtgttggggcattgtatatccacatacaaaaagaacaaaattaaacccttactgtacaccatacataaaaatcaactcaaaattaattaaagacttaaacgtaagacctgaaactgtaaatccttagaagaaaacgtaggggaaaatcttcatgacattggtctttgcaatgatttcttggatatgacaccaaaagcacaaacaacaaaagcaaaaacagagcaagaggtatactatgtcaaactaaaaaacttctgtacagcaaaggaacaatcaatacagtgaaaaggcaacctgtagaatgagacaaaatatttgcaaaccacatatctgataaggcattaatttccaaaatatataaggaactcctccaacttaagagtaaaaaagcaaacaaactgatttttaaatgagtaaaaaatttgaatagacatttatccaaagaagatatacaactgggcaatagatacataaaaagattgttcaacatcactaatcatagggaaatgagaatgaaaaccataatgagatatctcacacctcttagggtggctattggtttttatttgagggggtttgtttgtttgtttgtttgtttgtttgtttgtttgttttgagacagaatcttgctctgtctcccaggctggatggctattgttttaaaaaaaaaagttacttggtgttattaaggctgtggagaaattggaacccttgtacattgttggtgaaaataaaaaatggtgcagctgtgtatatatatgtatggaaaactgtatagaatgttctcaaaaaaattaaaagtagagttgccatatgatttaataagtccacttctggccatttactcccccaaaattaaaattagaatcttaaagagatatatggaccccatgttcactgcagcaatattcacagtagccaagatgtggaaataacctaaatgtctatcaaaagatgaatggatacagaaaatatggtatatatgtatatatgaatggatacagaaaatgtgagatagatagatagatagatagatagatagatagatagatagatagatataacagaatatcattcagccttaagaaaaaggaagtcctggctgggcgtggtggctcacacctgtaatcccagcactttgggaggccaaggcaggcagatcacttgaggtcaggtgttcgggaccagcctgaccaacatggtaaaaccctgtctctactaaaatacaaaattaaccaggcatggtggtgggtgcctgtaatcccagctactggagaggctgaggtgggagaatcgattgaatccaggaggcagaggttgcagtgagccaagatcgcaccattgcactccagcctgggcaacagagtgagactctatctcaaaaaacaaaaagaaagaaaaagaaaaaggagtcctgccataagtgacaatatagatgaatcttgagaacattatgctaagtgaaataagtcaaccacagaaggcaaatactgcatgattccatttatgtgaggtatcaacaataatcaaactcatagaagcaaagagtagaatgctggttgccaggggctggcaagaggggaatacggggacttgctattcaatgggtataaagttttagtcatgcaagatgggtatacaacgtagtgcttacggttaacaatactgtacacttaaaaatttgagagagtagatctcatgttacctgttcatactacagttagagtattagtcctttttcacactgctgataaagatatacccaagactgggtaatttaaaaaagaaagaggtttaattgggcttacagttccaagtggcttgggaagcctcacagtcatggcagaaggcaaggaagagcaagtcaagtcttacttggatggcagcaggcaaagagagagaacttgtgcaggggaactcctccttttaataccatcaaatctcattagacttattcactatcatgagaacagcatgggaaagacctgcccccatgattgaattactgcccaccaagtccctcccacaacatatgggaattcaagatgagatgtgggtggggacacagcaaaaccagatcaaatagaaatagaaatcaaaatagacaaacaaaaaactagaaagaatctgagagcctatacttcaaggtgttttacctaagagatctgaggaaattacaaacatgatcaccagcactgaaatcttgaacttggatcaaagtaaccctacataaccacaaaatgacagggatataagtctcagagactttaaatgaatataacaggttcttgtagataactcatatacagagatccaaaaatgaaaaacttgttttacatcctattcacaatatgtgtagtacccttttcccaaatacttgactgataaaaatacatacagatttttaacttatccagtctattacagtttatttgccaactcttagttccctcttgtgctacgtttaaatttataagatgagtacagagactttttgaataactaatttaattaatgaattttaaagttaacttttgtagagttttagatacgtcctttggtcatacagtttagaaattacattgaaaagtaatctaatgcaaagttttttgtttttttttttaatttaaaaggtttgagtaaatctttctttctttttttttgaggtggagtctcattctgtcgccaggctgcagtgcagtggtgcgatctcggctcactgcaatctgtgcctcccggggtcaagcgactctcctgcctcagcctccagagtagctgggattacaggcacacgtcaccacacctggctaatttttgcatttttagtagagacggggtttcaccatgttggccagaatggtcttgatctcttgacctcatgatctgcccgcctcagcctcccgaagtgctgggattacaggcgtgagccactgcgcccagccgagtaaatctttctttaaaaattactgaagctgagtttaatatactgtatttatttgcatcaactcaaaattgaattttatgccacctttttggtcagttgtgaattgaaattttataactgaaattgtttacaagattatgttaaagtagggctgagagaatgaattttaaagtatgattcaaggttatagattaaattatgttcttatatattttagtcactttttgaactattacaaatatctagtaaattttttaatgctctgcccctttaattctggtcatgtaatttaggactgaaaggtgagctttatcttggaacaatattatctttcatttatatgatagcaaaaaaattaactatactgcctttattcaaaagtgcttaaaaacaactatatgtttactctctccacttcattattttcttcctcagtgcaaatatgtttatctggaaataatgtatgcattgtagcatgcagaatgtcaagctattttaagagatgcaacataatgcttgctataaactcttatattcagtcctcatttcataaaactctcatgtttaacttgaacatgctttcatgtaaaagctcaacttaaaagtgtgcctgtttggatgataagaaaaaaaagcaaacaaataaaataactacacctatcttgtactctttaaaatatatatgttggtttttaaaaataattgcactaagctaaacatgagaacctctatattagcaacttacattaaaagcaagtcttttttgggaaagcaaaataaaattaaaagacacatgattttagatcactgatctgagtacacagatctaatctctttgccagggttgtgtatactgtacacgacatttattttatttttttttttttgcactcacttattttgatccagtggatcttgacctattatcaagagtgagtgaatattgctagaagtggtcacttcagtatgacttaatctgaagacagagaaaaactggttataaaagaggaaatatattagaaaggagagtatttttgtatctagcaacctggaatatgaatgtaaaagagaataaacagttcaacacagaatgataaagggtgccattgagagggtcttctggagttggttttgcttcattcaactatgaaatgactacatgtattcatttatccctcccctccctcattttgagggtataataaatgtgtttctcctttttctcctctttcttcaactctatctccttgaaagagaataaacaactaaaaacaatgctgcacccccactcaccttgataagcagcatgagtctattaaattaagcatgcttgacactcaaacaccaattttagggacagagtgctcaaaatagaaagcacaatggtgacatcctgttaccgtctctttgtgcccttggactcataaataaagttctgcaggtttctgtgctcccttgatacaaaataaagaaaagtgaatgagttagaacaagctctggcagccatcagtaatgttgcaccccattgctgcaggacaggagacatccaattatggagcaaggtcagcctcagtctctaccagtattttctctggtggtcaagagaccctcaccccctcaccaccaccaccaccaccaccacgattcccttctacctgatggtgctccgggactttatttttggatccttcactgcttgacttaagaggaggaagacatgataggccagtcagtcttggctgggttgtgggaaaagtgagaggacagaaccagattggtcagtttgtgaatcttgtgatcagctacttttagaatttatttgttgttaagtttgaccaacaaatttccatatccttcatgttttctcacaaagatctttaaattgcctttcccagcttcccacctaaatacattcaaccatcataacacattccaaaatacagtggttgcccatggtttgcccaatactgggcaataggcactcagatcccagttagtgaccaatatacctatgggacacaaatcatatcaatgaggcacagctgcagggtgcatgtctactaaggatactgctcatctgaaccctcagactatacattctggtaccttagttctgtctcttggtgccctttcctgcgggtaacccacattcttattctctctccatgcggcatgggcactctctctcctgcctgagtcatagttcctggagcagactccacccccatgtttcagatcctgcctgagtccactgaatgaaagcaacaactcctgcgtgtcactcacaattccctggatgatactaaaaagcaatctttctctcattttcgaaacccctttgagatattaatgacttcctagatttttttcaggacttagagattatttcagaaataatcatataataagaagcattttgaattggagactcaaattgctctttagatcatactatataatcttaatgatgatgacgatgataatagtagctaccattgaacaaatgcctactatgctaggtgccttctatcttaaccatggttaattctcaggggcagtcctcaaaagttaggatattgttcctatttctcaggtgggggaaatgactttcagcaggagtaactatttttattcatcttatagctttaaattggcagctagattttgaccccatgtctgactcgaatttcattttatttccacaacaccattcactgcgtagagataagaactgtgagctggtctaataattttttcttcctgcaatagaagtccttttctaaaatttgggtcaactctcagcactcgtaaaaatatgcatataaaaagggaaagaaatggaggaaaatattttcccattaaatactaagacctactatacactaagctacagtatttaaagcacacaatactaggaccaattggatggattatgataaagagactagacactgacccatacataaaagaacttggaatattatagaggaaacacgaagaattaatgaaaaaaggaaaataaatgatgttgcattaattgaatttcaatatttgaaaaagtaaaatagctttccctcctgaaacaaacaaaaaattcagggagatattggatctcaatgaaaagaacatttaaatatattaaaaaacaaaactttaaatatattacaggaatatgaagataatacctttatgatatctgggtaacaaaaggcaaaccacgtaaattaagtaaagcaggattttttttaagtaactaaactggtacaatttataaagtacacatactcctttgaaaaagtaggtctcatgtgaatctgctcaaattccagggctgtattcactttcaccaaacactaatgacctgaggctattgtatttttctagttttcctgttaaaaagagacatgagagtgttgactctcaggtgtgagatcttgactgatcccacacctagcccaactggaggcttaaggctactcatcacagagtccttctggagccaagataaatgcctatgaatctcaacttttattcacagctttcaatattagattttttaatattagattttaatatttttcaatattagatttcatcatttcctgtgcccatttccctagctcaagggttcacttatctttgataagtttattggctagatgtatgtacgatgactcactctccatcacataaaacatacaattttgacagttgataaaaagatgttcgcataaactataatcatataattaaatatgtaccagaaacctaaaaaatagggaagagggaagctgatagtattttactcacatttaactaaaaagccatacattttaaatctatgaggtaagaagaaaaatcaggaaatctgcctgaacccattagtgactattcatgtaggatttttttttttaattttattttttttgagacaggctgtggcccaggctggagtgcagtggcacgatctcagctcactgcaacctctgcctcccgggttcaagcgattcttctgcctcagcctcctgagtagctgggattagaggcacctgccaccacacctggctaatttttgtatttttagtagagatggggtttcaccatgttggccaagctggtctcgaattcctgaccttgtgacccacccatctctgcctcccaaagtgctgggattacaggcgtgagccaccacgcctggcctcatgtagaattttatggtcacaagcctgtagttctagcagggaaactcaacacataaaaaggaggcctttaaatgcattgtcaagaatgacgaaaggagctaagtatcattatattctgatcaaaagaaaaggcaagtgtccatttccaatctctctttctctctctctctctctcacacacacaccccccagcagatttgtaaagaaaggtaaataaatcccccatacaaaaagtttccttttttccccacttgggtctgagagttgttcagtttaacctgagttgccattagtgtccttcgaagctataaattttgcttttccatgcaattgtttcaaaacaaagaaaatctgtgactttaaaattactttagagccaagcatggtggcgggtgcctggggtcacagctactttggacactgaggcaggagcattgttttgagcccaggagttctgcgtggtagtgcactgtgctgatagggtagtcgcactaagtttggcgtcaatatggttaattcctgggagcgggaatcatcagtttgcctaaggaggggtgaaccaagccaagtgagaaacggagcaggtcaaaatttccattctgatcggcagtgggttccacctgtgaatagccactgcactccagtctggataccatagcaagaccctgtctctttaaaaaaaaaaaaaaaaaaaaatggctttagaagcaattttacaccctaacttaccaatataggtagcggtccgactttatcgccacaggaggaaaaaataaaaagcagagtaaaacttacagagcaatggtagatacaatacgatcaatacaatcttcaaacccaacttcactgagcatgagtttctacacataaaagagattctttcattatttcttttttaattatttatttatttatttatttttgagacacagtctaactctgatgccctggctttgagtgcagtggcgtgaacacaactctctgcagccttaaccttctgggctcaagggattctcccacctcagcctcctgagtagctgggaccacagacaagcgccatcacacctggctaattttttaaattttatgtagagacaagatctccctgttgcccaggatggttggtctagaattcctgggctcaagcgatcctcccacctcgggcaccaaaagtgctggaattacaaggcataagccatcataaccggtccaagaaaatcttttagaaaaccccatcaaacaaatcaccatactatttaactgtaagtccaaacaatagtttcaatcgtaatatttgaagcaactagtataaaaagagaaactcataagctagcttacatttctgttgtcaaagagtaatttatccttgctggagttggtttggaggtattaatagccggaattatcccaacaatattctggcaagaaactatacacgtactttctgatgtgctctgatgtggccacagtctggcgctgagagtagctccaacatgagggactgaagcaaaagggtttcccaaagaagcactgtgccccggagactggaaggagaatttgaggaagacattaggatgaggcatctcaggggtgtaagagagagaccctggaaggcatttggggccatgacttaattataagctaggaattgcgtgtgtagaatttacaaagtaaacaaaatggcagccgagggtggggatagttcacacccttagtaaaggctcgacattatagaatctgcctcatactaggattcccagtagcttttctggaaataggtctccttcctctcctgccagccctaaaataatattggtaacacacacaccaacttctagagagcactcacaaaaaaagttgtcaccgccaagtgacctcactgcttctccctggagagctttgcagacagaaaatagctctgtgtctttataaacaaatcactctgtgaatggcagtgggtacacaaacatgtcgattctcttccagagttcttactcgctcaattgccaggtttgcttctattttggttacagaattaaaatgtaattagttgtgtttttaatgagtccaaatgtgacacattaagattcagtaattactctaaaatgataagctgtgattgaatgtccccataaacaagggacatttaaaggcagtaccatttcttgctcagttgttactgcttttaaaaccgtcactctttcctgggtgaatacagttttaggatttaaatgattacgctggattattgcacatatttacagtcagagccagctataccgacatatttaaagtgtgtacgttctttgatcatgtggccatgtctacctaagaacctaataactgactttactgaatgttggctgtccaggttagtacctcattatgacttactggcttttaagacacgtttattttatgtggcatcagtttttctcttcaacctgatgcaagacctcactgctatttctgaggttctttatgtccttagtgtttggcagggctcacatcaggtctagaaaagtggtgctagaggttcaagatccaatacaacaatggcagcagtaattgatgcacttgccccatacggaaatctgatctcttaacccacctgtttcctaggctaactgaatcagcagcatgtcagtagctgccaatgctgatcaatttcctagtgacattggtaacttaaaaaacattgaaatagttaagttcgttgtagaagtaagcctttcatcctacagcaaatcaaaaacaaacaaaatggataaatgttttctgataacttttaaaacagtttacctaagaggaggaattgtaaaaacttaaacataaattgagatcatcccacctgattttttaatattcgtaggaagcctgttcatgatattccagtcaactactctagaatcctattttggtatctcagtatctcgtgcagcagtgaatagcactgctcaatattttagaggcttcatatttccttagagtcacaattgtcaccctaaaatttagatctaataatcctactactgtcctgtgtaggaaaaaatacagaaagcatatacttcttatttcccagccttcaagtatgtgaagactgctatcaagaccactgtgtcttactggccaggcgcagtggctcacgcccgtaatcccagcactttgggaggccgaggtgggcggatcacgaggtcaggagatcgagaccatcctggctaacacggtgaaaccccatttctactaaaaataaaaaaacttatctgggtgtggtggcgggtgcctgtagtcccagctactcgggaggctgaggcaggagaatggcatgaacccgggaggcggagcttgcagtgagctgagatcaggccactgcacaccagcctgggcgacaaagcgagactccatctcaaaaaaaaaaaaatccccgcttccaacagcagttctcctggaaccctaccttcccctgaattttgtcatatttatcaatgcctttcttatggcaaccagaagtatatagagcagttcagttcacaaagggctgtaaatacagtaggacaatacctatctcactttactttggacaaccagatgcttcaaaacttgctgatggtagattaacttttcatgtaactttatttattttactgttggcacacacggcatttttgtgtaaagttttctaatgatttttacatgaaatgatgtccagttataaatctctattctataccttgaatttaaaccaacaatttttttcacttaatcctattgtattatgtggtgttgtttttattattctaatctatttaaagcatattaatctcactctgaaagctgtataaaaacctctaaatctgggccgggcgaagtcgctcacgcttgtaaatcccagtactttgggaagctgaggtgggcagatcactagaggccaggagttcaagaccagcctggccaacatggtgaagccccgtctctactaaaaatagaaacattatctgggcgtggtggcacaggcttgtaatcccaactacttgggaggctgagccaggagaatcgcccaggagacagaggttgcagtgagctgagataatgtcactcactgcactccagcctgagcaacaaagtgagaccccgtctcaaaaaaaaaaaaaaaaaaaaaaaaaaaaaaaagcctctaagtttggttcatctgaaaatttcatgagtctgcttactcttacaagtccttgctcataatattgaacaaaaatcaccaagaatagacatgtgacacatacaccaacagaagtctctccccagcagttcaataagtggaaggtactctagctagcatctccatcgttcaactgtaccccagtatatcaacaaacacattatgagtggttcaaatgaatgcttttctgaaatgatgccatcctcaatggggaagtttcccagtctatcaatctccatgcagcataatttgtagaagtcctacctttcatttctagatgctaatcgatcttctattcaatggaagatctagcctactggtgtctcattttttattcttcctacaatttagaaaatcagatcagcataagaactttatttttaacaaatattaatataaaagtattacgtgtttttctactgcccatatctgttctgtccaagccatgtacattcatgttaaataaataccgtcttttaaaacataaatagcatggttactccacattgactcctgatgtcccaagatgttcaagatgcagtaaggagaaatattattttaaaacaattcaaagggagtgaaaatggtagcacacaaaggaggcagcatttcctgcttctcacaagaccatctgcctgtattgtgggcaagattttttaaaaatcctaactgaaaagaaaataatgttaagagacatatgcccatgtttacaagctgagggaaattgacaagtgtgtctgtttcgccagtatttttacagtcaactgttatacataatggggaaaattaaaatcggtaattacttttctagtctgccattgttttaaatgtgcttggaattttccttaagcatccattccaagtaattatttgtaataggccagaacacttaaagggttgtagggatggatacacagctattttacaaagtgaaatactttgacaataacaaattatttttcctcctttctctccccaatgttggctgagttatgtttatacctcactttgtagataatccttctagctacactttttttaggcacagccattataaaaatcttctgtttgggcttggcactgcttagaactagaaattgctatttgctgcctgccaattacagaataatttaaggtttgatgctcccaggcacagtttcttgaaatacacagaaaaaaatatattaaggtggatgcataatattttttctgcattgcatagcttcaattgcctgtatagaattatatccaaattgctaaacaaatcaattggagaaaaattatgtcttctaggaaagtgttttgtaatggttttactactctttcttttgataagatcatagcaaatattttacaaaaattttatattatttgcaactgaatgatttcaatctatgaaatgtgatgggtataaatattgatataattttaacataaaatttaaacttctaggaaataatagaggaagatgtgatttttttaaaatcaatttggaataattaagaagaaaagaaaaaagagagttaattaagtttcccggatcttttcaagtctaaaatgcaataatttttcatctttgtatattcgtatctgaattatccatcatttgcagtacgaagcaggaaagcggtaaagcaaagtaaatttgtgatttaaaaggatcaagtatatggttgaagactcaaaaagctttttatttgggacagtagaaggaaatgtgctgattatcatgagaacaacaaaaaagagaaatgagttatttatgtaaccctgtcatcatgcctacaacacctcgaagggcagtcaggcatagtctgttatcaggaaaagcaagcaaacaaaagcctttatatatatatatatataactaatcacaaacatgctcagactccagaagatggtaaaataaaataaaataaaataattttattgacttctttcacctaggtgccttggttgcactccctggaaaccattcttcgcattccccacttacttctcttttcttttctttttttttctttttcttttttttttttttttgagacagagtcttactctgtcgccccaggctggagtgcggtggtgccatctcggctcatggcaacctccgcctcccaggttcaagctattctcctgcctcagcctcctaagtagctgggattacagatgcgcgccaccatgctcggctgatttttgtatttttagtagagatggggtttcaccatgttggtcaggctggtctccccacttttcttaattcacccctgaaatacactacccaaacacgtagcaactgaggtctggaaacttcattcttgacttcttctaaggaaggccactttcttcaaaatacagcaagacaaacacatctagctcctagcatgacttcagtgtgaaaaggctgggcttgggagagcagcaggtagacatgcctattaacattgtgctgccatgtttactttttttttgtttacttaaatcatggacagaaagccaagtgtataagtgaaaacccaagggacaatgacatggggtagactgcagaccaagaataagcaggaagttaaataccaagatattcccccaaaataaaccagatagcttggtttatatggaagaaaataaaccagagtaccactaacataagcatgacagaaggttttacacaaaactttagcagaagtgggtccaaatttcagctagtttcaggaatagttggtcgaggatggttctccaaagagggtggaattgtgctgttgatcagctgccctcacatgagcgatttgcattttcttggcgagaaatagtcgctgaagtcaagcagaagagtacgtgagaaggaatagctgtgagaccaggacaagccaaggccacagtgggatattctcagtccgtctgggtctctagatttacaaagaagcatgttgaatctgtagaggcaaatgggaagctcccccttcaccctctaaaggttagctgaaaatgagtaaatgacaagagggggattaataggaggaaaggacatagagaaggtaattaacatgcttagggacaggggaatcacaggaggagaatgacccaataatccagtgaggtcctgacacttatttgtatacccttcttcacagggacagggttgatgaggagtgtagggataaatgacttacaggggaaatgaataagcccaaagcacggtggtctgggacaaagttcctctgagctctaggacaggtggagggaaggtgagtggttgagcttcactgtaatcaaaggttatcttattatgcagataaagcctcccaggtaatctcttggagctgtcttgagaagaatagatgaaaagtctttctgggtgcagtggagactcccagtgtctcctcttctccagtggttaatctttcctggttgtttgatgagattcctagggaggaggtcttaagacaattgcatttccttttaaagggttttcctagtcagataaggaaattccggttctggtacagtggctcacacctgtaatcccagcactttgggaggctgaggcgggaggattgcttgagcccaggagttcaagaccaccctggccaacatagggagaccctgtctctacaaaaaaaaaaaaaaaaaaaaaaaattagttgggcattgtagtgcatgcctgtggtcccaggttctcaggaggctgaggtgggaagaattgcttaagccagggaggtagagaggctgcagtgagctatgatcgctcaactgcactccagcctgggtgacagagaaagaccctgtctctaaaaaaacaaaaaataaaattccagcaagagtagctcccaatgcttcaggaaagaaaagagatcagagtggggcttgggagggaacactggagagaccttggttctgaggcttatttctgatgcctttaatttcctttaattcaaagcatgccaaagagccatatttttggaggagtattttctgagccccaagaactcctcacaatgcaaaatggatgcctggctttcatttttttaaaatgatttatttaccttaaaaataaacttggattcatttgatcttcataatccctgtagataatttaggcttccaaaggaaacatggtctctattggcctaattaccaataaccaagttaaattccatttctgtacagaatttttttaaaatttacctcacaatctagaaagaggagaaaaaaataccttaaaaattaattattttcaaagccatgtatatgcagatttggtcatggcttattcagaacacattagaattattttaaattctaagtatcctcaatggtgaacttaaaatttcattctagggggaggggggcatggttaatgagtagaaaaaaatagaaagaatgaataagacctactatttgatagcacaacagagtgactatagtcaataatgactgaattgtacattttaagataactgaaagagtgtgattggattgtttgtaacacaaaggataaatacttgaggggatggattccccattctccatgatgtgcttatttcacattgcatgcctgcatcaaaacatctcatgtacccccataagtatatatacctattgtatacccagaaaattattttaataaaataaaaataaaataaatgaaataaaattttattctagccattccaggaaaaaaaaaaagccccattttgcaaagatgattataaccatatatatcatatgattatcaccttgttttcatacacacaagcatatatgtatgtatatatacatatatatttacacacacacacacatatacacacacacacatatatatatgtgtgtgtgtgtatatatatacagttgacccttggacaatgcaggggttagggctatgtcctgcacagtcaaaaatctgcatataacattggactccccaaaattttaaccactaatagcctaccgttgactggaaaccttacccataacataaacaatcgactaccacatattttgtatgttatgtatattatatattgtaatcttacagtaagctacacaaaagaaaatgttattaagaaaatcataatggccaagcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaagaggcggaggttgcagtgagccgagaagaaccattgcactccagcctgggcaataagagcgaaactccgtctaaaaaaaaagaaaagaaaaaagaaagaaaatcataatgaaaagaaaaatatatttactagtcattaagtagaaatggatcatcatgaaagtcttcatccttcctgtcttcacaatgagtaggctgaggaagaagagacgaggttggtcttgctgtcccaggggtgaaagaggcagaagaaaatccatgtataagtggactcacacagttcaaacctgtgttgttcaaggatcaactgtgtgtatatatatatatatatattttttttttttaggtttattgcaggaacaaaatcctctctccaaagctataatcctgactggctcaagatgtcttaagaaacttagaaacacagctaggaataaattacagcccaggctagttggttgttctcccggaatgagcgaattcaaaaggaacctggttatttagcaagaaatagactcagtgacctcagcagcattctaatgcatggaaaggtcagagaggtttcgtaccactctgctgggtcagatggaagccagagaagctgttggggtctccttgaaggttgaccctgggctgcaggtcaggaaacccaagtaggattccaggaatggattgctaagaagcttcgaggagaatggcttccacccatgactgagaattgaattgaggtccaggtagaatgggtagtacctggtcacagcccataagaaataagaagaggctatgatttgaattggtattaataacaaagaagaaaagcagcatttacttcgggcacaaggccagccagcctgctctcagaagctaaatgcaagtgacattttcttgtcaaatcccaacttttacccatcaaaggcttggggagaaagggaatccattgcaatgagttggttctgtagatagccctgcagaatcctggggggtgtttcacacgccagagaccaggatgggttgcggaaagcagttaactaccaagtatagtaagggaggcacagtaactcacctggaattgactttgcaagctgaagactgttttcaactgtgactgtgccattaggattaatgcaattcatacagttggctagcacatcagataaatatgatgaattgtccttatatccttagtccagtgagaactggcttttccatcacagcttaagctatacacatagagaggcaaaaaaaaaaaaaaaaaaaaaaaaaaaaagaccttacagttttgtttattgtgcttatcacaagtgctggaaactcacattttcattgctaatagccctctttgaaagtttgttgacatttcagctgatctttaatgtgctctactgttataatacccttgggcaaagtcagtttccaataggaaaatagacagcttctgggtacccctgtggaagctgcacaaacacaaacagactggcaccccagcctgcaatacctggtgagctctgctctgtccgaatcacagaagggtggcagaatatataacctcaaagcatgccactttggcataaggattatgttgaagtaaaggctcttgaaaaatagcagatacaagaagagcactttgaccttcctttttcttcctaaaagcaggagataaatctccaggggaaagttgttgtccctgtattgggaggaagaaacattcttatcaccagagatagggagtgaaggtcaagagaaatccgtaccaaaaaactttgttaaattaaccttatctgtctcttcacttttctacaattaactgctctggcccaagcctctttgtcttgccatgttttcacaaggtgctcctcttcatccaacttaggatataagcatctgactctaactgcttctttgggtcttcattttcctatgtgaattcccatgtccatttaaaatctgtatactcctatcttggtaattatctgatagcgatttaattctcaggcccagccgaggactctcagagggcagagagaaagttgtgccttccaggatcactgtatttgggagcctggaagacgaagaatggagcccagtaaatagagagggaaggaaagacatttaaacaggttcctaaagagaatgtgaggacacgtaagaacaacagtaagaaaaagtacagaaagaaaaatttacaatctattctacagagcaaattgaggtatttcttctgtaatagggaaagaggaaagagaagattcatgactgaccatcagtaggctttatagtggagagagaattgtccaaacctccgtataatcaagcacatatcctgattcttagaatatatgttccaaactaaattaagaaagggtgatgctggacagaagcagttattaattctggggtcaacaggataaaaatagtcagaaatgaacgttgtggtttgggaatataagcagctgaattcaaaataagaattctaatagaaagtgttaaatcaaagagcagttcataaagtcagagctagaccttgggtggggggaagagcaattcaaaaatttagagcagcatgtatcttaaaaataaattttattgaaaaatgagaacacatggacacagggaggggaacaacatacaaggggggcctgtccgggggtagagggcaaagagaggaagagcattaggacaaatacctaatgcatgcggggcttaaaacctagatgatgggttgataggtgcagcaaaccaccatggcacatgtatagctatataacaaacctgcacattctgcacatgtatcccggaacttaaagtaaaattaattaaataaaaaaaaatgaaaatgaaaataaatgttgttatgagaactcatagtggcatggccccaattttagaaactgagcttaatacagttaataggtaaatgttagatgaatacctcaaactgaatgttaatgccaaaattaagatcattctttggttcaaaatatagagcatgtttatatcttaattaaaagcagtcatacttaaatctctccttttcggccaggcacggtggcccacacctgtaatcccagcactttgggaggctgaggcgggtggatcacctgaggttgggagtttgagaccagcctgaacaacacggagaaaccccatctctactaaaaatacaaaattagctgggtgtggtggtggatgcctgtaatcccagctactcaggaggctgaggcaggagaatcgcttgaacccaggaggcagaggttgtagtgagccaaggccacgccattgcactccaggcagggcgagaagagtgaaactctgtctcaaataataataacaataataaaataaatctctccttttcattatttatagaaaatcatagtattttggcacattaaattgaacatatttctttaagtaattaaatgtacgcctatcataatgtattcctcctggtacttaactatcatagattattagcagtttagtgtttaaagggaactcaggactgagagttttaaaaacttagactcacagtaagaaagtcatctcatgttgatgaagtataaatatgcacatacacacacagacacgtcacatgcaggtacataactaaaatgaaagcttcctgaaataatacttatttacactttgtacagaatcgaatgcactttatttcctagtctttgcattttaaaaatatacttattttttttaatgctgctcctggttccccaaattgaaattactatctaccaatgtatctcaatttacagtttggaaaacactgccttagggaatagctagtctaattttgcacctgagaaacgtagagatttagggaatattcccaaggtcacgtagtatgtggcaaagcaagcctgtgctgtcttctaagttctggcgtaatgagttttccccaatcttacattgttacattgttttcaagatgaatggtcatgtatagtgtactctttgcctctcaaatttgatgaagtaagcattattccgttgctacgtgtcttgctcactttgcgttttcttagtttcataggaagcatcagttgtgctaagttttatttgtgtgttccattgtctcttccccctaaactgaaagcttcctgagaatagtgtgtattcttatcaatatcccctaaaccaagctgagtagtgtgaatgattgaatccttagaaagacaagctcatgtagtcaaatagtctaaattacatgagtgggacaaaaatatcagcatccaggtagccacagatgctcttctttccttctaagaaatacgattctcattccatacctagatgatgggttgataaggtgcagcagaccaccatggcacacgttcacctatgtcacaaacctgcatgtcctgcacatgtatcctgaaactttaaattttaaaaaaggaaatatcaattctattggttatgctgattagagtaataagtggagagggaattgagaagttctaagacaagctgtgttagtatcctagggctgcagcaacaaagtaccataaacagagtagcctaaagcaacaaaaatttactctctcaaggttctagaggccagaagcctgaaatcaaggtatcagcagggccatgatctctctcgtagcttctggtggttgccggaaacccttggtgttcttggcttgtagacacatcgctccaacctcagcctctcttgtcacgtggcattctctctgtgttttctgtgtccaaatttcccccttcctattaggacactagccattggattagggcccatcttaatcaagtatgacttgattacatctgcaaaggtcatatcgagaagtaccaggggttagaacttgaaaatatctttttggaagacacagttctacccaccacagaagctacaccaatttacatgaaaaagaacctaagtagatctagaagagttggagagagaaatgggatagaagggagatgagcaggaagacatgaaagcaaacaaatgagttatcttcaggggagaaaagtgcttgtccagtgtactatggagagacgcataaatgaagatgactttaatacattctgctttgcatcatgcaacataactttttttcttttggtgcctctcacagagacctctgtaaatcctaaattatcttttaagactttgttcaagtcagattttttagagttatttcagatgttatgttattgcaggaagcagctcacaagtgacctagcattaaagataataaaagctaatgtttttatgtgagtagaagatatagcattgcatttaaactatagtttcaccattatacagaaggaaaagaagacagcaagcagaagagacaataatgatatattgaccttactgaaagatgatgacataaagcagtaggatttatcattttttgtaagttactgaacattgattcagtgttatgcatcttgttcttctatatattaagcaattatgtttatttctagcactgaaaagcatagttattttcagccaataattgctatttgaatgctatagttaatgtttttataatttttagatgacaattttattttaattaactctcttagaaacaatcatttatttatttgctcagcaatatgtgttcagtatccaaagtgtgttagacacaattcagtatatccgtcccctatatcgagagtctagttagagtgagttaacaaaagcttttattcatgggaatttatagtataaaagtgtacaatagtataaaaaggctgaaagatttctatagtgatttcactatgaagagatctctctgatatttttcttccctttcaccttatccagtctccaacgtttctgtaaaaaacagctacacccacttttttcttcctgtcaggtgaatccagatagtgcagcaaagttgagccaccgacactgaatttcccaccacaagtgaaacagcagaaaaggctttccaagttcactgtagggaaaataaaagccatgtgatatttattgcacatccaagtatatggattaagattaattcctctggagcaataatgatcacactttttaaatcttacaactcgttgatagtcatcaaaattgaagatccaaaaagcttttatttttatgagttttacatatcagaatttcatgtattagaaattaaaactgacaaactttaaatatttattttaagacaaatgatatactttaaatattaatttaagacaacattaaaaaccctctacttattagcataacatgcttttattttttaaaaaaactacattattccaaaacaaaaaaagattaatgagaagagtagtgttgttccattacacacccatgagtgaatgagagtgaaaaaggaaattgatgtcttaatattattatgaaaattatttggtccaatagttaatggatcccctgaaaggtattcagaacccccagttgtctcctggccacatttagagaatttcagccctagaatgttctgatatgtagtggaggaaattgattctatagtacagaatcagagggcaactcactggcctgctccccacctcagctatcatatgatgcacagtccctgaccaagtggatcggaaatgtctcctgttgtaggtcaaggtatccctgagaaccacaaactgagatatggacaaaagagcaaaagcgccgtgcacatatcttgagatgcaggttaaagaacaaaacaagaatgcatgtattttatctcaggacactaagtctccaaagaatggcttgtgatgggggtacagacttgacccaagaattactgactataatcaaaccacagtttaacagaggtgctatttatagtgaaaaattttcccccaagcaagaattccatagtaaagtaagatcacagttgcacactgcaaatctttaaaagaaaattccagaatttatagcttacttagcctacttagctacttgctttgctcatatataccagttctttcaactaccacaaaaataataactatttgaatatactcaataaacaggcattgtgaaatttgaattttacaacatagaatttggttactgttcctgttaaaacacaaaatacatgagtgaatatttatgtgtatatttttcaataatgttttccaaatgacctttggagaatatctcaagatgattatttctttggcagggggcaaaaaaaaaaaaaagctatcagtgagataagcacatcaatcgaactgttttcatttgagccatgtttaaatgagctaggatgcaaaatagaaattctggaaatatccaaaagaaagatgtacatgtcctctgatttctcctaagtctggacagaattggcagcagaggctctaatgaaatcttgcaattagtctgagaagcccattcagagagcttcactgtgttcagccttctgccgctgacacccttgcctgaagacacatgcccatatcgaagcacatgcagatgcctttcctcatacctagaccctgaaatgaccatggaccgcaggattctcatgtgagatttcagtttactgcttaatttttcatcttgattggacttttcatccatcatatcaggaaaagctgaatatacagacccagacatagataggtttggggacaggaagaagatttaattctacttagattgatcccattttttcttttcttttctagaaatgagtgagatcatttgctgatcctgaggtgtggagggaaaaagtcttggctagaggtgtaagagaatgtgtggaagatggaattgactaaagaaagtgatagggttgtcctgcaggtctgaggacccaggtgatattcatggtctccatgtaacgcataactggtcagcaccttttgtttgcttgtttttctccaagttttactgcttagatgcggtaaaataacatctggcattcccagagttggttttccaagtaatgtcacttactgaggcaggaaggagaaaaggtgtttgaggtttgaagagacaggggaaaaagtctgttaagagaaaaggagtgaaagtgaccagaaataagttagtaggattgacaggaactaaatgggttagcatgggttagcagagaatgagatgtaaactctgttggggttttgctgacaaatacgatggagagagctgaagttgtttgtttgtttgtttgtttctcaaagatgtgataattacagtgaaccttggaatctaaactaatgaagaaaaggagtgaggacaagagagtgaaaaagtgatagtcaatgaattgaaggtcccaggagaagaaatactgtatttgagaaccagagtaaatgaaatggaaaattaaaggcagtggtcagaagtcagcataactagaataaaagtttgaaaagataatgactaagtcaagggtatcaccaggggagtaggtggctgaagtgcaatcggatgaaaaaacagtgggaaacgagatgctcaaagaaatgggaggttcgtaggtcactgtggtccagaattgcaatgattatgtattcagttccggttaaccaagaaattaagcattttgcaattctaaaatcatcagttgatatactaaaattaaagtctaaaatgccatgaacattatgttagatacatatatattaaatggaaatcaaattgtatacgtaaaaaaagatataaagaagaaatatagggctagacatagtgtcttatgcctataatctcagcactttgggaagccgaggtgggaggattgcttgaactcaggagttggagaccagtctggacaacatgaggagactctgtctctaaaagaaaattaaaaattagccaggtgtggtgtcatgcacctgtggtcccagctgcttggaaggctgagatggaaggattgcttgagccttggaggttgaggctgcagtgacagatgtttgcaccactgtactttagcctaagtgatagagtgagactgtctcaaataaataaaccaataggacatattaataaatactgtgatcttaagcaaagacgctttaactttctagagcttagttttctcatctgtatcacgagtaatttgaattaaattatctagaagttaattctttgcctgaaatggtttgtttcctttatccaatattactcattgattataatgatcaccaaaaaatgaatacttacgtgaatactagagaaaaaatattgcttaattttgaaaatacaaattgcttatttgtagaagctattttggttttatttgtatgtttatttaaagtttgcgagggaaccagggttatcaggatcactctgatctgaaatctgagatttgggtaatctcacttctatccaaaaatctctaggacatcaagctcatcaaggtcttcagatgctcatgatgcattaattgccctttgagaataactgcctaagagatggatgtttatattgattttatggtagatattttcttcttcatgggagtggaattccttttacaggttgattcacaaacctagagccaaaaatataactgaactattacagatttaaagtatagattgcataattttgtaaaaatattatcatacaaattctaacatatcgtgagctgaattatactaccacaactaaaactcaattacttataggagtcagacgtatattctaataagacagacactgaaattgctatttttgtctgctggccaaattaactcccaactcatcagtttgcctcccattccctaaagccttgtgcatatgaattacctggcactattgctaaatacagatttttttgcagtaagtgtagggtggaatctgtaattccacatttctaacaaggtcccaggtgtgtcagtgcaacacatctaaggaccacactgaacataactctatacaaaaaggctccactttttattaaactgtgattctgaaaacccaagtagaaatcaggtttttaaaaacttatcattcctttctttggctgttgagacttgtatttctccatgccatatcagacaaattgcatttacctggttccctctgaattagcaatcttaggaacttcagctactctcagattctattccgttatttcagagttcccagtggttggctcaagtgtgagtgcacattcaggttttccagttgcctcatagcgtctttccatgaccttctcccttattccagctcctgcttgggtgtctctggcaccttcttaggacagatgtgggttgtccaatgctcaggacactgaatccagctcaagtacccaccatgagtttgatgcaaggcaagcgagccccaaagtggggcttagcccatgagggttcttggcttctcccaggaaagaatttaagggcaagccaatggtagggtagaagaaaacagctcttatggaagtggccgtgttacagttctgtgattgctcccacagagcagggctaccccacaggcagtgtgctgagagtagcaactcggggcagttctgcagtcatgtttataccgaccttgaattacatgtagattaaggagcagcttatgcagacatttctagaaaaggggtagtaactttggggtcatcaggtcattgccatgggaaggggtggtaacccccaggtgttgccatggcgatggtaaactgacagggcatgctggtgggtgtgtcttatggaaagctactcctgccccagtcctgttttagctagtcctcaacttggttcaggatctgagccccacctctggagtcgagtcccagttggtacctcaacttcaagtgaagaaagtcacttaattcagttttttgttgcccccttaccaataacttgaaaccatttgagtggcctctcatcctattcaaaactactcctttcccttaagcctaaaacattatccttggaataagcctcagcacctcgactctctccttcctttaggctcagagaactgatgactacttcatgccaatacatccttggcaagccacctagtaggctgccattcccacagcaagcccagcagaaccatcagagtcatggagtggttatagtttaggctcttaagttggaattcccaaggacactataacatagtgttcctgcatgggtgagggaaaaataataactggtttttatggagggctaggagaggtagatgaattacctggtgcaaagccggagtcagcatctgtaactgatgagtgagcaggacaagttagagttctatgaggaagctttatgccgtcactggcaaaatttgaggcagcaaaatgcaaaggaactcaataaatggtgagatgattaaccaatgaggtggtactgactccagcagtggtgttattgaaagttcaggtatattcaattataacacattttaaatcttggattgcctgaaatcagcctgccaaatatgagaataatccaggcagacaaggacaaagaacattacacaataatgatactaataggcagtgtcctgtacattgtaattgtacaatagtgacagtaataggcagtgttttccagcatcaactggagtatcatttcctatcccaagtaagttaaacacaggatgagctcaacatcctaaggtccagaggagagtggacggtagtgagttatgctgtctccctgtggtgcccagggactctctctctgtcaaagatgctgtatctaattacctaggctctttctttctcctttcctcctcctttcctccctctctccctccttctctctctctgtctctctctttctttctttatgccctagaaataagtctttttcttctttcccagaaatcatggtgataagtagaagcctgcatgcaggaaattattgaatataacaaaaaaacatagttggtgaagttaactcaagacaaaaattatatacaaagaggtaattgcatatagattagagaagtccagtgtattccctttttgtaaaacgccttctgaatcgagtatcttttgattccatacaattctgtctcccctcacatctgacctattcatgtcagagatctcctacctggctcctttttcatctagtaattaatttatatccctgtcctaacttctatctcctgctcccctcaacattatatctctttttataactaggatatactcaaatgaaaaaatccatgtatcttactatcttctgccttcttctaaatagttgtgcttccttttgatctatttatttgctacaccaggaatatttgacatttcctggagaagtaggaatctcttgtatgctcatttgaaatgagctagtgtggttatttaacaaatatgcagagcaacaatgcacaagatgatcaaaagatatacgtggagaaggaagttctctatttcacaccactgagttacattttaagcatggggcttgtgaactaataccactgttcaccttctcaaaagggcatggtatttaggaatggcattattacagttttctacagttttccaatagaagacattaaataaatgagagaacatttctattgggcaatattaaaacctttacttccacatccactgctttcgccagcttgaacagattagttattcccagtagattattctcattggtaattctgtaataaaagattctagatattgtgcattttcatcactggcattacaatttttatttcagaatcttggtcatcgaatattcattatctaattataataaaaatgcatgattcccttaggaatgcctataactaaatgaatatgaactttattaaaggaattaaattaggagattaaaattattcaaagggggtaacaactttattcttaaagaactgtaggattgcaatactaggaaagaaagagaataggaaaggcaacagaaaagtagtaaaaagaaacagaaacaaaacagatagatccctgatgtgctatgatggggaatagagtattaatttaattattcagttataaataaactaaagcctaagcctagtaaattatgtgctccttgaagattagagttaggactgattaatctttgcattccccaccagaccaggcagtgcctggaatgtagtggacactcaataaatttttgttgaattaataaggaagcaaattctatatgaaaatgataacaagtttatgagtactttttcaagtcagtttgcagatacaagtttaaggaaattcatactcggatatagttagaatgtgtatactgaattagaatgttagtctatgtgctttgggaattaattttgaagctcaggaagctatgcaagaggcagccaagctcagaggaagggtgagagacttgatcagctgcccctccctgtcttgaactatttcctgttatagatggaaatcatccttcattacctgggaaaaagtatgagcccaaagcagaattagccttctttatacatgtgttgaatttgtgttcccatcatattaagtattaaaggaaatgattatgagctgtttgttggacagtaaagggaagtgataatgataattttaatatagttaacattagcttgaaacacatgaaactgatatttttgtgtgtaaacacctaagtgaatattgacaatttcacatggtttaatttaatattgatcaaatgctacgtggtaggcactgtgctaagtaatgtatagtccattaatttgtttaaatttcatccaaaaagctttgtaatagatgaggaaattaacaataagttagggaacttgcccaacatacaaagaggacatagaaggtaaacagtttaacatcagagtcccttttcttaaacagaatactatcctgccagggaaaatatggatgtcataaattatgttatcaaaatcttgccttccaatcacttatttatgtcaacaaaaatgtgacaataagatataccatggttaattcacagtgcgaagtgtctgcttctagaaaggtgaaatttgcttataatacagttattattataccactgcaatatcgaggtcaagttctatggctacaaaatgacataatctttactcaagaaggtcacattgcagtaaagaggacataattataaagagtattacatcactagagttagatttttttttgttggtcaaatgactcaatccaaaaagtaggatacatagtaagaatgtgctatagagacaaagagataaatatctgaaaccaaggccccagaaaattaacaatctatgtcaaccataactgtattatccatgtgagtcaatttctatgggaaatacagttctgttatctatggataatacagttcttcctagaggaagaagcaattaattgatcttggaggggtcagggagagtttcatagaagatataacaactttacaaggcttgagggatgagtgggattgcattaggcagagaaaagaagaaagacatcctagaaaagggcgcaacatgtacaaacagaggaatgtgtgacagtaaacagtcacgttgaggaacagtaaatggtttatgtggctaggaggcaagtttgataccacattatattctgtattcctaaaacacccagacacgcgaaatgctgaaacagtaacttggactcttttgtgaagatcccaggactggaaatttctactgtgtcctagaaagcaatgataagccaacgatgctgtttccttctcgagctataactttcatagagggaagtgcacacatcttaaatggacagcttaggcattgttacatattagtatacccatgaaattatcacccagatcccttgcttggaagaccaaatgtcttttttcccccctcagaaatttattaccatttttcagaattaatattttctaaaacccaatataaaacattatatataaccattatggactgaactgtgtcctctgaaaaactcatctattaagccctaactcccaacatgattgtatttggagacagggtcattaaggaaattatttaggtaaaatgaggccacaagaatggggccttaatgcgatgggggtggtgcccttataagtagaggaagaaacacaggagaggttcctttctccactttagttcatggaaaggccatatgaggacacggtgggaaggtggccctccacaagccaaggagagaggcatcaccagaaaccaactctaccaacatgttgatcttggacttcaagctttcaaaactaccagaatataaatgtcgtctaagccacccgatccatggtgtctcaatacggcagcctgagcagactaatccaacagtctcgaagaattaaatttagaattggtcatcaagattttgttcacctcaaggaaataaaatgactcaatcctccacggatttgtttccatcattttcctttcctattttcagattatttgcaacctggagactgccctgcaaaagcacgtggcaatttccccttctggatcctcacaggagaaaaataaattcacattaacaaatattcagatgctttatttattctgaaaaaaataaaaaagtgaaattgctaaattgctaaattgagtttttcactggtcaaaatttacatagcccaataggtgtaggctccttactccttttgaggcattttctctctcttgattaacagtgatggatttttattgccccacttctgagaggaggatttatatgtcttttaatctgtgtaagttggactgaatcataaatggttcaccctctaaattacagagtaagtttgccaatagagatgaccttgtttattaaaatctaattaactgaagttttagaatgtccctgagtgggttgctgaatttctgattttctccaaaccaatatagatcaaatatccagctggctggagttaaccacaaagctctgaacctcactgtgaaattatctagttaattcctctttcagacattttttccaaaggtacaagcccaagaatcctttaatatgttggccatcctatttcagaaaagccatgtgcccaattatgagttggagaaagaagcccaggtgctccttgttcactgcaactgaaatgagaggaccctggagtgtaactttcattccccagcaatggtcagtcagaatgtctctgatcatgtgccacttttcatcttctggacaaagttctatgctgcctatacacataaggcagtaatattcatgactttttactgccaaccttggaaagcaatgttggcaaattgattacagacatatgggataaaacataattaattgattcagttcctagtctatatacaaaattgcttaatgctaaaactcctctagtttctgccctattgcttcttccatttctcattccaactttaagagtttaaggtttgtctcttctctctcatctcccatttaattatcagctattgaactttttcttcatgacattactagatccctttgtgtcccgtccaccgatgatctccatattgatatagctgatgtacatgctttaattttttgataacggacatttttgcaatatttaacataatataccacctcactcccaccccaccctccagaagctctctgttcccttggcttatagtacatataattcttttggttccttcagaattttagatcctgtattttcaacttctttggttcattcttcttctttcatgctgacactgacagtgctctcaaggctctttccatggctgcattctgacttgcatttagtcccagtcactgagagatattttgaagttctgtttttatttgggccacctcaccctgaagagtaagtacttttcattgttgtagctgaggtggtgtgcctttttcaaacgtctacgtcccacagcatcttcgagatattgataacataaaaacaaatatcgatcatcctaagggccttacagacttcagagatgggtaaaagaaaccacttccaccttcaaatcagtcttttgtatccactaggggagcaaaatgacctgctgagttgaagtgggaataacaaagtatctcaaagatgatgtgatgtttgtagagaaaagtttgtggcagtaatcgatacaggaatcacttatatggatctgtgttacttggagggggctttagaaatggcatcaagaagaaaaaaagcaatgcttcttggtttaaaaaataatgcttttatcattgaaaaatagtaccttttaagatggccaaatccccaaaataaaaattcaaagcatattgtacttccttctgaggccaaatgcatcagaactaatgctcttttgagaaaaccatgctatttaagcaaaaatttagggagtggagagtccgattattgtttttcatgagtgttgaagtctatggaaacaatgaaggaatgtacagaaagtaaattagataaagatttgatttataaaaattgtccaggtttagaaatttttatatatccaaacagaagtcatgaattaggtttccccaggctgtgaactagactaaggtggcatgtaccctcacattccaaagctgagtgccctctctgtccgtgtcacccagttaccctccttgggtgacataagagaagcccaacaattcctgggggtgtctcagagtccagcaggaaagatttatttgcagagttgagatgtcagcatattccgtctgcccacaaccatcatcaccatcatgggagtggactatcgctgtttagtttcaagggaaagaaacatggatgtgtggaatgaagccagccatgagcaacctttaaaggcacccacccaggggccatcaaggcaagagtgaggaggagtgtgaactgtgcagaaacagaggggagttgtcagtggctgggtgcacatggcattccagtttctgcacttatttattggttataaataacgcttcagaaacaccgagaagtcctagactattcactctaattttaaaagaatactgggccattataagggaagattttccccttgactacttttgagatgccaggagttggccattaattgctagatatgaaaacacatggaaatggcaaagaggctacacatcaagcattccctctactaatcatgcaaatgagtcatgatgtacaaaatgtaaggaactcctgtttagggaaaatatgaatgtagatgcacaaagtaaaatgtatgtagtccaaattagtcttctagccagtaaggcaattttcctatatgataaaaagaatggatttttatatcatttaaaggaaatacattgaaattattttagaatttaaaaaatgtaaacatgcatctttccttcttaaactctagagtatcggagatttgatctgtttttttctagctcagctattaactggttgaataccttagtctaggcattgttttattcctagtctattacctctgaaaaatgagggtagtaattagattatctcccaaaatattactgttctaattgcatgtggggaaattgcgtagaactacaaagtcttgtcatacaacctacattaactggttgagtaccttagtctagacactgttttattcctagtctattacctctgaaaaatgagggtaataattagattatctcccagaaatttactgttctaattgcatgtggggagactgtgtaggactacaaagtcttgtcctcaaagggctcacactgcatatctacgtgaagaaatattggcccagataaactaaccaacttacttttacatagagacagagccaaggtagggtttgcctttgcaaatctaagtcttgtacccctttcaccacgttaatgagatatggatcttctaattaaatattaatttctaaagaaataataagccccaattacagaaaaaaaaagatactaaaaatatttcaagagcattcaaggagcttcaatacaagaaaggcttgttgttgggtttttttcatctctctccattgatagttaagtacatacgggtagctattttagagctgcgcctagttaacgtctatgtttattcatgtatttattcaatcatgaaacacgtggagccggccacttttatttgaatccactttaaataaacacttttgtgttgattgtacaaagttccatgaaacaatatatctgccctcagggaacttgctttccagaaaggcaaatcaaagaaaaacgttttgcaaagaatcccgaaatggttacaagggctttctaagagaagtctaaattgaacagataattgtctcacattttgtaaaaggcctagactattctcactgaaaagcagtaattgaatctgtaattactttcatttcactggggacataggcatggattctaaagatctcattgtcatggttgttttcttaatcactctcattgcttcctagcaacactagcttccttccttccatgcaggaaagctcaacagtcaatggtgggcaaggacactatgagaaacatttaatggcacccacccaaggcccatcaaggcaagagtgaggaggggtgtgaacagagggacctgccgcttatttgcctttctgatgatccagcccctgtttgttttatgaacaaaggctttaacttctgacatagaagcgatttttgaaaatgaacgtaaaggaactggcaaactcagcccatgggtttcccttttaagaacatgaaatcacctcctcataatcatttcagtgatgccaggaacgttcctctctctctcccattcaccctccaccattcacagagatttgatttctagaattttgtcaaaagacaaaattgcacaaaaaattaaagatctaattggcttttattagcaattctcaaattgggcaacaccccactctataaactggaatagctgtcccagtgccctgagtagaggagattggctttataggcagaaaaggtctgaagaaagcagaaacaaggaataaaaagtggattggtcatttcaaagttactttccttgtagggttaaaacagggggatctcttatcatgccagctcaggcaaactggtctccttctctctttttggttttgacaaaatgtcttgctctatatggtggtatgatctcagctcactgaagcctcgacttcctaggctcaagcaatcctcccacctcagcctcttgagtagctgggacgacaggcatgtgccaccatgcccagctaatttttagtatttttggtagagacagggtttcgccatattgcccaggctggtcttgaactcctgagctcaagtgatcctcccatcttgatctcccaaagtgctgggattaagggatgagcccccacgcccagccaaactgggccccttctgattgatgactatgactctcctgttatttggaaaactggtggctttcaaagttcacgttagttatgtggcacctagcacaagtgattgcatgttggtttggtctgagttgttgggacctactgcagggcctactccaaaacaatggcctcccataaaccctgtatgacagtctcattaaggcattgcttctacttaactggtttgttaagtgggaggtttaaggtttgtcacctttttctctgagagcaggttttagtagagacttggacagagggcatgtagcagagaggatacagaaagatggagctgagaacaaaataaatacaataaactaaaaattcgccatacttttaaaaatatttaacaaaaactaactttggcttgagttataggtttcctctcctgttttatgtgcattagatacacacttttaacaattagatagtttttggtattaaccatgaagtagcatcttatttctgggtaaagtctgtctatttttttaagttgttttaaacttttaaaacattttttagttatgaatttattttattttattttattttatttattttattttatttttgagacagggttctgtcacccaggctggagtgcggtggtgtaaccttggcttgctgcagcctcaacctcctgggctcaagcaatcctcccacctcagcctcccaagtagctgggagtattgatgtacaccaccatgcctggctaattttaaaattttttatagagacagggtctcaccattttgcccaagatagtcttgaattcccacctcagcctcccaaagtgctgggattacaagcatgagacaccatgcctggatgtgaatttttatttaagagatagaaagaataagaacaacccaaagattatttaatagaaataactagacattaatcaaaaatctttagtgtaagccattagtaaaataactttccaggaaaattcttataggtttttaccttttgacctactttttctaaacacttgctatggaaaaagtacagtgtatttgaggatgattgttaggaggcagaaaaggtggagaaaagagaggctgggctcagtggctcatgcctataatcccagcactttgggaggtcaaggtgcgcagatcacttaagtcaggagttcaagatcaacctggccaacatggtgaaaccccatttaaaaacaaaaaaagatggagaaaagagatacaaagatttagaggtaaagtgaacttaattgtctgaacaagaaatcaaacaaaagactccaaaaagtttagaagccatccttgagatgcagatttaatgctaaaaatgttggcattttcagaatattacaatgatgaatgttgacagtcaaacagaattttattgttaagcttgtcctggaaaaaccaagaatgtttgattgtctgtgattgagacacagtccctaaatctagtttggaaaagtgacagatgtttcaggttgggatacaaaagacaaattctaaataaggaatgaaggagagaaggaaacatggaggaaattggtgggacattctgtgccatttaaatatcttgactcttgttaatgaatgtctatatagaggtcaaaggtgaggaaaacagacaaatcatgggtatctaagaaaggtgtgttttctatccaggaagaaaggtcaatggaatacataaatatagtgatataaactttaaaggtaggaaaagcccttaaaaacagagtcagtaaagattttgtagtccctggttcatagtcacaaagtagaagacaccaaagccaggaaatacaccactttgtagttcattaccctgctacttctagtgagatgtgtgcaaaacacttgtcagaccttattgccaattggcatttgagactatctacagttcttttttttaataacctcattgaagtataatttaaataccataatattcatcgattttaactgtacattaactgtacaagtgtacaggtttttttagtaaatttttagaaaattcattgagttgtgcaacaaatcaacacaatcccaacttaggacatcaacattatccctatacgattcccggttaccatgaatttctgtttctactcccagcccgacaaccactaatctcctttctgtcctggtagatttcctttttcatatcagtaaaattagaatatgtgatttttttgtgtgtctggcttctttcacttagcataaggtttttgaggtttgttcatgttgcaacatgtattcagatttcattcctctttattgtctaataatatttcattgtatgtattaccatacttttatccattcactagttgatgggcacttgcgtgatttccactttgggcctcttatgactaaatctgctataaacatctacctaaaaggctttgtgtgaacatatgctttcatgtctcttgtatagatatccagaagtagaattcttgagtcatatggtgtgtctatgtttaactttttaagaaactgccaaactgttttcaaaaatgactgggcacagtgtcactttagtgtaatccaagctacttgggagctgagacaggagaatcatgactttacagcccaccccccgagcaatgtgtgatgattccagtttctccaaatccttgtcaacacatgttattgcctctccttttgattatagctatcttggtagtgtgaagtagcatctcaatgtagttttagttacatttgcctaaggaatgatagtattaggcttcttctcatgtgtttatgttgtatttgtacttatatctatgagatatcttctgtagctataactttgacttcctgaattctgtccagaaatttctagtttgggtgatgctgtgatggaaatgcatgaaagtatgcagagtaaacattttttaagggttactaaataatcctgaaacttcacaaaagagaagtccatctactctgctagaattactgtataggaaaactcagtgtaatcattttcataatatttggtagaagagcaggcttattgtaaaaactggggatgtttatttttctttagggcttcatttttctactttttcattaagctaaggataagattaaactgcctggaggcttctttgctttctcagcacaataaaaaagtcaaggaaagacagcaaagcaagacagaattcttcagaaaaacaatactgaagggaaataacagtaacaccaggttagagaaacaaaatccatagaatcaagctttacttgagtaacaatgctgatggaaatagcatgtaagagtcttagttcagggcctattggaaatggatgatagaatttttccaatgtacaagcccactaacagatataattagcttattatgctaacatgataaatagttactgaatatctccctaaattagattgacctcaatctgtaaggatcgtaactttcaacaaaggctcgttttgcttgcaaaaagattcacacaagatgctcagatggacaacataaaggtatttcagaggacccctctccagaaaccaaattggttgtggaggctaggcacagtggttcacaccgtgaagccaggagtttgggaccactctgggcacaaaagcaaaagcaagacctgtctctacaaaaaaaacatttaaaacagtgggcgtggtggcatgcacctgtactcccaactactcaggaggctgaggcaggaggatcacttgaatccaggttgagcctacagtgagctatgattgcaccactgcactctggcctgggcaacagagcaagaccctgtctctaaaattaaaaaaaaaaaaaaaaaaaaagtaggttgtgctgtaggatcacaaaaactttgtgctggttaaaccactttactgcctttcatgaattagtttccacaactaatgtagagtccgcttctttgagagtttcacatgccattgcttgtggctttccattctctggatccctgtttagatctttggtcaaaagtgaccaaggaggcatctttatactattttctccttttattattttctcagctgacaattctttccctcttttgttgattgggtaaggaatatctgagtgttattactactagctatacggcaaccttttataaacttcaatatagcattacaaacattggttgatttgggcatgaggtagttctagaattcttttttgcttagtatggtatattgatagattaggggtaaatgtgaataaaacattgcagatatctttgaatttatgacttacaagtaacctcaatatttcagcctagctaaagacatctttaaaaggtaattttcacctcatctataaatgagagttaaaaggaaaattcttttaatttacatagtggtgttttggcttatattctgttttggtttttcccctttttaagacgaaaagtccaaggaggggatccagatagtgtgaatctgaatccagactgccactggtaaactttgtctagctaaattctctgattctcattcttctcatcagtaaaatgagaataatgtacattatctcacttaatgattattattctcacttaatgaatcatgatattaaattttcagtatcattgaccaataatgcaaacattttcataaaacgtggcttataaatttctatcatccctgatgttaatcagtttttcttgcaaaataattaagtaatgcctgcttttagtattaaaaatttttttaagttcaaaacctactaaaagtctacatttataaaattattacaaacacttaaaaattatatttccaaattatgagagtgtgtagatatgtgaattcctataaggttatacacatatcaatttgggcaatacaattacataataattggaatatttccaaacacttgttttaaaaatgctttctcctagcactagtttcataagaaggtagtacactgtcactcatcatatataaaccaacattactggctgggtgtagtggctcacacctgtaatcccagcactttgggaggctgaggtgggcagatcccctgaggtcaggagggcagatcatctgaggccagcaccagcctggccaacatggtaaaaccctgtctctactaaaaatacaaaaattagtcaggtgtggtggtgggcacctgtaatcccagctactagggaagctgaggcaggagaattgcttgaacccaggaggtggaggttgcagtgagtcgagatcgtgccattgcactccagcctgggcaacaagagcaaaactccatctcaaaaagaaaataataataataataaaataaaccaacattaccaagtgctgacaatgatcttgagcaacctgaattttcatacatccctggtagaaatgtaaattggtacatgcttttgggaaaactgcttgaaattatccactaaaattaaacatgtgtactttatgacccagcatttctacttttaggtaaatgcttgacataaatgaaggctaataagtaacacatctataagaacattcatagcagctttattcataatagccaaacactggaaacatccaaatgacaatagaatattcattcttattgttgtattatattttatttatataatacaatcttttgtattatataatacaaatacatgcaacatgtattatacaattttttgtattacatataatacaattttttgtattacgtataatacaattttttgtattatgtataatacaattttttgtattacgtataatacaatttttttgtattatgtataatattttttgtattatatatactattttttgtatcatctaaataaatatttaaagttgggtagaaggagctaggcacaaaggaatgcatagtgattccatgcacataaaggtcaagaacaggcaaagctcatctatgatgacagtagacaaatttatggttacttctgatggagtgtactgattgggaagggcatggggggtgcttctagggtgctggagctgttctaaatcattatgtgggtcatggttgtacaggggtgtgtgtgtgtgtgtaaaattcattgaactgtacctttcagattttcatgatcattattcatttcattacagaatgtcatagagattccaccatttaaagaccttgtttttataaaattacccatactatcttatagatgctggaagggttaaacaatgagagtagccacaagtagcagagcaccttctcttcctacaggatagatctcacttgtaccaaagctgacatatgactgcctgctatgtaatgcacagtaaatttaaaaatttattattaattaaatttatttctcactgttacaataaataaattgaagtgtagatggtttctgtcctcttgcatgtttctttgcatttattctcagtacatatttttgccccctctttggtcccttcccaaaccccttgctcaactttggaaacttgattgagttacacaacagttgcctaccatgatagtcagtgggatatttgctcaataaatttctaaagcaaaaatggacaattatgccccattatgagttagaattggcaaactctataaaggaccacataatatacattttagactttgggggggtcttatgtctctgccatagcttcttacctctgtagttgcatcatacatagacaatacatttttttaaatggctgtatttcaataaaacttttttatgaacactgaattttatagcatcacaaaatattttttcatcttttttaaaaccatttaaattgtgaaaattattcttagctagcttttgagccatacaaaaagaagtgatgggcagaatttgggtctcaggacttagtttgcagagctctgatttagagtcatgtaattttaagtaataacttgaatctcaaccttcagttccatcatttctagtaggttatcaaattaccatatgctgttagagagtgcttttatttattgttcctttaagaagcactaaatattaagtttaatatcaaaggctttgtttcctctttggcatgattgtaattcataagacttctaataaaagagggtgggtttgtaaaaaattccacagatatttgaggcctagtcattagtagctacagtgtcaataagaatcacagtacttttctgcattatcttaattctgatttgataaataattattttttaaaaacccttcattttgaaaacaatgaaataactaaggcagtatataatgcatttatttgaggccaactggccaagttctgtgactccttcctgggtttctatgggtcctgacacatgaggaaacaaatattcactgacattcaagaaggtcagaggtacaagtaactgctccacactgcatagcattttcaagacaggcctccaagttggttcctctccattccctgcactatttgctaagagacatgaatgataaatctttacatcattgaactgtctgtctcattctcctgtcatccaaaaatcagggtgggatttttctgatgagttctatgtgcaatttcaaaattgttatttctattcagactgaatagtaaaaaatcatctgaaagggtaaatttgaggaatgacatcacactgctttgtgcctcccacccattcactcccaaatgagggatccctcagccacagcagcagaaaaagaggacaaaaggccactgattttccatgaaggtgaaatctgtgctgcacgggctccaaaactcactgcacataactcatcttaagcccatctccaggaacccctcctgggtttctatgctccattctagagtcagtactttgcaactagccttgtctttcctcctttaggatggatacagggtagacttgggagacctgaaacaagataaatatagagtcaacagaagaacaaactcaggaggaaagccaactgggctcaaatctcggctccactcttcattgtagatggaaatagacacttattgaatacctgttctgtgctggaaacttcacataaactgttccagttgttaaactaaacaagaagagaggaaggaacaaaaggtgtcccttatttaactcatgtacaatagggaagaaaacttctgaaggaactgcttcaaatagggttttgtttcacatattattcaagcgaccaggttgactttgttgaacttctgattccatgacaacagcaaactctgcatgtgtgctcagggtttgacatgctgtggtgtactctctacctaaaagagtacgcagcataatggttgtgaatctctggaaatcagggtgtcgcttctgttttccagaagatgaagatgccagaagggcttctgagcaatgtgctatgagaccacctatggaagagagagaacaactctttaactgtggctttacttagtaaacttccaaacgattactgaaatgtcatcattagacaacgtaagcaactagcagaaaattcatatgtctaatgcagcctcctcattctttttctgtctttccctgtgatccaggaggaaggatgctggtttcttatcatacaaagatcacctgccagtgagccaagtggtggttggagatactgaccgtcaaggctcagaagccaaattgagcgtaggtcctctgcgctgccaaggagacagtaagtttgcatagcagctatggcttgcactttcttatcccatttaaatattgtttccaggctcctcagaagatgcctgcaatcagacttgctctcctgtagctcctacagaaacatcacacaacccaagcagagataacttagaggaggggaacagccataaagcctccagtacaggagccgagatttgggcataaagtggggatatccatctttcctctatattcatatgtaacaagtttgactacctaagtttatgatgatattaatagcaatgctaatagcataaatgcagtactcaacagctgtgattccacggagtgctgctgttaatgccattaggatgactatttatatcaccataaaccgagtttatggtgatataaatagtagcattatggcttaatgtatcattgtaaacttggattatggccatataaagtttgacattattgctatcaaacttcatcatcatcagagcttgatggtcccttgtaagccaaagattgtttctgttaactatgtcttgctttcaagattagtcaccccagagaggaatttggggctgctagcttggacagtgggaggtaagggagttggagtgatggtccctcctaattaagggcaccattaggattttatgttgtttgatacccttcggtgtgctttatgtgcagtcagagggaaacagtgacatggttgcactgtggggattctgcagcgagcatcctgggcatcgttttctctcttctttctgggacacgtggtttaggcaactctcctgagagttctatgcttttgtgattgtgtgctaggcatccggagacctagattctgctccccaaatagctgacttgccaggagacctcaggcaaacccctccattgtcttagctgtggtaatgagaataccacacacatcccaattcctcctggggaggctgtgaatattttagtgcctggatttggattcctcctagcaaagcattatgtgagatggaatattattaccactttgtaaatcaagggagaattagacctacttgataataaattatagcgtccactcaaagagatgtcctaaggaacgtaatgatgcatgcttaacagtttcctacttagtaaattgaggttgtcagcaattaagcaatgccatgttcctaatacaaaagggagatggactttgtactgatttttctctacttacattgaaaatgctacctgtaaaattgagactggtcaagatctttatcacgcacttattgaacaataatacttcatttgtttagtcaggcttagtaaaactgtgcagaagaaatttaatttcaactgcctaagaaaaggatattcacctaaagcaatagtatatatgcattttaaacaaatattataagaaatgaaatacagtgttgctctaaaattaggaagactgtcatgtgttgtctaatgaaaatcatttttgttatggaataattactcattagcatataaaggtaaaatatttctggcttaccgattctaattctgaagttagctttgaatttgagaaagtgttcccattaaataattgattaacttaatatatttataaaaattccacttctgcaaactttttttcttgtctgttttgttttgctttattttctttttttgagacggagtcttgctctgtcgcccaggctggagtacagcggtacgatctcagctcactgcaacctccgcctcccaggttcaagtgattctccagcctcagcctcccaagtagctgggattacaagcacacgccaccatgcccgactgatttttgcacttttagtagagacggggtttcaccatgttggacagactggtctcgaactcctgaccccgggtgatccacacgcctcggcctcccaaagtgctgggattacaggtgtgagccactgtgcccagccttctgcaaacttttattaccattcttaaaaaaaagattctaggaacattaaatagtagatgctgcagtatatgagcactttataattaatattagcttatttgttcttaataaatcagcctcaggaagaatttattgtgaggctgtcattcatctagaactttcctaggtgctctggaaagtaagaaaaagaagttcaaaccatgttatgtgaaatgaacatgaaaaaatattggaaaacacaaattggcttataatttaattttaggctttgtaatataaaattattgcaactgataatcaagaaaggagccatagaaggtgtatttcaggcagactttctttttaaaaaagagaaaatgagaaaagtatagtggtcattgttcatttgcatttctattctagggctgttgttcttagaaacatttttagaacctattatcaaaataaacttatttattcacattacatgatctcagtatacttataattactgtaacttcagagaaactcttttaaataatattttacctgatatttcatgaaagcaaaagcagtcaacagttaatggcaattatgtagaatacttttgtgtctgtgtgagagagagaaatctcattgttttccaggcaaccgagaataagtatcctacctggtactcgaattgcctggtagcagtcagcagttgtgaagcccatgttccctttaagaatgttctcacggccgggcgcggtggctcacacctgtaatcccagcactttgggaggccgaggcgggcggatcacgaggtcaggagatcgagaccatcctggctaacgcggtgaaaccccgtctctactaaaaatacaaaaaaaaaaaaattagccgggcgtggtggcgggcacctgtagtcccagctactcgggaggctgaggcaggagaatggtgtgaacctgggaggcggagcttgcagtgagcagagattgtgccactgcactccggcctgggtgacagagcaagactccatcttaacaaaaaaaaaaaaaaaaaaaaaaagaatgttctcacatggacacagtagtgatagagtgttccgtatcaactgcattttccagtttttatacatatgtgatctccctggttacacacagcctcctgtgaattgggcagggcaaatattagtctttctgccttacaaatgaagaaaatacttctttgaaaatggcatttacacagcaaatttctgagcatactttcagcctctgagaggcttcaggacaaaagatggaacagagaatagaaatagctgtgtctgtacaaggtcagagttgttttcccaactgtactctcatccctgagccaattgttgattaaattaaaatgccttaaaatgtttcatttgggttttatcccaccactagcctcagccacacatgtcagttaccaacatagtacaaacattatagggattacatttatgtaatttaaaaagtggcatagtgcatttttcctgctgtttatagagatgaacttactttgtgtcatttactgaagtctgttcaaacctacagcttataaagactaaacctattgttgaaaaatatctttcagtttgaggagttgagtgatgacagccctcagaacctgcctcttgaattaggccccagttccatcctctagtctcagagaatgaaaccatttttgtgggctctgcccaaccatttcagcagttttggttgatttcatcatgcctgctgagtttcatttttgctttgattcgtctgaactcagacccatataatcaaaatgctaaagaaaatcagtgcatgccactcagatctgctgcatttcccatatagttctgtgaaatgcttatgtccttacaggtgtgtgtgtgtgtgtgtgtgtgtgtgtgtggttttttttttctttcattctttcttttttgcaaagcctatccaaatggaaacttcaaatcaaatgacactgaaagtatgagtggtgacggatggttcgctgaaataaaaagtgctgtgaaaatacaaatccccctcttaaactacacgtacgcacctagaaagaaacaaaagaaccatttggaagattaaaaatcaatgatcaggtagacattgtttcaaattgaaatatgtaatcatctttgcagatggctgccaaactttcatactttcatgaaattagttaaaaaaataaaagacttccactttttggaggtagaaatctcatactatatatgacgaatataattaattgtaggaatatagtatttgctagacaattgctttattttcagccatatgatgtaaaactttactgtactcctctagggatacggggactgtaaataaatactttggagcaagtttgtcagaaccataggaaaggtttaaaaaaaaatcaaatgttttcagtaaacctgggtagaaacaattccagaaaatgtcttattcaagggcttcttccaaggccatgccagaaacactggctgtgaagctggcagacagagcactggagtcacactgcaggattaagatgcaaattcagtttctcagagctacggaggtgacccagagagacaaggaaggaaaggcaaggcagtagtgacacatctagttctggaacactcagaggacagacaaagctgtgtgtaaacaaataaagatactgatggagattcatcaagatgatggtgaatatttgttctttgggaaagttattttatgtgccagactaataggaaggccattatcttttttttgcaagaattttacaaaccaggatcataacctgccattcccttgacaggagagataagatggccaggcatggtggctcacacctgtaatcccagcactttgggaagccgaggcaggcagatcacttgaggtcaggagttcgaggacagcctggccaacatggtgaagccctgtctctaataaaaacacaaaaattagcagggtgtgctggtggccgcctgtaatcccagctactcaggaggctgaggcaggagaatcatttgaatccgggaggtggaagttgcagtgagccaacatcgtgctgttgcacttcagcttgggtgacagtgtgagactccacctcaaaaaaaaaaaaaaaaaaagcaaaaacagacaaggcaataaggcaatgcctcggtctccacgttgtttctgtaccaatgaaacatttccaacaggggcgcacatggcagtaactctctttcagaagataatacccacgagcatacataggccacatactctgtgcagtgaatagggactgaaggagaaaccacttctcatctgggttcaggaagcaattctccttattgagaggaagcagctctccaggctccagagaagagttcaaaatttatttatctcctttttctttgctgcttcaggcttggaaaaggcaagaaaggaaaagggactagcatgcaggttctaaaccaatcactttcgattcattttctctcttgattctctcaacatcccttaataggtgatactgttgacaaaaaaaaaataaaaataaaaataaataaataaaaaagtaccctgtaaaatatttaaagaggtttatttaagccaaagatgagtggccatggcccaaggtacaggctcaagaggtcctcagaacatgtgtccaagggctacaatttggtttttatatgttttagaaagacataagacatcaatcaatatatgtgaggtatacattggtttagtctagaagcaatgtgagagtgtggcttacaagtcataggtggatttaaaaatgttctggttggagattggttaaaagagttaagttattatctgaaggtctggaattgatagaaaggagcatctgggttaagataaggggttgtggaggtcaaggtacttattatgtagatgaagtctcctaggtggctgcccttagagacaatagatggcaaatgtttccatttagacctttaaaaggtgcttagactctcagtaaatttcttctggattttgagggcctggaaggggaaagatctagttatgttgatagagattattcatagatgtgaattttcccccacaaaaaaactgcttagcagggtcatttcaaaatatggcaaagaaacatgtttgggtgtgaaatctttttatttcttcctttttctgtcatgtgatgttatgctagagtcaggttaaaatttggtatcttattgctacagtctgtaaactgtcatggccctggtggaagtatggcagtgaggacaaccagaggtcactcttgtcgccatcttggttgtggtgggttttagccggcttctttactgcaacctgttttatcagcaaggtctttgtaacctgtatcttgtgccaacttcctatctaatcctgtgacttagaacttctaaccacctgggaatgaagtccagcaggtcttagccttatttcgagatggagttggtgcttagatttttagttttggttcacagtacctttgactccagtgtactgatgaggaaacagaaacaatgttattaggtgctttgccaataagtttcagagttcagactggaatctacctagttccaaagtcctcctttctactctattcaatcagagctgatgttaggataaaaatgggaagaaaaaaaaatctcttatgctctcggggagtggctgggtctagctgtttgctaatgagggggtctagggaaacatccctattgccctgtgaagggtcactgaaaaaccaactcacaaggcaggttaatagaagaaaaggcatgcaaattttactacagggagaatcacagaatgatttctcaccccccaaaggagttcagaagcttatatatcatcctggaaaaacaggttttgggagcaggggaggagaggaacttcactttcactgtcaaaaggactatttactggctgggcgcagtggttcatgcctgtaatcccaacactttgggaggctgaggcggatggatcacttgaggtcaggagtttgagaccagcctggccaacatggtgaaaccccatctctactaaaaacacaaaaatcagctgcgcatgttggtgcgcacctgtaatcccagctgctcaggagactgaggcatgagaatcgcttgaacccaggaggcagaggttgcagtgagccgaaatcacgccattgtactccagcctgggtgacagagcaagactctgtcaaaaaataaataaataaataaataaataaataaataactatttacaagttcatctctgttcctagatccatttattctctctggtaatcccctcaacagaattcctcttctctccactcccataatctatttttccaggatggtaaataagcttctgaacccccactgggggtggggggtggggagtggtaatccctctggggctctccttggttctccacatgtacatgttaaatcaatatgtatgccttttctccatttaatctgactcttgggagttgatttatgtttttactttttttttttttttttttgcgaatcttcagagggcaaaggggaagattccattggctcttacactggcaagctgtgtcttctaacttactcttacatgaagggctggttctgaaagcagagataaaaaaaggataggtgacaaaaactgctcccagtcccatgcttagtggagaaaagatcccccttgattttgcacccctctttttgacaagtcatcaaacaactgatctttttccacttactgcatctattttggctcccctaacagtgtacttcttaaaagtaaaaacaaaatctaattcacttgtatattctcagtagtatcacatgcctaacacctagaaaggattcaacaaatgtttgttgaatgaggaagaaaaataatacatcagagcagagggagagtgataatgccaggtttggcctgaaactcagcttctgcccttagggcactcatcaccccaagcagagaaatctcagggcgctggggctttggagttctctaatggagccacaggtgctgggccaactgacttcctacatgaaatctggattttagaccctgttttcctagacccctcatttcctgcttgggtacagctcttgcctctgccttttcttttttaaagttttcattacactgtgtactgatttctggctcactttgcttccctactattgttctgaaagcttatctctgattcagccccacccagaaaagagaggttgcctcaggcaatctatgtaggatgataataggtgtattaccagcatagaggaccactttctctctgtctctccattcctgccctggccattaattataatacattcgatttacttgggtttggtcttcagccctcatgcttttgcaacatcatgatgggctcatacatgatttttaaaaagagcattaacatcacaaatctcagaatgggtaacgtttgatcattcccagtaactatttcctgagaagatgctctaaattgtttttctttccccattttttcccacaaaatgtggctgtatatttttgcctcacgtatagctcaaaacaagaccaagaatcacagtgtcctaacagtggaagcgtcttagagatcaaccagtgcagaacctctcattttacagatcaggggtctgggtctagagaggttaagtgactggcccaaggtctcagagctggtatacagcagagcacatcgagaaacagtttaatacagccttcatccttagtaattccccagggccaagatgaatgttgacacccaaagaggaaactttgacctggaacaatgaccttgggtctctgcctatcaacagctgagtgggtatcagaactcttaatcttactccatcatgagatcaatcatctggaaatcttgatagaaaacctacagccacagaagtgagggtcagtggcagaaagttgatgacttctgtttttttgttatgttttttgtttgtgtgtgtgtgtgtgtgtgtgtgtgtggttggttttttttaactttttagggttgataatagaaggcatgaaaaaaaaaacaaaagcaaaaacgccctggagtgatgtgtagaaatcattaagctctattttttcttaatgtcccagccttcactgctattgccatgggctactaacaactgagaagcagtagtgggtctaagaacaagcagaaatagtgaaattttcaggatcacaacctaggctgactcccattaatggattgagcccaccgggcatttctgaggtcaggtccaattacaaatgctgtagcttttacaagtagatggaagccttcccttttatcttccagattccagagtgactttaaacaattagaagaaatggacaattcctgcgaaggaaatcagctctttaagattactcagttactcaacttcagctgcaaactcactgttgaaatgggacgtaaaattggttacagtttggaaaaaagtctttctgttttacaattgacatgatatttgtgtgcgtgtgactgattttcttacctgtcctttcaaataccatttgtatttggaggaatcgtcacatgccacagaggaattaacgtgaatgagctgatgccagacttggttctgcaggtctgtgttgtcaacaaagagtcaaattctgtaaaatatttgaagacatttattctgagccaaatatgagtgaccatggcccatgacacagccctcaagaagtcctgagaatgtgtgcccaaggtggttgggacacagcttggttttatacattttatctattttatgttattttattttatattttattttttgagacagagtcttgctctgttgcccaggctagagtgcagtggcatgaccttggctcactgcaacctctgcctcccaggttcaagtgattctcctgcctcagcctcccaagtagctgggactacaggtacatgccaccacaccccgctaatttttttatttttagtagagacagggtttcaccatgttggccaggctggcctcgaactcttgaccttagatgatccacccctctcggcctcccaaagtgctgggattacatgcatgagccaccacgcctggcaggttttatacattttagagaggtatgagacatcaatcaaatacatttaagaaatacgttggtttggtccagaaaggcgggacaactcaaagcggagggtggtgggggtaggggttccaggctataggtgaatttaaatattttgtgattgacaatttgttgagtttgtctaaagacctgagactgatagaaatggaatgttcatgttaagataaaagattgtggataccaaagttcttttgaagtcttatagtggatgcccttagagacaatagatgacaaagtttcctattcagatcttaatctctttaggattgggagggtctagaagaaagagatctagctatgttaatagagattctttacagatgcaaaatttcccccacaaagaacagctttggaggcccatttcaaaatatggctaagaaacatgctttggggtaaaatattttgattttcttccttgtctcataatgttatatgagtcaggttggaaaataagtcacaatatataggttaaataaaacccatctgatgaaaatttattatttgtagggcatgactccccacacctcttagataggaatttgggcaagacttaaaaaaaaacaatcagagtttagtcctcagtgtggctggatgggttctgcctcctccatgtcctctctctgggtgcctctcccttcctgaacttgttactctctgcagaagaaacagcatccccagatgcaggcgggagatttctctgcaaattgaatccccgtaatttggtttctctgctgaactctctgaccaatctctcaccatttgaagagaattagtcttggcctattggatctaaacatccacagtgtggagcatactttggaagtgacagaaacacggagtgaaatagagtctaacctattccaggatcagctcctgaaaacaaattcaacctaagagactttattgagaaaaacgagacatggctctgatcctggatcagtttatgtttcagtgagggtgaaaattttaacaaagtggaggagattaggatggaagtttggattcctagtgggactttgagtggaaagctgagaggcctcatgtagttgtgctttacaaacattaatgtacttagaaaccacctgagatcttgttaaaatgcagattctgattcaggaagtctggagcaggacctgagatgctacaaggtgtggctgctgctagccaacaggccacgcttaggccagcaaccttacatagcagcatggtgaacagcacagactttggaatcacacccacctgggtccaaatcccaactttctccctcactaaccatgtgcctttggacaagttccttaacctctctgggcttctacttctcacccagatccttacctcagctgcaaatgagaataattgtaacatcactgagtttgctccagtaaagcctgattgtccccagtccttgcacatagtcagagctctctaagtgttagccaacatcatcattcttatatccatttgctgtggaaaaagtggcaggcttgatatcagaaaagctctgcccatcttcctgctccatgttcctgtccctgtacccttgacttcatgccttttcttggagaagacaggcctagtctcaggtgacagtgtagcatccagccatttagcttctcctaatttggaggtgctggccacaatacctgattagagctcaactgcattttctgagtccccagggacaatgtccttccacataagcaatctctcatttccttctcatcatgtggatctcagcttcgatgttaattcttctaagaggacttctttgtccactcagctgacatagccactcacacctccctacagcccttcttaattttcttcatagaatgtgccactccctggaattatctctgcaatgcacaactcaattctgacaccaactgccctgagttagcacagccttcacaagttaaaagcacagtccccaacaaaacagccttctcttcacacaccagctgcaaacttgggtggctctcaagccactcacatttctgaccaactgactacaaatttggggttgctactattctttcagggtcaataattcactagaatgactcacagaactcaggtaagtgctatacttataatcagagttttgttataaaggatacaaatcaagtctagccaaatgaagagatgcacagggtgaggtcgggggaagcttcagagacaagagcttgcatgtcctctccctgtgaagtgagaattgtaggagttaaagaaagaggaaagaaacacaaaaggcagctcaacagtcaaagacaggtttattttggagaacaaacctaagaggggcttctggctgatttcagtcaagagcactctctcttacagactaagagtatttaagggttttagggtgagagagcttatcacaggcttggactgtttctgtgtggaagagaagtttattgcagggttgaaatgtctctggttggaggggggttatcttggggctgacatctctccggcctctctggccagaggggagattatcttggggctggcatgtctctggctggggaggggtttatcttggggttggaatgtttctgattggagatatcatttgtggtttatggtcatgctgaccttagcctgatgccctttggacttaggcgatttttttatcaaggggaactttaaaatggcggtgcttgtccaagatggtgatgctcctgctctgtcaagaattccctactcttctggtacaccagtgtgcatcaccaaccagtgacgctcacccaggctttgggtgttcaatgatttattgggatctcattctgtaatcatgattgattaaatcattggccacatgattaaatataatgtttagcccccttttcccctcctccctggagatcaggctgatatcaggaagctcaaagcctcaaccctctatcaggtggctggtcttcctggcacacccagcccccatcctgaaaccacctaggggcccaccatgagtcaccttattggcatggacccaggcatggtccctggcgctcactatgaataacaaacactcctatcacttgagaaagtcctagggtttagaaacttggtcccaggaacctgggacaaagaccaaattaatgacctgttatgagtcaatctcttttctctatttatttgctttattgtcaccattgtccctaacagtagacgggaatctcaggcagaagtctgtatcatggtgccaaggacaatgcctgccacattgaggcactcagacatgtgttcattaaattaatatgaatggttaaataaccacaaaagatgatttaaattagcatttccaagtaacaatggaggcagtgcatgaggcacttcatgataaattgcagaaaacttgcacagacaataattgttataaaggtccaagagaagcactatcacttgatttatatgcacaactatttttaacctcaacagggttttgcacatttattcatcttaactaaatgaaaacttttattcctttgtaccttgaaaatcccttgaatctgatgattatctttaaattaaggattaaaaaaaaactcttttgctaagtttttatacattctttggcaattctaaattaagatgcacatgaagtattaaatttatataactcattgtttaatctaaattagattaacccccttggcccttcagagatccaagtagaggcttccatacttttgtttatccatgtctcaaggttattactgacaaaattacaattagtcagtacttcatgtccattgttagggtgctaagctgtgagctataaactacctcactctggcataattaaaaccgtgttccagttcacctattttatgatacctacttggctttccataaagcttcttttcacactcctaactatgtgcaggtctgggaaacttgggaactttactgaagaaaactttaaacataagcttcttcttgaagtttgctgatagttctgttatagcagtcttactatcatcaggataaaaaaattgtactaaactattgtaaaaacataagatttgtattactacctctttttttttttttttttttttttttgagacagagtctcgctctgtcacctaggctggagtgcagtggcgtgatctcggctcactgcaacctccgcctcctgggctcaagcaattctcctgcctcagcctcccaagtagatgggataacaggagcatgccaccacacccagttaatttccacgcccagttaatttttgtatttttagtataggtgaagtttcaccacattggccaggctgatctcaaactcctgaccttaagtgatctgcccacctcggcctctcaaagtgctgggattacaggtgtgagccaccatgcccagcctctattactacctgtaaaataaatcctaattcaaaagtcgccatgtgtatgtacataggaaatagtgcatttgaactggcatttacctactggcataacaaattgctctttggaatagatgcctagtcccaagttaagaagaaaaggggactcctgtgtcccatccatagtttctcattaagtccaagagccaattgtgctaaagtaaatgaatatcttcaagctaacctataaggggtggtgggaatattagttgctagaccaacacttaatcaagaatctctcacactgtctaagggtgaatagaacaactagacttgtagaggattgcttaatctttttatgaaaaagtcatgtgccaattaagattctagccatacctccttcagggttttcttgacttactcaagctttagacaatgaagtggctcaataatcttttctgtaatccctatgtctaatgtattaagtattccttaattcaatttggtagattaccctaatcgattttgttttctggtatttaaacctttagaatttaattatattatactgaataggatacaaagtaggacttgagcttaaaagatggcctttcatttcacagaaaagaaatttatatgtcaagtattttgctgtggtattctcattgacatagctgagatgataatgtaaccagttcacgacgtcaggattgctatgagagaaccccgttactgggtgcttgatttgctcttttggtttatccaaagatactgagtttgctctgactgcctcggttttctccattttaacaaaggcaaaaaccaacactttgtattaaataacctaaaccttggcattgaacttgtcaaaagagaaaatgacctgaacattagagccaagaagatactctgttgtattttactttgttacttaggtatctttatttattctttacttatatatttcaaaaagacatagccttcctttatggaaaaattcatttgttattatttaagtacaacagatagatagatgctccaaaattaagtctgagtgttttctttgcctgcagaactgacagtttgcttggcttatgctgataatccccaaaaaagtcgcttgtgtcttgaacatccataggaaataaaactgtagttccgggcagtgtcgataagaaagcaaactttacaccttcacttaggggttgagaaagagaatgagctattgattccactctgaactttagatggccatatcacatctgaaaccagtcatttcgtggtgggcagtattaaacccgactttgtcttatgactttacaaattagcgaattatgttgttatgataagagaacccaacaaaagtatctgagtttggaacatcaattttcaggatgttatatatttgagaacacttctccactgctcctctaactcctctagcctacctaactttaatagccaggcctccttcctacctgtttccttcccccttcacaagaagcacctattaaggaatcaagaaaaaaaaaaggatgacacttactttcggaataaagtaatatagtctctactatttctgctttcacacagatttgccctcctttctggcacaattacacatacacacacacacacatgcagatatacttacgtatgcacacatgcaggtatgcttagaatttagcattaggctgggtgcattggctcacacctgtaaccccagcactttgggaggccgaggtgggaggattgcttgagccccaggagtttgagaccagcctgggcaacatagcaagaccctgtatttacaaaaaaataaaataattaaccaggtttggtggcacatgcccgtggcccaactacttgggaggctgaggcaggaggatcactggagcccaggaattcaagactgcagtgagctatgattgtgccactgcactacagcttgagtgacaaagtaagacctgtctcaaaaaaaaaaaaaaaggaacttggcatttgcaatcctgaacctactttaacccaaggtaatatggtttggctctgtgtttccacccatatttcatcttttagcttccataattcccatgtgttataggagggacccagtgggagatgattgaatcatggggacaggtctttccagcactgttctcatgatagtgaatggctgtcagaagatctgatggttttaaaaatgggagtttctctccagaagctctctttttgcctgctgctatccatataagatgtgactttctccccttgccttccaccatgattgtgaagcctccccagccatatggaactctaagtccaataaacctctttcttttgtaaattgcccagtcttgggtatgtctttatcagccatatgaaaatggactaacacacaaggtaaccacaactcagggcttaaaacttctggacaccagtgtagttggaagatatagagaggaagctgaagagaaatgagaggcagccttggaactcgttcctctcagataagggggaactgctatagttgtactcatgggtatgactacagcaaaaggatacaaagcaaagtcagcaaaaggaaacgtgcatgagatgaagtccagaggaaaccaaacacaagcttccaagagactcccactggagtccacagaacacacttaattcccccagctattagttgtggcatcatgtgtgaaatgctgtctacaacagaggctcactagagactcagcacccaaggttttattgggtactggtcacaaaggcagcccctaccaggcatgcacccaaaacccagactcccagaagaaaggcagttgtttagcacaaaccacattgtttgtaccaacagttcagcatagtggggcattcttattaatcagttaaccctcctgaaatctaacttggtgggccagccatgggaagcacttctccagcacaaggatgctgcctctctccttcccctgctccccaaacccttctccacactcttttccctctcccttccatagaagtattaagaagatgtgggaacatccagatcttcaacctcacaccaccctgcatcacactcctgacaccatcatactccacttccacctggctttgtcctgcctcttctaattcttttgttgtttttttttttttgagatggaatcttgctctgtcacccaggctgcagtgcagtggtgcaacctcagctcactgcaagctcctgccattctcctgcctcagcatcccaggtagctgggactacaggcgcccgccaccatgcccagctaattttttgtatttttagtagagatagggtttcaccatgttagccaggatggtcacaatctcctgacctcgtgatctgcccacctcggcctcccaaagtgctgggattacaggcatgagccactgtgcccggcctccctgtccgaattcttagagaaggaaaagaaaaaagactgtgctcttttcccttgagctgatcctttgtatctcatggcctgcagtttctgctgcatccattccccgggcagcaccagctacataatttgcaaagtccagtgaaaatgcaaatgcaggaccatttgtattgtgaattttaaaagagagacaataaaccaggtgccaggcccttctgaggctgtgagggtcacacacctatgtttctacgtgctagcgaaagcacaaggtcaaccctagattctgaatatcactggggcatggcagaccttgcagatgtggatctgcaagcttggtttctctaatagctttgaaccacaagaaacatttatgtgatgaaaaccaaactatatatggcaaaaatatttaacacaggggcttcttatatgtactggcaaaccatatcatattattgagttttccctaaacttgattacagaaattacctggggttcttatcaacatgcagattcccacacagctcccctagagattttgatttggattctccagagtggagcccagtaacctgtttttaagaagttttctagaatatttttctgacagggaaagtgtagaaacttaggctcagaatatttgggggcagacaggcctatgctgaaattctccatttatcagcagtgtgacattgggaaagttatttaatttcactaagcttcaatttcctcatctgtaaaatagaaataattgtgctagtacaaaaggttgctatgggaataaaatgagacaaatgtctgtaaagaacttagaacagtgactgctacagtaagctgtcagtaatcgtagttataaatattacagaaaaagagtagaactcatttaaaaccctcagttttgtaatactagatgaattaagcttaaatgcaaattgctaaaggcaacagttatttctgtcaaattaaactcattcagaaataataaattacaatctgaagtgaacaaaaggctcaatcagtcatcaatggtaaacattttgagcactgctatggtctgtttttgtctttccaaaatttatatgttgaaacctaatcacccacatgacaatatcaggaggtggggctctgggaggcaattaggtcatgaggccactcccattaatgggattagtacccttgtaaaagagaccccagagagcttattggccctttctgccatgagagacttcagctggaaggcacgatccataagccaaaaagtagaccttcatcagatatcaaatctgccttaatcttggacttcccagcctccaggactgtaagaaataaatttctgtttttcataagctacccagtttacgatattttgttataggtagcccagacacactaagacaagcaccttgtgttggcagtgtcacgatgcctccgttcttgtcttcttagtttaaaagaatttaaacagctgggtgtggtggctcaggcctgtaatcccagcactttgggaggccgaggcgggtggatgacctgaggttgggagttcaagaccagcctgaccaacatggagaaaccccgtctctatttaaaaaaaatactgaattagctgggcgtggtggcacatgcctgtaatcccagctgcttgggaggctgaggcaggagaatcgcttgaaccgggaggcggaggttgtggtgagccgagatcacgccattgcactccagcctgggcaacaagagcaaaactctgtctcaaaaaaaaaaaaaaaaatttaaacaagagacgcacagtgaagcgggtgcagcataatttattgcaaaagaaaaagaatactttgaaagttaagtgcagaatagacaggatgctctgagagagagaggagtcagggtgggctgccggggaggatgagacagaaaagattggcgggagggagactccccttatgggagtcttacctgattattcctaaggaggtgaaaagaggtgttaccagtaagcatgttctgggtggttctctgggtgcacatgcgcagtagccgcacatgcgtgttcatacgtctcatgtctcattaacatcttaaatctccacctaggggtgtattttataccattataatgaacaaagggtcagtctgaggacggatgaaatcaaagtgcgcatactctctacagggggagtccctaatgaagatagctttgcttgaacgagctcaattaccaagcgaatgctggggcttattgtattgactgtgtggtcaccacggttgctgcgtcctaagaacatggtcatttcttttttcttttttttttttttttttttttttttgagacggagtctcaccctgctgcccaggctggagtgcagtggcacaaactccgctccctgcaacctctgcctcccgggttcaagtgattctcctgcctcagcctctcgagtagctgggattacaggcgcccgccaccacgtctggctaattttttgtatttttagtagagacggggtttcaccgtgttggccaggctggtctcgatctcctgacctggtgatccgcccaccttggcctcccaaagtgctgggattacaggcgagagccacggcgcccggcccatggtcacttttttgactacctatcctgcctcattgatagcaggctgcagatacagaggcgtgaccgatgatttttgcaatcaaggaattgatcatctatttcaggataagttagagaggtgagaagatgcatctctttaaaaggaaacacataaaggttaaagggcaaagcaaagagaatgagtaaagaccattttccgtggggattggtggagtgggtagaaggcttgagctggagaatattagacaatgattagccaaacgtaaagaagcaaaagtttcctgtagaaaaatatgcaaacatacacagtaagcattcagtaaatacttgaatgagaaaatgagacctgagttggaaccagaaaaaccgacaaatgccaataatcccagagctgaagatagtctgtagacagtggggagtttgttagccagaaataggaggggtgagtgggaaatctttaattaaaataaaacctttaatctttaattaaaatattaaactcttcacttgtgcttagttgcagagatctatgcctatgtagttttttaaacaaataaaacaaacattgccaataaaatgatgtaattcaataaagggcttacagtaggttccacatccaacaacgctatactgaaaatacacaattaaaacttattgttatattctcattatagaagtctttttttttgagacagagtgttactctgtcacccaggttggagtgcagtggtgcagtctttgctcactgcagcctctgcctcccgggttccagtgattctcctgcctcagcctcctgagtagctggaattacaggcacgcaccaccacacacagctaattgttgtatttttagtagagacggggtttcaccatgttggccagatggtctcctgacctcaggtgatccgcccacctcggcctcccaaagtgctaggattacaggcatgagccaccatgcccggccagtagaaatcttttttaagaagacttttaaaagctactcattttagacaagcctttcttaattgtgtaagaatgcttggaaaaaagtagtattttactatttttaataaatctgtaaaattattgatgactgctagcttttctgttttgcttcatttataagtgaatgaacagtgattgttgtgggttgaataacattccccaaaagagatgttgaagtcgtatcccctcatgcctgtgaatatgatcttgtaggaaatagggtctttatagatataatcaagtcaagatgaggccatactgaattggggtgggccctaaccctatatgaccggtgccttataagaagagaaagcgcacacacacacactctcacacacggggagaacactatgaaaaaatggaggtagaagttgcaattttgcagttgccctgccttaagccaaggaacatgaaggattgccggctactgccagagcctgggagagaggcacgggtgaacattctccctcagaatctgcagaagaaatgagccctgccaacttggactgtggatttctacccccagtactgtgggagaataaatttctgttgatttgagccacccagtttttggtactttgttaaagtagcctgaggagcctaatacagtgacttcctaatcaaagaatgtggaggcgcaattcaagtggtcttttcaactccaagaggattgggctgtgtttgttatggttaaaggaccattagcagttgttgaaaggataaagggaaggtacttcagtctgatgcggagtcagtgaggacacccaccgctcccctgcagagcagtgtcttgagagagaaagggttctcctctctgtaggagaagcaagctccattcctggtgctcctctgtatgatgggcatggctacctatgcctgccctccagaggggaagaagcctttgtgtttaggaccccgggatgatgttgacagctatgatcacataataataattgtatgataatgattgcagataacatctgttgcgtatctaccatgtgtcagatctagttaagcacttcacaaatcaactcatttaatcctcgcaagtatatagtccatgaaggtcatattattacccttattttacagacgtgaaaaccatgatagagattcagtaatttgctccaagtgacacagtgaatgacagagctggaatctaacccaggcaaattggctccaaagcccatactttcagcctttacagtttagcaaggctgcaccagaccccaacaaaaactagttcttttgtataacaagagaaagattccctggctgaattctagcagactagattcctcagtgccattacgggctgaggacttacaaacatgaggaaaagataatggctagtttggttttctaggtctgccttagcaaattaccacaaacttggtggcttaaactagagcgacttctctcaacagttctggagccagaagttcaaagtcaagcatcagcagggccacatccctctgaaggatctgggggaggatccccttcttgacttttccagattctgggggctcacggcagcccttggcttatggcagcaaaactcccaactctgcctgtctccacaaggatttcattgtgtgttcaagtgtcctttctgtctcatgtcaggaaagtctcattggatttaggacccacgctaatttagtgtgatctcaagtgatccttagcttaattacatctgcaaatacccagtttccaaattaggtcacactctgaggttctgggtggacatgaatttgggaatggggaatgatattcaacctgctacaatggccaagaaacatctacctagttcaaaagagaacaggatctactggaaagcttctcagctcttggagccccacaactgtgtctcctgggtcctagccttcagcctggctctcagcacagctctttgcggataacatggctctacactgcgtcgaacagatttggtggcagtgactcacctagcagagttctcagcagcccacctggaaggtcccatcacattgttgttattgcagatagcactttcactgttactcaattttttttctagtatcttgtgaacaatgtgtttcaaagtataggacgacttggtggttaatgtcacaaaagcaatcattggagttgtcaatcacagaatgacattacataaaagaattaggactcttcttgctcaagatgctttatacatgagcataaattgagagttatgtatatttggatagtagaaaagctatacattaatgtgcatcttaatgaggatgattttcttcttttgataaccaatgtgtctatgaagccatctagctaggtactggtgagaaaaatgtttcaaataaagtatttttattggagcatataaaagagttacaaaaatatttctgtaaaattttctggtctatttttttcaggttggtactttttaatggtttagctgttaaataagcttcatctattaacttgtattcagaaataagcttaattattcatcaattcatgctcaccttatattttatggttttccaaatggatgatatcttctatgtctgtacattttttattaaacataagtcattttatgcccataaagcttattcctgaaaaaattattttgctactaaaaaagatcattaagttcacaaattttctctccatggcttgatgctgctatctttctgcaccataattagttgcatgtatagttaattattatgagaaaagcagaacatctcccaatttctacaagatacttagagtttgatggtttaactatgttttctccttcatttctcccatccaccctccagccacgtgtattttcatggtaggaagatgataagcatacgctttttcaaaatgacagcaaaatgttcatcaggaacttcataaagctttgatagactgaatatatatttagaaccagcatttcaatggctctttaccttttcttaagaatttccttatctatgaccctcattgctagaaaaaaaatgcgcacttttatataaacacaacatttttcatataattttaaagagatttgaaaccctctgaaggctatatgtagtccccatgccaagaatgccagatttgggaaccaacatttcttatccatttataatgctaattaattatttctcttaaaaaatactctagttagcctgtaaaattcatttagatgacacatttaattttgcccaaaaccttgatttttttggaggaaaaaataatgtaagaaaatacattattttaggttaggatctttaaattctcacagtcaaccaccatggtttctttgtacgacctaagctcattcactggtgggcaagtgttttggggaccaggagtggatctgattcatctctgtatctgccacagagcctagcatgatggtttagacatggagggagctcaagtaatactgttaccggtacacttgttatttaattttaaaaattaggaatggctactgtgtaagtacataaacatttaagttcataaatttgtttacagttgaacacaaaaaggccatttgtgttcagatatgtgacctggggaagaaagatgaaatgggtattttgatcagcacggggagcagtcagtgggcctacagagaaggcgattagaaaagccttgtgctgacagtgcaggttctatgatatggaaagaactagtgaggaagatgcacatgcttagtagctcctaggaagagttctcaaggagcatcaacctctatgtgtccttcccaaggaagcagtgggccctagattggaggaattcaggataaaacacacagtcctgctaaccatttcttatcccagtcacctgaagggatgagatcagaattactagggaaagactttgcagtgggatagatatgcttccaaggtacttctcccagcccctaatacttcctgtttgctaatgcttaaaatctctctaacctaaaatctccctaacctaacctttcattttaacattagaggaaaaaaaatttgctaaatattgactgaaatttattcaccctaaatttaatcacaaaagtacaagagcaagcatacttcctctctgattccgtgaatgagaagtattgaggagccaaggttggagaaggggttaccattgagaatcggagagggcaccagaggtcaagactggggaaaaagacaaattgaaaagacattctatctttccctaggattgttccaattatcaatcctattagataagcatatgtagaaacctggtataaaagaaattattttgtatggctaaccactctccttcaaaaaacttcacaatttgttaagtttagataaagatttatcctcttgtttgattagtttccttagaaataaatttcattcttaggggtttcactaattaagataaatagacaattagcctcttggcagcagaagctacttcttatttatctctgtattcccaatgcctaggccagtgcctagcataaatattgtgcttaatcaggattataatatgtatatttcttgaatgaagataacaaaaatatctattacaactctaagtgatttattaattgatttgagaaaggatttatgttaacttacaaaagttcattcaataagaggttacatcaaatatttaaatcattgcaagaggaaattagaagtaaagccaatgaaatgaagttatatagctaataaatcaatttttcttagttgtaataagtatacaaaatctttctgcatgtaatgtgtatgctatcagcttaatataggcatgttttaaaccatgataaagaaaatattccaatatctcaaattctttcagaattatgccaaccctagaacacagtttctagtatgtgattaagccttctattttttaaaaaagtatttctcaattgactgctttacataaatcatataggtgtaaatttgaattattactacataaatttttcttagatttatgacagaattaaaatagccttttaagtcttaaaaatattaataagaaaagctcaattatgtgaacacagctaataatacattcattctggcaggcattgtgcaaagttttcaatgaatatgaatatctttatgaaatatgagaagctttgttcatttacatacaagttccttagtctcctacattaattattttttctcattttttcatgtggaaccttttccagtaagttctcataagacaacaaatgacccagtggagtacctatttaaaacattataaacaaagaaagcttctttcttcagccctgttctttaatatgtaatgaaaatgcttcatctttcattacagaaatgttttatgttctaacctcttaacctcattattatagtttggttagatttttaaatagaactcgagtttttctcagtgtttcagacaggaagaaaggtggagtacctgacaacctgttccaggaaagaatgttcaataatcaagcatctatctcctcttcctgagttaatccagttagcttatgaggcaagcatgggggagttgcaaagtaaatcaaggtgctgaattctactctcatcctgatcctaaatggattgagttttgttctttcttatgtactatccccatattcacagttacagactttgcaggtcacttgctgtctttgtcatattgggatgctctaacataccatagactgggtggcttataaacaactgaaatttgtatctcccaggtctggagaccagaagcctgagcccaggctggcaacaaggtcaggctctggtgagggcactcgtctcggtagcagtctgccaacttctccttatatcctcccaagtgggaagaaccagagagctcgttagggcccctttttataagggcattaatcccactcatgagggctccatcctaaagacctaataatccccaaaggccccccttctcatgccattacattggtgattagggttttagcataggaatttgtgggggacacagacattcagttcatagcagtggaagataaggggtgctgtgcagacatcatgggctctatgtgtcacataatgtagcatctcatacagggtaaacaatcgccactgttatctcttcccaaagccctgctgtggggtctgctcaccggccctgcatccagtcaaggaaggggaggtggagaagggcacttgaatgctgagtggcaccaagaggaatgtgcagatgtcataaactggaaaattggggctaaaggtgaaacagcatcatacaaatgtcttccctccaaaagctcaatcttattttagaaatatatgatccatgaggactttatcataaattggcccaaaacagccagtcagctactgagggtcctcattttccaatgagtgcatgttttgctgcttcagtggtccagcacgatttggaagtattattgctttgttactgaagagacctttgttttgattcagttgccaatattctctaagatggtttaatgtgagccatggtacttaggtgtaatcctgtaaggtttcttttcctgggattcacagtccctgctttcaatagagtctcacgagggtctatgacccttccagacagcactgatttcaagtctgtatcactttataaaatcctacacatagtcgtgatcttagaaaaaaaatggacacaatatagaacacaaaaagatgaacccattactaacaaatctccatatatccattgtatctaagtcatactctatgagcccaaaggctaataaaaaaacaggatcagacccaggtacaggggcaacagtgccaacttctgaaagcagggatattggtgtagcgaaatagagaatatgaaagaaaaaacaatactctgtgagaaatagcctagtagcctatactttatgccaataagctttataggaagttctttttttttttttttttttttgaaacagagtcttgctctgttgccctggatggagtacagtggtacaatctctgctcactgcaacctctgcctcccaggttcaagtgattctcctgcctcagcctcctgagtagttgggattacaagcatgcgccaccacgcctggctatttttgtatttttagtggagacaggatttcaccatgttggccaggctggtctcaaactcctgacctcaagtgatctgcctgcctcggccttccaaagtgctgggattacaggcataagccaccgtgcccggccataatagtaacttttatatcccagacaaaaaaaaaaaaaaaactgagttaggcttacagacttgactctgaggggctcatgataataattttcttttttttttctttagttcgtttgttttagcatgtgctcagaggaaaaagaaaaagaatttatggaagaaatctctaaatcatattccgttctttcatgaaagtgggcaattcaaataatttcactcaattttcaagtgagatattcacagtaatttgtatcttcaggttgaggctaagcttcattgcacttcatgggaatatatagaacattctagcaaatctttcttagactattacatctttgacttacatgtttatgaagaatcatctgtgcctctgattggccttatataaatacaagggtcatttcagagagcagttcttaactgacttggaaaagcctaagagccaaacaattcagcagctcttccacattgatggcaccagccacatgcagtacatgtgctttacgcatttcattattgcatctctttgtcttatgagtttattgatggaaaattgtgccttgtcttttatcaagtaaacatatttcagaagacatctacatgctatcaacaaaacagagcaaattcagaaaatgtaggacttcgttgtacttgggggattacttcaattgccttaatagtctaccagagtagaaatattacattctttaaagttcagataaataatttgtgctgcttatgtaggaagtaagctattctccactgtaagcagtcttttatgttgacaatatagaaataatctgtcttataagctacactgcatctaaagccctgacactacagatttatgcatacttctggctgaaaataatattgaaatgtgaaaatgaaatctttcaccaaatctctgggaacataggtttgaggctggctttggaatcactaaaaattcattgattcccaaacgtagactaagtaccataagaactgactagggtacttgattgagcttgtgctgtatggtttattacactggtggtaggaatgtgtcaatagtgattatactgctctaagtattttgttttagggtatgattctagcttcccttgtatcattactcaaaactccaaatgaagtgtgtaagagtatttttcaaccctggatttacttgcattccatactcattaaatatatgacacaataaaatgtctaggtcttatgcaaggaacttcaactcttctatggctcctggcctaaaaaggtatctgtgagaggcagaataatgtccgccaccaaagatgtccacatcctaatcttcagaacctgtgaatatgcgaccttacatggcaaaggggatttagcacttatgactaaattaaggatctataaatgcggagattttcctgcaattcgctgggtaggtagaatctaatcacatggatccttaaaaatagtaggaggaggccgggcacagtggctcatgcctgtagtctcagcactttgggaggccgaggtgggtagatcacgaggtcaggagttcaagaccagcctggccaaaatgatgaaaccctatgtctactaaaaatacaaaaaaaaaaaaaaattagctgggcatggtggcggttgcctgtaatcccagctactcgggaagctgaggcaggagaattgcttgaacctgggaggcagaggttgcagtgagtggagatcacgccactacactccagcctgggtgacagagcaagactccatctcaaacaaacaaacaaacaagcaaaaaacatttgaagcattgagattaaagtgttttctttgattaaaaatctgtcaagagtaattagaacctgcttcctttcctcttctcattgtacagcttacaatatggatcaagaaattgtttctattgacatacttctttccatgtttagatcggcttccaagatcttatcctttccactttcaatgtcatgaaaaatcattgagagttcctttaatgcgaaatgttatgccagtgtcacttcctgtgagacagcttcatcctttttggggtcacaaccaccttccttatttgtgtagttcaattcatttaacctgagttcctctggctacaaatctggagtctctgaaacaatgacacattcagctattgcttctataactccatttacattcatttcacatttcactttcagcatcatcactctctgtttcttgatgcacttttatcttagttagccaattctcccttctcgtgtccagttttgtaaagtgttatatgggcttatcactgggaaacaaggaggcaacataaccacatgctttgctgtgtgtggaaagaataacattatgtggagtaacaaacccttaatagattttgaaagaagtgacatggttggtcactgatcatgatgcacatctgttatttctgtatagatacttctgaatgcacaatgaggttatgtcccaataaatccatagaaaacacatagttgaaaatatatcaaaagttgaaaattcgtttaatacacctaacctaccaaacatgatagcttaacctagcctaccttaaacatgctaagaacacttacagtagcctagagttggaccaaatcacctaacacaaagcctattttgtaataaaatattgaatatctcatgtgatttatagaatactgcactgaaagtgaaaaacaaaatggttgtacaggtactcaaagtacagcgtctactgaatgcatatggcttttgcaccttcctaaagtacaacaattttaaggcaaactgtcataagtcagggttcatctgtagtgtttttggacaggagagctagtaacaaaacttgaacactatacatatgcataattaaatttgtatattatgcaattactcaaacttagtatagcacagtaactaaaatttgaaccatgttgggagactggtatatttacctatactatagtaactgaaatttatgcatattaaagtgtgtgcaaagcaaggactgcctctttgtgtgtgtatgtgtatgtgtgtgctctgtatgttttgcatattttcaaactttaaataaatgccatcatataatatttatccttttatgaacttgctatttacattcaaacaatgtttctgattattcttattaatgtatgcagtcaccgtttatttctttttctgttttatgatattccattcacatgactatactacacttcaagttatttatgtattctttattgaaaatatatattgctttcagttttttatttttgcaaatatgactcctctgagaattaatttattgcttccatgtagtcatgtgcaagaatttctctaaggtaactatatctaggtgtggagttattcagttttaaaccttattagatatttccaaattgttttcccaatttacactttcaagtaagttttaattttattttgactcaacttgctccataacagttagtattggcaaattccattttaccaatctgatcacataaatgaatgaggctaaactaatttaatttgggttttcttgattaagggtgagactgagcatattttcaagtttcctcaaatatgagttatctgtatcttttgataattatattaatatatattatttacataaaccaaatattaatgtttataatttgtatatactgcagctgtcatctcctaatctttgtcttgtctttttatttgaattatgatatattttgatgtgcagaagttttaatttgaatatagtagaattcatccattttcctttttggtttatgttttgtgtcttatgtcataaaaatattatcttttgtgcttcatgccttttttcttttatgatgtcttttttcttttaaaagttttaaccgttttctatgtttgggtcattaaaatacatggaactcaatttttttaatggtataatctaagggttcagtttcttatttttgacacatatacaaccaaattttccatcatcaaacatgggaaaaattctttctccactgaactgtaaagccacctctgtcatacatcaaggtttttttttttttattagactttattttttagagtcaatttaggttcacagcaaaactgaatagaaagtacagagatttcacattcaccctctgcccccacatatgcacagtctcccctactgtcaacatccatcaagtttttatacatgcaagggtctcttttgggctctatatttttttcctttgttcacattgtcaatgctgcacaaatttcatactgtgctagtgatacatcttcataatagaacttggtttctgatagagtttagtctacagtgttgatttttaataaagttcttaaaatttctaactaaaattcatgcaaattttgctactgcaaatagtatcttttaataaattactttttctaatgattgctgatagatagaaatgtaattttttgataatgtgagacagaattcacattacatataattcatccatttacaatgtaaaagtcaatagcttctgttttttgaaattatatgtatatatataatcatatagtgtgaattctttgtgtctgacctctttcagtcaacgttatgtttctgatattcaagtttttgtgtgtagttatgtccatttatttttatcactgtagagtatcccatcatataaatatatcagtatttgtgtatcctgttttcagtttgggctattgctgattatacatcattattctagaatttccttttggtacattttaaacctgcccactctctagagagtattttattattttctcacggttttcatttcttttggtctgtcttacaagtgtcttaagtatatttgttttgtatcttttttataattattacattaccttgagggtttagagggtttttctggcactttttcacagtggcttatttcctcatctgttttggtatttttgttatctttctgcttatcccttgcaccttgcaatgtgtgagactcattttgtcttaggttgatgttgctctgtctcaacaggatttggatttgcttatacacgtgctttgatacataatctaggttgggtttatgttcatttattggcttggcttttcttggactctcaagtagtgtatactcaaactgtagacctctgtgagggcaggcctgtggttatgaactctcaggagaatagctcttccttattcagtattctggccaagacagatgacagacatttcctatggccagtagtcagctgtgtttcctagaacatcctatcattgaagatgtagccttcaggggcctcagccctgtgcatcctctagattcccaccacaggggagcccagggcactttcctgtccctggaatgctgtgcaattcaatcctctcgctttccaagataaaggaatgtccccagttaagggccagctcaccactctgatgttcttccccatttttttggtttttgcctttttgtttatttctttgtttaagaggggatgttgctttgttgcccaggctggcctcaaactcctggcctcaagtgatcttcccccctcagtctcccaaagtgtcgggattacactggcatgagccatcatacccaacccttccccttctttttctaccattgggatttatcttgctctttcgagtccccagctataccttaaaaaagacacttgttaatttttatgcagcatttgtgggaattattttagagattttcagaacccctagtctgtcataataccaggatagaaagtagaatggtgctggccagggcctggggagatggagaaatggaacattgctgtccaaccactgtgaaatttcagttatgcaacaggcataagttctagggatctgctgatccaccttgtgcctgtaggtaacaatactgtatggtgctcttcaaaatttgttaagagggtagatctcatgttaagtgtttttaccacaataaaaaaattgttttttaagagttgaagactattttctgaataaaaacaaaatgaaacctcataagtaaattcagagttgcctagtaaaatgtgtcacacgcataataaaagtgtaaaacattcacactcctcactctcatttaattatcaagaattaattaagcttttatttttcttccataaattccaagttcccgatagctaacttccaaagctaaaagtaatgttacttttgactcttttgctacaacaaataatactacactaataccctggcatgtattgtgtggctatgtagagtatatctgtaggaaatgttggtggaggtggagctgctggttaagggtgagagaaattttaattttctagctttcaaattataccattcagcctcccttttgtaaactgttagtttaaatttgcttttctgtaattgtacgtgagtgacaattattaaccccagttaaatgaacaaggagttgatcatctgggggtgttcacagtgctgaaattatgaggaaaagatgtggttcaggagaagcttattaaatgtactttcctttttctccacccccacaccaacatgctgacaatagaaactcattctcaaactgaccttattcaaggtaagaaggtattgttccagtgtgttggtttcaaggactttcttccatgcagaataaatagtagaactaaaatatcactaaacctctaagtaagcagattatgtgctgtcaacggtgaatgcccaatatatccacagcgcaagaacttaagtagacagaggtattaactgtcattttatttgaaggaagccaaaaaatcttgtgctcacatcatattccttaaaacctcattcttccagaatggctaccacagtcccaggcatcacctggagacagagacataatacccagcagaagaaaagagtttattattttatgatctctctgtttgaagaagaaaaaatacaacactttcttaaaaatttctaagtggacttcctcttgtgtattattggccaaaattgaattactgaatcatatgccaaccccaggaaaatcaattattggtgtgaggaatagaattcccctgatcaccttagcctaatcaatttgtatccatgacttacacaccctgcaacaaaggaaaatgtaggacttgctattgattacgtacacaagtgtgcctgatgtggacagcaaataagtttgatggtattgtttgtcataaagttaagtaacagcatgagtaatatggccctctgtggaatttcttggtggcagttgagcaaaatttaaattgctctgaaatggaggactgtgatcacggaaacaaggtagagttagctgatataatttggtacaaggaaattaaccatggttgggtttttgagccatagatatgataatactcagaaatatatgtaataatgcagcattcccaaatgattccaatgttgagttctccacacaaatcatttcattttctttcagttggtgttaaagatattggagtcctcatttggaagtcactcactatagcatttatgggaaaccgagctctgaattacaaacatcgagttgacaaacgaaaatctggaacagaacccactcaccagctggcgaccacccagtattatttgactttaaacttgatacttgaacatgattttttaaaagaaacttaagcaagtaaacataaaaaaaaaaaaaaaaaccacctctctttgacttggtcttgcaatgggctttttaccgctttgaaatggaatacagttttatttccaataaacagcagccgtaacaaaacttcacacagacacctggagaaggggcatttgatgaatgcaatactatcattgtttattatagaattatttactagaatctggcagagatcctaaacaccatttaccataactttggccaattttcctaaatccatacttcaaactctactgatataatgggctgctttagccaagaatgatagctctgttactccccaaatattaccaaaacaaaggcgtggtcacttcccacaaatccacctggagtatgagtcaccagctgccccttgttgatataaagagctcgaagaatgaacagttttgaaatccattagtgaatcactgagaatccactcagtacagcttggagatctcaacagaagccaataataattaaagaaagaaaagctctgggttaaaggaaagcaagcaatccagcggaaccaactagaaaacatcagccaactgcagcgccttgctggaattagggcagaccacagtctagtgcctgctagagcaattgaaggaagcccagctgagagagaaggcttcagtaaagaaaattagggaaggttttatttttatgtgaagttcttgtgagaaggatgttaagagaaagcattatctgttattatttatgattgttgagccccacaagcaagcctttgagtttttataagcccacatagcatgtttttttgtttttgtttttcctgagggtaaacacttttatttgtaacagcattgtccatggctgtcaatgtatctgatggaaaatacctgtccataagcatgaaggaaatccatgatcttcccctttaatttgcagaacattacatagtatttttttaaaaaagatgcaaatagcagcctacttctttgctgctaaagagctttaatggaatttttagtgaatcagatgtgtaagggctgatgtcctccaagctgagctggatctccccagttcttcctaaggttccttttgtgtcacattcaactcaacagacaggaagcaactctcctgcagtgaaggccgcacagtgggctctgctcctaaatccaaggacacagaggagcgcctgtgtccccaaatcaggaaggcgggcatcggcgagacccagtgtcacagagaacgagcatttttgctgctactgttctgtgcaagtgatcacagcccagatgtacagtatgatttggaacctccacactatttagcatcccttaatttgtatccagtgtgctaactgacctggaaacattagaaccccatttccaagtttctcttaaaaatccccaggtcccaacacacaccaaccactttcatcctcaacagggcatgttacgccagagacagatccttctgcatgcattttgccttaatgccagtaagaaaattgattttttgtttcaggatttttcaatccagaagacaaagagattagtcagcagcttttaaaatgaaagtttccaggtgagagatttcaacactattttgtagatctggtgaattaagatacatattttcagtattttaggaattcaaattctaatcctttccaattcaccaactccctttatccaaatccatggaatcagagtctaatgaaaggggtacttagcatttgattccaagctttcccttacaactacatttacaagaaagtattttgaagctgagaaaactgacaggtcctgtggttgatctgcacagttctatttcctttgggctccaaatgttaaagcacatgccctggcaattcgggcaccagttttgaatgaagacacccagcatcttgcacctgcctgccaatctccacgtcctttgtagaggaccggggtggacatgcccatcccctcctggggaagtctgtttacactgcaaactcctgacttctgcatggcggtagagctgattgtgatacctctgtccacctatgccagcccaggtgcctgacttgtgttgggttaactattctgatagctttgatatggccttcccacatgtgccttctcctactgtggccgctgtcactctgtctccactcccatgacacttggatgctccagtgacaccagctcctgcacagtaccactcttcagcagcgttcatatcaaactgtgcatgtctagcttatctgggggaagacactgaagagaggcagaggtggagacgtgaaagaagacagcaaaatcacagagcttcgcaagagaaactgcttgcttaaagataatttcttcttctgattacaaaagttacacatgctcattgtcaaaatgctggaaaatacagagaagtttaaagaaggaagaagttaccataatcatactacccagctaacatttcggtgtattggtagtagggaaatttctggttgtcaaggaggaaggtatatatccctaatcacagaggttttttcatgctcttaggtcctaagttatagcattttaatgggagatttctaagacggaaggtatttctggaatagcattccttccctttcttctgcagatctgtcaaattgttcagctttcttgactaatagatgctatggatagagcatccctctctctctaaaaatctcaaaaaaagcaagtcttatttattcaggatttgaagagaaatattcaggaaggatatttcatcaaacctgattcatatattatgcactgtaatgatgctagacacaaaacacaagatttcttgatagatggtcagaataaattacaccaactgcattagctcagcagcagtcctgcccggatctcagcacctgagcttctcatctgcgtatggttgctcagcttggtcactgagacatgcaaaagggaaatgggcattttccctgaacacctaaatcctttccaaaatctgtcaaaatgtttactaaaatgtagcttctttgtttatcagacgaactgtggtaacagcagttatgaaacttatcacagttcatctgataaactacattttagtaaacatttcaaagtgaagcagatatgagagagaacaaaattatttgtgtttacatgagacttggaattgttaaaatttttatatctagcatacaaaaaggctgcttatgttaaaaattgatagtaactaaatatataagaccaaaagaatactaataatgtgaattaaaatgaaatcttagcttggtttataaactatgaaatttgactaaaatctattctgtatatatgttctagttttagaatataaactagaactagaatctaagtagtagccaattggtaagtagtgtctgactgggatctaaaccagttcagattaaaccattgcaacactactcagaaaagcgtatggtcaagatcttccgctatggagattaacaagaaatgcccatctatgtaacagtaatttaaaaactgatagtggtatattacattccagtgaatgacgtaaataatagcctttttaaccctcttgcgaatatacatggtatttgagaaaaacgttgcttcagaacaggtgaaagaatatgcctggccaaaataagttcggctacccaaaatggtaatggcttaagccttttggtttttatctttgttaaaggcagcgagtgacattttaatcttcttgtgcaggtttttctaaaacacaaaacgctttctgttaaaactcgccacaaaggcagaaagggaaaagcattcacagatgcacacagattccaagaactctctcacactatctcaggaactcttactgctccctagaaactgtttttcatcagaatggggaaaataacacgactggtacctgcaatttctgacaccaatttcacatctaacctctgtaggtatttaacggactcagggcctaactgaaactgctgctaactattgatttgttgaggtgttcatcccaggtggtttatggggactctgtaaatatgggctgataatagtaatggtcaagctcccataatttcttaatttcagtttatttatttataatatttatggttgtaagatcgaatctggtgattatctgtgctgggggcagaaatttcatttctaaaggatggcggtaaatataagcatgttgttggttgaatgttcaaaaacatatttcaaaaaccaagtactaacagctaaggggaaaaactcacacaatgaaccagaagtgtatgaaacaaggaataaaatggaaaaggagaaggcatgaatgttggagggatttaagttatggatgaaactacagtgaacattcagggtatgttgggagatgaaaactgaagcatccttttactcggtagcaaaagtgaccgggatcaagggtcactcccggatacaggtatcccggagcacctccacaatggcttccagcccagacctttgtcgtgggaaggagtcccatgctctcatttttggcacaaacagagtttgactctcaccacaaaacagcatcaaacaatgtcacaggctgtgcttctcacaaggttttttgtttgttaagttcattttcctgaactcaaacattgtgggaagaagtaggtcataatatccatttccctctaaattgatccagagcttccagaaatctgaagaccagtgaagccaaggtttcttccaaacatagagttgtgtgaaatcactatgtaaaactgtcagcattattttggtggcaagttctgtccccatcttggctctcctccctgcctctcccacagcctggtacagtcagctatagagttcagccctgaatacctgctggatttacacctagcaatgcatctgttgatctcactgatgtgaaaatcattttacaaagaattcccactgcattttctttagcatggcattcacattcccccatagtgtggtcccaaatcactcctggtcttcatcttctaggttcctcagaggggacctcctagcatcagtctgggaattctctgtctcctatgggatccaggacctggaccacccagtgtccttccaacaggcctgaaaccttcctatgtgcaggtgtggaatgctgctttcgcttcttgcctcccaatatcttattgattcttcagttccttgttgtaatctccctcattcagagttgttttgtgtttgtgttttgttttgttttgttttttgagacagagtctagctctgtcacccaggctgtagtgcagttgtgatatcttggctcaatgcaaccaccccccaggtccaagagattcttgtgcctcgggctcctgagtagctggacttacaggtgcatgccaccatacctggctattttttatatttttagtagagacagtgtttcactatgttgcccatgctggtctcgaactcctggcctcaagtgatccgcctgccttgccctcccaaagtgctggggttacaggtgtgagccatcgtgcccattctcagggtattctttttttggggggaggggtgtgaggggagggtgaggagaatggagtttcactcttgtcactcaggctggagtgtaatggcgtgatctcagctcactgcaacctccacctcctggatgaacgattctcctccctcagcctcccaagtagctgggattacaggtgcctgccaccacgcccagctaatttctgtatttttagtagagacagggtttcaccatgttggtcagtctgtttttgaactcctgacctcaggagtggtccatcagccttggccttccaaagtgctgggattacagacatgagccaccacacctggccagagtattatttaattctctgagtaaccagaagccaaaggatattgcttcacctttagttgccatgtaattgaggcatacctcatcatcagcagtacacttggttttctatactggattacacaccttttggaggcaggggctacttttattcttctttaaatcttcacctgcactagcatgctaaaacaaggaaaagaaagttttatcttctatactggaaacaaagaaaaacaagggtaattcatcttacttttatcactagtctccgattaactacatgttcaagtttactgtatagtatatctatgtgatctaggcaggcatatttcccctcaaatatataatatggcaaaataaagtgcaagttgtgattggtgaagataaatgactgaacttttactatcatattctcactctgctgataaatcatctttgagaattcgtattaattttggtcaagaaatacacaagttaaatccattttattcttttttttaacattgggaggactaagtgaataaagaaggagtgaattatatgattgtctaccccacagtttcagtaaaacgatattttttcctgcaatatatttatgatctgccttaaaaccatagaatctggcttaagccaaagcaactgtatcttcctttattttttaacaataaacacctttaattatcttccttccgactactttgttgtaacacacaatgtgtttgtctcctgaggtgagcataaaaaaggagcccagcatgacttgaatgctaccgtaattaaagaaaagctaaaaaggtcaaaaacaagaatgtggtaaatcttaagcaactccccagaacaggcgccacctgccactttgtgctgacaccgtcaatcattgaatcggttactgaatactttcttgcatttcttcttctccaccttgtgcccacgttaagcaggaagacatcatattttcattagcacctgttttgttttttcaccttctgtagactgttgagtgaatttctaataataaagccaaaaggaaaaataatggcaatatgattggacaagcagtttcagaatcaaggtaggatgcctttttgttggtggaggttttttgtttttgttttgtttttggacttattctccctcatatcaaataaatttattaaacacacctgaacacttgttatgtgccactgtcggccacgtattagggacacggaagaacaataagacatactccctaccaaaagaggcttatggtttagaaggaagacacagtcttgtaaacaggtaagtaaaataaaatgtgagctgcactatgctggaagtcagcccagggtggcccaagtagaccatagccagtctacataaatagggagacacgggggacagctttctagatgtccctaacgctgaatcctaaaagatgagaagcatttctagggtgccagagtggagaaaacacctgacttgtgggagaacggaaggcctcgtgttcattcaatggatcaactatcattgggcatctccacctgcgagagacggcgctagcccctggggatccagtccccggtgagctggaaagctactctgtgctctcagaggacttggaacagagaatgcagacagggtggcaggaatgcaggaatgtgctcacagtgcaggaacccggtggctcgcagagaagggcaccaaacttagacctgggagatcaggaccctctcccccaaaacctggaggattgctccaaagctgtaccgagtcagtggcggaggccgggtgagcgtggggaagggcatcagacacggtatacctgctccacctttcccttttgttttgttgtcacaagaggcactacttcgctgcctccgtctcctctgtgggtggaaaggatggacccaaaggaacagaaggctgtggccactcgacgatggttttgatagggacttatcttgctctctctccctggacactctctttctaggcctgcagcctctctcctcccttcccatttccaaagcctctgccccaacctgatccaagtattatatgtaaacctgtcattagggttctttaaatcaaggctttttgatgacaaaaagagggtttaaaaaaaaaaatgtggctcacgcctgtaatcctagcactatgggaggctaggcaggcagattgcctgagctcaggagttcgagaccagcccgggaaacgcggtgaaactccgtctctactaaaaacacgaaaaattagccgagcgtggcggcaggcacctgtagtcccagctactcaggaggctgaggcaggagaattgcttgaacccgggaggcggaagttgcagtgagccgagatcgtgccactgccctccagcctgggtagcagagggagactccgtctcaaaaaaaaaaaaaaaagaaaagaaaagaaaaagaatctgtaagaatatccagtgtggcttctgcctctggaataagtaatagtcttagtgaccatggctatgggagtacccgggttccatcagtgtgccctgtgtggttttggtctgggctgcattggcgtggcctgtttttttgtttttgtttttgtttttcccttattactgttcgtggagtgttttagtttgcttttttgtttgtttggttggtttttttttggactctgcgaatggatgtctaatgctctcgtctccctggcaggacctccttcctgtgtctgcagtttctcttgtagccacaccgtctgcccgatcatcagtgctaggaaaataacgatgagaacagacctttcgaagcccgattatcagaaagagtgtcttcatgcttgaaatctgaatataaaacagacgcccctgaagtgcatccctgtgacactgcctgtacagcaccgttaaatatctcatcggcagtaatagcttaagactactgtgctcagtcacttctttgggtgtcactcatagcaatccccatccctgccatcatcattatcacacagcactgccataatgacaattataaagatgttagaaagctgagacaagtcattctgaattaaaccgcagctcccataggtcctctgaaattacccgtttccaatatctccattgtttccctacccaaaagcaaaaaggggagacaaatgtctcttgagcgatgcacaaaatacattataagcctgggaataatcaaagctaactgtgttcagtagagagagatgcactgtgactaagtttcactgaattttaatggcataatttttagcccagaaagcaagctcatgtgtgccggagtgattaatgatacagtttatgcagctcattggtcatacttaaattagtttaaatattcatctgttgttttgttataatgaatctccatgtttctttttatttctgttcccctgagtgtttcctcttgtctggttggaggatgtttgcctgaattgggaaagaaatgccaatagccctgtaggtgacaatgcacccaggctgctgaagatcaggggagatgaggcaataaacgcttcatttcacactgtgaaatgcacacacagctgcaccagcttcttgagtgagatgtcttggtggattctgtgaggtgccaggtcagagattaaacttactgatttgtggcacatgaagccattggatgaagttggatgctgtttgctgtccctgggacttcctttaaagtccacacatcaatttttataccaactccctgaaagtcctccttttatgagcattcataatttacattttgagttggaaagtcctgtaactctaccttctgggattttatgaattttcctcccaaatacaaaactctctagatgctgaaattgcatttgtggtgaagaagggaaaggccataagagtaacttaataagacttcatgttacagaactgaaagatctttcaaattcacataaaaggaggcctgcacttgacactgtcctgactatataacaacatctagaagtagacagtgttgcctttttatgctatatccttgggagtacaatttacaaatagtctactacacacttcttgcacttgtgaatcacccatatagatcaacctttaaagtgtaaaaaaaaaaaaaaaaaaaaaactttataacatcctgagaattaatccttggagagctggctagatacagaatgaaaaattccagacaccacaagtagttagagctcagcttcctggataaatcagttaatttggaaattgtggcctccatacccgctaggcatgtttgttcatccattgttctcctccctatctcctagccacagtgaaagaaaacgaagtgtggtgtacacacacttctagctatgaaagcagctgcatgatactggaaacacagtgtctccaaatgtttcagccttgggggcttccctcattattactatctgaataaagtgcttcagtccgctatgatactttactctaggaaacccagctttgttcctcacattatcaatgacttccaggagtgttcaggaaggacccaacttttacactcactattcaacatgttattaccatgctgctaatgtttagctttcttctacattatttgacccccaaaacagacactataacccaactaatataattctgttatagcatgttacaagtttttagcaaaggtgagaatcatcaaattgcatacgggatgttattattcttcatatccatcaaagtacaggaagtccttcacaggcagccatctttttctctgggccacaccagagaagccccctgccttctcctttctttgagtttcaaggactgaacttcatgtctcacaagcagtcagaggtggaagcaaatgaaattgcctttgcaaaaattctaacagtgagaggaatctcacctgactccatcttgcttctaacctcacaagctagctgactttgttagctttaaaacaaaaatgatacatcccttcctgaaactaacccctccttgcttagggactgaaaccatgtttgtaagtctaatgaaaggacataagattaggattatgggaggggcctgaattctgctaagatatatgcatagttaaacaataaccagctattgttccagaggtacaagatttgtaacttctccaactgctcctttagataatatccatatggtcaaaacctaagattgggctttgaggtattttccagacttttgcatttggtttgaccagctgatgccacctgaacccaagactcataccagggaactggctcaaccagtcctgtgaccttcatccagatactgactcagtgcacaaagaccattttggacattcctatgatttaatccccagtcaatctgcagcacccattccccatccccctacccaccaaattaccttgaaaaacactagcctccaagttttactatctctcatccttctcttggctggccctgcaataattaagttctttctttgctgcaatacctgctatactcaatgcattgacttttctgagcagcaggcaagattaacccatcaggctgctatacaaatacttcctgttaccttagtactcaaaacaatctatggtccctcttctcaacctttctttcttgattatttaatctctgttaccattcttacacttacttacttgcaataacataatacttactctttctgtaataacttgcaggttataattggatcatgagtgacctctccccaaattcatttatctcatcttaagcctaatgaatgaaaaaattatccataatgagagaaaacagcaggatccttttcataaagagatgtttgaaaacaagtatttttggaaataatatattaagatgcatatgtggctatatgaccgattctaatgtgtttaggccttgctaatatatcggtatgggacaatctccttcttaaaattgtcacactgtattgtttgcttcagtccaggatagcaggactttttgacctgaaaggaaaaggtaaggcaagggcagaggttggacccttgtcccttaggacaaagcaggcagatttacatcactgccttccaggaaatgacagcttacccccaaaagtaaagaaaaagtgtactttaaaaaatactagccaggtgtggcggctcacacctgtaatcccagcactttgggaggccgaggcaggcagattgcttgagctcaggtgttcaagaccagcctgagtaatatagtgaggcctcgtctctacaaaaaaaaaattttttttaaattagtgtgatggtgcaggcctatagtcacagctactcaggaggctgaggtggaagggtcacttgagtccagggggtcaaggctgcggtgagccatgattgtgccactgcctttcagcctgggtgacagaacaagaccccgtctcaaaaatatatatatgttttatacttctcactatagaaaagccatttaaagcattctgtgtagggggaataaagtgagacacaacctgagtattataatgagcactgaatttgtagtaaaaagagtaagtcagattcttgatttgcctcctgcaggctttgcactttgaaaaaattatttacattctctgggctttggatctcttgtttttaaaattcagagtttgaaccagatacccgcccacctcatacagcttgaaaactctacaagactcaagtttaaaacttctgcattccaataaaagttagaaccctaatcctcttgctacaggctagcaagatttctcgtatgaaaataatgacactgcaaatcagtacctgaggtctaccaaaacctcatgttgtcaaaaccaaattgtcatctaactatttgaaacccgccacaaccctttctcgtaccattaatgtcaaagcacaccctctgagcagaggcagcagtcactgttttttgttgttgttgttgtttttttctgagctttctcacatactaacagaggctttgatgcaaaatatagagcagtttccgacctaagggactttggaccaacagatatcatgctagccctaattttttctgtgggttttcacacgactgtgtgtgagaaaagcaagagatttcagatctaaacaagacccactatacgaactaatgaaaatattgggtgtgtggtctacaaaacagcctaaataagtacttctctctgaaagatccctttctccataggcctattcagattaatatctagttttcttcacattaaagtgtatatgacagttgtcatgataacttagtgaaaagtttagccaatagaatctatgtagcacttttaggcttctcctgctgtctgaattttttcttaattttctttctctcaaattcagcccacctaaagtttttgacagtctgtttaccaatcaggaaaagatttaattcttatttgtcttaaggcagacatccaggatggacagtgattatgggttcatggaatgttacaactggaagagtttataggattcatctggtccctcattttcctacttgtcaaatgaaaacaatcaccagggaatgtgttgaaaatatagatttttagtctccactccaacctgttgggtcagaatctcaacagacacaagagaatctgtacttttaacaatcataccatcaagcaaatttgagaaacgctgatataatcctatgattttattttgtaaagaggtttattttgattatacatggtcatatatgaaaaaaagaaaggatttcatagcctttcgtgaaagagttgactgcttcatatcagttataaaacataaattgaaaattattcctgaggttgaaacactcaacttgggcctctcaatttctgaaactcttgactttgatgatcgtaaaatgacaatgattattttatgttaattacagaagtcaccttccattctctcccaacctcaataacacctatagatgatatcaaatcgaggcatgtagagccacacactattttaaaaatgtagcattccttcatactcataaacattctcttaaccttaacatatgaaataatctccaaattctcacaaaaatgagtgcccacctgaactaaagtttttttacacctttaaaaatgtaattgtacagacgaaatcggtgtcataaggttactttcactaaaatagtatatccctctaaaaacaactttcacccatttgcaatcactggaaagtcatagaaggtgactagagtaactgatttctctcaagagcaaattcatgctctccaaaggagatcagggtctgtttagaaaactgaggtctaataatcaaggttgccacctggtagatctcatgttccacacatttggatgacttggctgatttcaggaatatgggaaaaatcagtttaacccaggctctctgaaccaatgtctcagatcaaactgatgacccccggacagcaaaaatgtgaccaaggtggaaggatcacttgagtccgggaggtcaaggctgcagtgagccatgattgtgtcgctgcctttcagcctgggtaacagaacaagaccccgtctcaaaatatatacatatgttgtatacttctcagtgtagaaaagccatttaaagcattctgtgtagggagaataaagtgagacacaacctgagtattataatgaacactgaatttgtactaaaaagaatcaggcttagccttcacttcacaacccaggttcacatgggtccttcctgtgcatcccaaggtcaggtttaaccacatcaacctcaaagccttccaaacagaaagcatttggaaacaacaccatctccccagatcattctacagtatgaagccgtgaaactgatggctctcggttcccctattcctggaacacaagtcttcagtttcagatttgggggaagagaaatcatcatagtatgacaattgggagaaaattacgtttttgttttcatatgtctccaaataaaatcccaatcatattttgtacaaaatttccatttttcattattaaaatttcattattttcaggcagccattgaaaaagattgtgccctaccagaatctggatatccttttgggcaacacacttttaacctctcttaggagatgttaatttgagtgagttttcaccattctatctactgcattcgtaaatttccctttttgattattctagtcatgtaacagtgagctcagcaaaacaaacacacgcacaactccaaagttctatgcttaatgtcagtgataaatttcaccaagtagctagaaaagcagctataataaagaatattctaattagtcttagaggcattatgtggcagaaaatatggaattttttttcttatgccgagtttgctaattgcccccaacaataggtgtgaatctcttttgttatacttgcagaaaatatataggtttgacttccatctgggacactctagagaaatgaaggagttgcataaaacttttaatgctgtgaacagctagacacaagttacatagctgctgaaatgaaactatacaacaatttctctatataaacacattctgaaaacacgttgggtaaatggagatattgttgccaccctagaattgatggtttccataaatatcagcatagcatccatactatcttttaattacaattttaaacctgcgaatataataccttgactcgatggtagtctcagagaatgtatgactatattttattccaccacatataaatttgtagaatagggtcttagtgcttagctctgtgagaactatctaactgtctgatgataaaagttgaggagttgtttctgtgaccaaatatgaacataagaccaattatctgcaaatactcctgtaaggtatatttccagtactgttttatgtttggcaggattgtggtggagaagaacagggagatgttctaagtgtttaaaattatttttacatcctagaatcaatgtcttcttaatatcatactctctggttggaaatcttcagaggacagacactcagtgaataacctttaactaatttccaacccatttgagtatgccaggaaaatagcatcttccaagttctagtctagttgttgtatctgtctgtgttgctttccggctgctatagcccagttaaattaccaagtgctgctgatcctttggagcttttcttaatcctcttttgacctctctaatttgaattattctgtgtcatcaacaaagatgtaacagttaggtctctgtgaaatcacaaactagaattgcaattagagtttcttaatcgttgtgcatattgtattgttgcatggggaaagaaagttttggaatttaattaaaagaaaggggaattgtcaatgtacttaatatgccattatattttttcttttaaaatatggagttaaagaaaagtttgattgtctttaatagttgcagttatctaccaatggggactactgaatacatatgctggggaaattcaatgtcaaggaataatgtatgcttgaggaaagtgtcattaaaaaagaatcagaggattagggattctctaagtttttaaaaatatatatattcttagttcttccggttctgggcccattcctttgtttgtagagttacaaaaaacatgattgtttggtagtaattttctttatccagctctttttttttttttttttggcaggtggtaaagtttattcttgtaatttcttgagaagcgtacagcatattttcatttagatgaagttcaaaaacaaaaataaactattaagtgagttagggctacaaaatgtggtcaactataaagaatatcaagggaaccataaacctgaaatctgggagagcagtttcatctgagtcaggaggaaataagtggatggaatcaggcggaagcacgtagcgtaaaagaaaaattgcaccagacactcattaaaaatggcagagagactttctttgaaacgattgtaatatggattaagactattgcagtaggggagagattgaactagactccattggcacaaaagactggaaagttttcaagcatgaagtgagccagagaacaggtactggaagatggtgggacgatgtgattaggccatctgcatttcctaattggcacttccagaatttaggctccttacccttccacagagactgagagactggggccctcccttcttgataacaacatttcaaagggatagctcccgggtccttaagaaaaacactcctgggctgtaaaaggtttacctctcaaagggcagagtaagaatttacaattgcaagttttctaatgtaagtgctctaagaaaagagaagtcaaaggcctagagtcaggaagaaagctgtctgaagtttagtcaagctgaaaggaacttaaagcctccttggtcaacagtaagcttcagtgataatgctgaagtcttgttttctaaaattaggtgggaagtccgctggtcattgtatcatgacaccttacaccttacacatactttaaacattttctttagtatttggtagaaacagaaatactacttaagtgctacttaatagaaagtaaatcaatagtattcaacagaagcagaaatgtatttaatagcactaaatagaagtattaatagcatccagtagatacagaaatgttcggcccagggtcagtggtgttgcccaggggaatagccttcctgggtaacatacgctgagattgctgagtggacaaggtatttccatgtgccgaatttacacagtgcacctctttcctttttcctggctgcactcggtctctctgaagtgaatggcagtatttttaccctcgatttactgaggaggagactcagtcagagaggacattaattgtttcttcctaatatcacaataaattctcattccctaaggctatgtcactccctagaactaagttatctacttagggaagatcattcgtcactgccaggtctccagggtaacatcaaggctttattgttgcaagtcgacaaatcgcctcccatctgtctgccctgactctgtgactgcagccgcgcggtgccctagatgtttccccagtggtctgaaagaattaatgtgcctccctaaacatctaacttaatgctagggaggggcttaggcaatgggggaaatccgcctggaagagatgttctggatgtcagtaggttgtgctaatctggctgtggtcatggctctattggggagacattgacagtccatctatgtctcactgaaagatctttgtgatatctacaggggcactggggaactaacatttcaagaaaataatagcgccagcaggtacagatggtgtctcagacaaagtttctgggctctccctgaagcttgacatcacatcagtgtgtgtgcaactctgcatgtggttggtgagtacaagggcaagagacagagagggtaggagtcagaccgaaggagctaccgtgctggagcccagtgaaaggtgccaggagaactcatggcctctctgctcagatctcaaaatcagaggaaatgacaaagaaccagaagaacaaaggagaagtgacatatgggaggagacacccaagggaaacgttcaaggtcccaacatgacaccttatttgcagaacatcccccaaaacaaagaaatcctctgcacttgttcagaggatttctgatcaacagcagccaacccacagaagcagcagcccttgggcgctaagcagaagagagaaccaatgaggagccattcacctcacctgctgacgcgaaggctgcttgccagttttaggggttttctatgttgatgagcactttggattgttctgagaaattccccctcaacacaaaacacactctttaatgaagagatcccatattcctggctcaaaaatttgacccttgaatcatttatatcatatcattttgttgtagtccatgaattcatgaaaggcacagagtgacccagggctggatatcagccaggttccacgcagacagagtgactgggatgactggatcccaacactcggtgactctcccattcaccaagctccctagtggtctagaataatacccagccacacacctagcgagggctcatagatcttaaaaagttaaagaactactgccactgagcagatttttcatgtctgtatctgcttgcctgccagatttccttcctcttccatctcattgctgaatttaaaaatacttctaagtctatatacattataattgggtaaaataagaaattcttcgtaatttagaagatgtatctctttcctgaagacttcctcctactccacccccaatctccagagacacatttttacccttaagatccttttttttcctttatttcttctaaaaaaaaaaaatgggatacatgttcagaacgtgcaggtttgttacataggttacatgtgccatggtggtttgctgcacctattgacccatcctctaagttcccttcctctacccgccactccacaaaggcccttgtgtgtgttattcgcctcactgtgtccctgtgttctcaatattcaactcttacttatgagtgagaacatgcttaatcctgagattctgagcaagacaacctcctttagagatgtctattgcttggaatgttttaatctgttagatttttgactgcacatattagctttaagaaattagaattgagcattaacatgttcagtttgttttcactattaatttctccataaattatgttagattgcattttttatagtatgtgcaagtgtatgtgcatatacgtatacacacagagagaggctttgagctaaggatggtggattgcccacatctgtttaaatctccctaccaggaaactagcagcaagcatattacttcttcttaccccctcctatattcctgccaaggagggaatttaaaaactctttcaaggagaaacaggtagccagtgatcatcaaacattagagaaagcattcaccgtgacagaggcaggaaaaagaaaattctaaaagaaaaactctagaataaacaaagacatagtaggaatcataaaaaaactgttaagtgagcaatgctgacatgcctgctcctggtaccattattagcagaaaagtagatacaaaatgctttgatataaatgagacatctatatctatcaggttaacatagagataaagtgaacagatgaatttcaagtgatagaatttcctgtgtgtagcacccacattagaggttataagaggataaaatttaaagtaaatttggaatcacccagtcttacgtcctcattatcagggctatggtttaattgttccccccaaagtgcatgtgttggaaggttgacccccaatgcagggatattgggaggttaagcctaatgggaggtgtttgggtcataagggcaccactctcatgaagggattgatgctgttatcttggaagtggattcatggtcttgggagtgtatttcttataaaagcatgagtttgaccccctcttgccttctgccatgttatgacacagcaagaaggtccttacgagatgccagcaccttgatcttgaacttctgtgctttataaattacccagtctcaggtattctgttacagcagcacaaaacagacgaagacagaaaatgggtaccagagagagcagtgttgctatagtaaatacctgaaaatgtagaagtagctttggaactgtataatgggtagaagcctggaaaatttggaggagtaggctgggaaaagcatgcattgctatgaacagaacatttagggtaattctgttgagggctcagaagagaagaaatataggggaagtagagattactaagttgttgtgatcagaatgttggtagaaatatggacaataaagggcattctgatgaagtctcagacagaaatgaggaatagcttattagaaactggagtaaaggccattcttgttataaattggcaaagaacttggctgaattgttcatgccctagggctttatggaaggcagaatttaagagtaatggactcggatatctggtggaagaaatttctaagcaaaatattgaaggagttgcatggttacttttaactgcatatagtaagattagagagaagagaaatgatttaaagacagaacttataattaaaaaagaagtagagcagaaagatttgggaaatctgtggcctggccatgtaatgaacagccatgtaaaggtgctgccaagcaaccctttaataaagggattagtacagctagaaagaagccaggtgctatttatcaagacagtgggagaattacccgaaggtgttttggagatctctgaggctctccctccatcacaagcccagagctctaggagggcagaatggtttcagaggagagtctcagagtgccctccttggtttctctgcccagggcggcctagggactctactccctgcattccagtgtagcagtcctcgaccactccagctgtggctcaagtgggcccaggtgcagctggtgctggtgctccagaaagtataagggtaatctttggtggtacctatatggtgcttattttgtaggcacacaaagtacattagctgtggggccatggtagcctctacctagatttcaaaggatgtgttggacagcctcagggcccaggcagagacatggtacagacagaagtcatagcagatttcccactatggcgatgcctggtggagccgtgggggtagggcaaaccccacaaccctgaccccagacctatagagctactagcatgtagccccagcctgggagagatgcaggtatgaaactccaacccatgagagctcctatgtgggctgaacccagcaaagctatacgggtgaggctgcctgagactttgagggcccaacctcaactccagtgtgttcagcacaagaagtcaaactttattctggagtcttaagatttagtgttcaccctgttggctttttggacttacctgagaccagctacccctttttccctgcttattcgtccttttcaaaatgggcatgtctatactatgcctgttttagttctaggattatattttggaagcacataacttgtttaacttcacaggctcatagctagagggaaatttgcctcaagtgaatcatgctgttagtctcaaccatttctaatttagataacattctggactttggactttgagttggggctgggatgagtgaagagtttagagtctattgagatagattgaatatattttgcatgtgagaaagacatgaatttggtggaccagggatgaaatgctataatttgaaactgttccccaaagttcatgtgttagaaacttgatccctaattcagcagtgttgggaggtggggcccagtgggaggtgtttggatcatggtggcactgccctcatgaaaatattagtgccattatcttagaagtgggctcatggtttctggggcgaattgcttataaaaggatgaatttggcctctcttgctctctcttgtgatgctttccatgtgatgcttttccaccatgttatgacacagcaagaaggccctcacaagacacggatgccttgatcttggatgtcccaggctccaaagggacgttttcattccaatggaatgaaaaacaattccattctttatacgttactgagtctcaggtattctgttataacagcacaaagtggactaagacgagcagttatgttatttacccataatcatataatatattagctgcagaatcaagtctagaattctgattcctaatttctagtcccatgtgatttctattacctaactccataaaatggatggaaatgtctgattctataaggaatctcaaagttccacagagtcaacatatagaacacataaagccaactttatgtgtttttttaaatgtaaatgtgactgatatctaatagctaaaaattcttatcaaatagctaattgttacataattagcacaagtggtaataattctaattactttctttcagattttagaagagctatgttgagaagatttgctaggcctctttaaaattttatcctaggaagttttaaatgggggctttacttttctcttgttaaattttccttaagctcagaatccagtattgcccactgatcaatattttcaaagatagatggcatagcactcaaacatttgaagacattactaaggccttgtcttgtgagttttcagaaagcagaagtcacttatatcttgctcccctcccccatcatctcaaactatgtcgaaatccttccaaaatggcaatcttcatgtaaagaattatttaaaaggagcagccattggcttctgacttaatataatggaaggaaattataaggcagatagtatgtgtatcagactgtctctgggccatgtccaatccgcagctgtgtgcccacttgttgcttctcttggtttgtaataaattttaatgggttacatctaggtcaataataaaaaataagcacaatgatcattcaattcactgaactctaagtctagctactagtgttccaactcgtataaaatctgtgttgaactataaatacagtagtccccccttgtccgtggttttgctttctgcaatttcagttacctgtggccaaccatggcttgaaaatatacagtattttgaaagagagagagaagaaccacataacataacttttattacaatatattgttattatttttctattttattattctcataatctcttactgtgcctcatttataaattaaagcttatcatagacatgtatgaataggaaaaaaacatagtatacacagatgattcttgatttacaatgttttgacttaaaaattttctcagctttacaatggtgggacagcgatccatgttctttgacttacagtagatttattgggatatgaccccattgtaagtggaggagtatcttttaggatttggtactacctgtggtttcaggcatctactgggagtcttggaacatatttcccatggataagggggaaactactgtacaattgtaggacttcagtatgtaattaggaaaagaaaaattaatttgttttcataaacaaatagatcattatagtttacatctgtaaacaatcatggtattcttctgtcaaaacctttccatatcttcttattagttacaaaatacaatctaaactatagagcatggtcttcaaggcaattcagtctgatgcctcaacctgtccatcaaccccatcaactgtattgtttcacttcaaccccagatgctaatcactccatatcatccagactgccttgaacgctgtatgcatttcatgaatctgtacctttcccaagctgcttccgcagttaaaattctctgatcctttgagactcagttcaagtatctatgatcctaggaaatctcttcaacaccccctctttgtcccctctcgtctcagcagaatccattgtttcttcttcattaaagttcccatagcatctaattctatttttatgaaagcatttctcagtcacaccttttttgccatttctgtttctgtttccctccccaaatggtgaatcactagaggaagtcaaggatcatcttatagtatccttgtgtctcaagagtttagtctacccctccacatgtttggtacccattaaatgtttctttaattggatttatgtaagagcttaagagtatttcccatgatttcatttgatgcccatagaaactccattaagcaggatggtaactgactccattaaagcaagtaatccaactgttttaggcttctccaaagagagagagagaagcaataggatggatggatagatggatggatggatggatggatggatggatggatggatggatggatagatagataaggaatttattaggggaattggctcatacaattatgaaagctaagtcccacaacaggccctctttttgttaaatcctttttgtattagttaagggcctccagagagacagaaccaatagaagatatacatctgtatctgtacatatgagaagagatttattaggagaattggctcatgcaattgggaggttgagaaatcctacgctaggctctctgcaagctggagaaccagggaagctggtagcatggctcagtctaatctgaaggcctcagaaccgggaaaattattggtgtaactcttagtctgaggctgaaggcctgagaacccaggtggccattatgcaagttcaagtccaaaggccagacagcctggagttctgatggccaaggacaggagaaggagagtgtcagcgctctgggagagacaaaaaaagaatttgtcttctgccttttgttatctctgggacctcagcaaattggatcatgcctgcccacatgagggaggatcttcctcactcagtccaccaattcacaccccaatctcctctggaaagacccttgcagacacacccagaaataatttttaccaactctccaggtatttcttaatccagtcaagctgactccttaatttaaccatcacagcaactgggcaccaaaaacagattagtgatttacctccaggtcatgtggtcagtcaatggcaggaccagtaccaacccctaggttttccaatcctccatcgcatactttgcaccatcgttgctcagcacctactgagaagtggggacatggtaaagagctaaggatgcttgcaacccaatattcatgtcacttcttgaggtttcagcagctttttcatgcatgcattggctccatggtcacatacaagaaccctctgctttctcatctaagagtttcagagatgccaaagtaacaggattgaggctgaacaatcaccttcatttctaatgtttttcctcacaaaccaattcagaaattcagaaaacatcttactatagtagttgtttcctgaattactaaatggaagctttattaggaagtattctctgttctttctaccaaggcagctttgttccttgggcataaacaaaactatcccttctctctctaaattgaccacagagccaaccttatataaattagaacttgttagttttggcttcagatgccggctctttctcttgaggttttcacctacttaaaattcacttgttgccctttaaattcacatctagcttaaggcaaatgtttgaatttctaaaataaaaccatgtgcccaaaataagcttagggaaaaaataactgaaataaatggaaaattctccaaaataagcaaaagcattaaaatgataatgctttaactttctgaactaaactgaaaataatgtatgctcaagataagcttacaaccacggagagatctctcttctacaaagccttaaagaaaaagcaggaaattacctcagatgaaacttcattacatggcatttccattcccaggatccatcctcagacacgttgacttaattgctctggaaaagagccccagcatcaatatttttcaactttctaggtggttctaatgtcggtcacaatcaagaaatgacatgaacaatattctgaatcatttcagtagatgttgactgcatgactgtgctttctaccagtcctatcccacaccccgcctttttcctaaaataggtatgcatgcagtgtgtgctctgcacacatgcacatacacaaacacacacacagtttcattcatttgtatattcattcaatcaataagttgaattttgccttcgtgcaaggaaccatgactatcagcacaaacaagaaactattcctgaccccaagagattcccagtctaggtgtggagaatatgaagcacagaaatgggaacaactctaggtaggaaatggaaagagagcaaatttttttttttaagaggcagctgggcacagtggctcacacctgtaatcccagcactttgggatgctgaggcaggaggatcattggaggcaaaatcaagtgtacctaacagttttagaaaattgtacatcgtatacttccactttccatcgtgacttctgttcatagtttatagatgtacaacataaagacataattcctaaataaacaaagcttctgtgaaagcataatgtgactctgcaggcctgctggcctgtcttattattgatctgaaaacaagattgacactactgtgattattctttagtgggaagggacattcatacttatttagccattgctatgctttcaggcaaatcaacccctcagtaactccaggcaaatgaatataggcctttcataaaaagtgtcttggagagaaagcccacaactgcaattaacaggaaatagctgatgcagtgtgacagcaagtccccaaacccttaatggaaggattgactgtcatgtgcatggagatgtggttagagaggaaataagttactgggttttgtaaggcaccaacttgaaaaacatgaaaagctgtggcaggccacaaacatggagcccatttggagtagaggcaggcaagtagaacggagaaccgtggcatttcaaccctagattaatctgagtgtcgcttttgctgccactacttaacaagagtagctgtagagagtgaaacatttttcctaaaatgtcatattttctctggtagctcctgttttcttctttgtatcacattatagctccacaaagttcatgcaaatgcataactaaattttgattatgagaggtctcagaatgcaacttgtttatgggaagaatatcattagtatagtttcaggcaattccttgcaaactatccccagtttaaaacagtcacaccttagtcaacaagcatctattgagcaacccactttcgacctggcattatggtaggtgcaaaggctaaaaaaaggtagaatgagatagaacctccacggaatatatacaataacaaattatttttttaaaaaactggatataacttgagaaactcttctgtacaggcattctggagtgagctgcaatccatcattattcagaaatgcattcatgcattacacctttgtcaagccaagttccaggttctgtgcttggtgctgggaagattgaaaggtcagctgaagttacagaaggccacgatgccagcacagctgctgcctactctttcgcctgatttatttctgttatttcttttacaattgtgattaaaaaaacacataacaccaaattgacgatcttaaccatttttaagcacaagcagagtcacgttcagtgactccacttcagtcaagttcagtagcattaagtagagtcacgtttacgtgcatctggtctccacaactctttcatcttgcaaacccaaactctataccatgaagtatccaaagtactcatatgtatcaaaacagagagtaggtggttgccaggttgccagggcatggtggagggggaagggaggagttgttgcctgatttctttttaaagctcagtcttccctttggcttctggttctaagcgtgttagcatcacggccccttttcattatcctaaaggacagacccagccctggttctgcaggtgctgaattctacttgactccaaagaggctcagcctctacctgcacccaggttctgctaacttggtctaccctctgttgtttttcctctctgttttgttcccatttgtaagatctctgccaaacttacttatttgctgcttttcacagacactagaccataccacctcctgggtattcacgatccatgcctggcccagctgactgttctcttattccaggctgttcgctgtttacctcgtccctcttcagcatcctcaatatgcctgcataatgcatatccatttttctccccaaattaaaagctatggccactgtatgttgaaaaatgcttaaaaccccacctaaacattccaggaagcaggaagccatgaatgactttaaaccaagaacagtctcaaaaatgttgtggtttccagtatgtgagtctcggacttcagcatattgctgttcatatgccacacaaatgttctgtaaagtcccattgagaattatgtgcaaatttaaatgctctccagacaatttcaaatatcagctttgatgcaagacttcacctgctaaaagcatctctttatggtttgacactacatctctgacattttgacgtgatacatattccatcagcctgatacattgccacctcccagtgagtcacagtgtcactaactcagaattaaatatgttgctaaaccactttacagcccttgcaaagcacataaaggctgtttgacaattacccccaggaaggcaaataatcagtacacctctgattctcttattattaaccattataaaatcatgtgctgtgatcaaggtgtgtaacaaagacattgatttttataagactacccaggaagcaaatacatattcttgatatacgaaacacacaggaggcctcttcattttcctttgtgtctttaatttgctcagagctgctcctcatacagcactggctttcacctgtcaagctaaggctttaattactgagttatggaaaaatcattgccaattgccttaactacaataataaagaatatcttacaaaggataagaaatcttttttcttcggctctgtagttaaaagactagttctagttttaatctgaacttttctatttctctccctatatttccctttcttcctattttaattgctggttagataattaagtaggtacctgacctgcaccaaatgtgcttgggaaagtctctcgtattttcgttttgctttgttttgtttctgcatgccattgaaacccctgtgttaattattctttccttacttgaagtatcttatacaacctttcttcaccagtatccttttcactaggccaaatacttattttggagtctcaaggatgattttctaaatcttttcataaccgcttttagcccttactcagttttattgtgcctgcccctcattgcacaaagggatatatttgactattccatggcatatttgactttgtaattcgtaaattatttttcatgtcttacatggttaaagatacgtttcacttgagcttgtaacagacataaaaatgacccatggtaaacctgtcgtattagaaaatcaaacaaaaagcataaggagataacacggtaaaaatgaaaagagtacaagctttagacccgtgtggatccgagttcatatctaacttggccaactaatagcttgttaattatgttaccttaggttgtattttttttttttttttttctaatttagtctcggggtctccgtgttctagctccgacccaagggggttcccgggacgtggttgtggatgttcagtgtgcctttaactggatacttctttatcctggcagacggcctgatgcccaggtgtgacttgtggccaggtgtcccacaaacaggaaaacctgtttacactggcagatggccttgtggcgtgctatagtctgaatgtctctatcctcctaaaatccgtaaattgaaacctcattcctaacgtgatggtgttaataagtggggcctttgggagatgattaggtaatgagggcagagccttcatgaacaggattagtgcccagacaaaagaggcccaaggaagcttgtccacctttgtgccatgtgaggacactgctggaaggcaccatctatgaagcagagagtcggccctcatcagacaccaaatctactgctacctctgtctcgggcttcccagcctccagaactgtaagcaatctgctgttgttgttgtttacaaattacccagtctaagatattttttatggcagcccaaacagactgagacatggcttttgtctgctctgtgtctagtgtatgttttgttttggttcggttttaagtttgtttggtttttggtttttggtttcgctttgtttttgtagacaacatcttactatgttgcccagactggtcttaaactcctagactcaagcaatccttcgcctcagcctctcaaagtgctgagatgacaggcgggagccaccacgcccagccaccctgtgtctagcttattcctaccaagagaatcactctctgtgaaagctctgagcagaaggagagttaggttcgcgtgtgttgctcaggtgagacaaagaggagatcatacagcaaaacacatgaaataacagaagcagcgtttgactcacagatccagagcagagagggcagcctgcctctcagggccaacaggaaaggggagctgtcctggacacgcaggctccaccagtgtggggagcaaaagagatcacaagagacctcagggcctaagactttgttggggtctcaggagttacccaagcaggtttcctgctgagagttctaatgggggtgggtggtggggggcgttacagcaacaattaccagtttcatggagccacactgtgcctgagcggtagtaactgtggcatctccatgcagtccatgcagcgggaggggtcttgggcgtgagtcaggtaggttgtattgagctgtcccctggggaggtgggcactagcagatacctggattgaccgccttgaggagctaggaggaagcagagaactagaaatcatgtcaagattcactaagccctgcatctgctatgagaaagtccaacttacaatcaaaatggatgcccaggcaacataaaattgtaagatttcgctacgccttaggcaatgaaacttggctgccttccagtgaatatttactgagcgtctagcttatttgagaaaccataatagacactacagggactgcgaagaatgggaaataaaccaattacacaatcacccacatagcagcgatacaaggccagccatatcaaacaacccaacagataaacagttcatatgttatatggtgtcagaagtaagacacatcaaaaaatggtaaaatacgtttgatactactgtccttataaaatcaccaaccataggaaaaatgatttttattaatgacagggatataatgaaaatagtttatgtgtgaaaacacataagtaattacataatacattatgatcaaaattagatacagcattgctgggcaagacctttttctcctctaatgctgtccttcaatattattaccaaaatatagcaccagtttttgtttttgtttgaggcagggtctcactctgttgcccaggctggaatgcagtaatatgatcatggctcactgcagcctcaacctcctgggctcaagtagtcctcccatttcagccttccaaagtgctgggattacactcgtgagccattgtgcccagccagtacctggttcttaattaactatatgaaaggcaaaatctgttttgctgctgagcaattatagtactatgcattatgtgtgtgtgtgtatgagtgtgtgtataacatgtagtttatatccatatataaactacatatagtttatatttaattgagtgtagacaatttataggttataatatctttagttataacattcacatgggtgtaattttttatactattctaatttatcattcctttctgttttaccttcaactctggttgaagtaatgtagttactatctgttttccgagttagacttccacttttcctctctggctacctgacaccccaagctagtgtaggtggctatatcattgcctggaattgaagtttttaagcctctgataattcagtctgtagaagctacccagctcaagaacaaaggggaaattacatatttcataacatgcttcaacatgaatgcatttaattagtatttataaatttgaatcaaaatgcaggaaatattctaaaaatataatttctctagaagagttatataatctctattaatgtaggccaactgcttctgtttcaaacacagaagaatgttcttcaatttttcatttgtgaaactgaatagtctcttctgaaagagtatatagtatttttccttttgggaatacaaaagcttttacaaaatgattatactaatcatcagatataagagtagtaccaattctctacctagaatagctgttaaccatggcacttggtgaattgggaatagacttaaatgatgcttctccttgggcccccacctccccaactcctacctttctcgaaaccaggctatttctctccaaatctcctttccttttgattcttcagttcgtgctacatgataactacttgccattggtcattaattatggtcgacgctcattattcacaggagtatgacccataaaatcactgcaaacactgaataagttaatactgaaccattgcccctagagggaattcagggttaagttcctgcaagcctctggtcacagtatattcatcaacctatcaatacataacgttattttatgcatgtttctgctttaagacatcttacttaacatatgtttttgattcattaacactgaactcatggccaacagctctataactaatgtctgaaaaaagcttatctaataggcatgttttccccataaggcacatcacagccttcttgtgcttaggaacactggacgacactcaacactgcgcttgggggccatttgaaacagtaatatcaccaataaaaaaaaagcacaaaaatgtcagggggaaatgtggcagtaaataggctgtgaaaaagacatttgtttgcagtatgagctaaaagaaggcagggcatcaccttgttctacatcagtagggatcatgagtgttatgccactcaatttttttgccagcctgtgtgtacacgtgtcctcaaatgaccatgaaagcactgcaagtatagatttggggattacaaataaatttcaacaagtagatgagtttgcaaacatggaatccgcaaataattactgttgactacaccatccttttgaacaaaaataaaagccacaattcaacttgagattggttatagatggcaactggcatttagtgagcacctgctatgagctgggtgccttacttttttttttgttttgagacagagtctcgctttgtcgcccagtctggagtgcagtggcaccatctcagctcactgcaagctccacctcccaggttcacgccattctcctgcctcagcctccccagtagctgggactacaggtgcctgccaccatgcccagctaatttttttttttttttagtagagacggggtttcaccctgtgagccaggatggtctcaatctcctgacctcgtgatccgcccgcctcggcctcccaaagtgctgggattacaggcgtgagccaccacacccagccactgggtgccttacttttagtaacacattgacctgggatgtgatcaactcgagaaccacatcactgtcatgtagctgcatggagctgtatcactcaacttctgggggcttatgtttcataacaattatcttttataaatgttcaatttaaaaatgaaaaacttccccaccccaatcaccacctcctttccccctctcccttccctttaatgaaccatctaagggaaggacatgtgtgcttctttgacatttcttcacagaatccagtccaatggcagggaggctgggtgagggtcagtgtcagcctagccagtagggaatccatggagctggggcatgtcaggggagtgtctcttactgagaactctgggtcctcttggatcaaagaatgtgcaaattgagctaagagatagaggggaattcgagaagatcacctaaaatgggcaaacaggaggaagctagatccaggtagcctgggagtcaagaacagtgagccctgtgtgagctaaaaaaccagaagcaaaccttggccaatggctggagctggtgtttttgctcaagcctggctttcatgggctccccttgatgtgagtctcagagtagggctggttaagtggccaggacctgagaaataaaatctcccttatatactcttgagagaacaagtctaacatatcagtaaggtaatagctataaaaatgtggctaggccgggcgtggtggctcgtgcctgtaatcccagcactttgggaggccgaggctggtggatcacctgaggtctggagtttgagaccagactggccaacatggtgaaaccccatctctactaaaaatacaaaaaaaattagccaggtgtagtggtaggtgcctgtaatcccagctactcgggatcctgaggcagaagaatcacttgaacccaagaggcagaggttgcagagagctaagatcatgccattgcactgcagcctgggcgacaagagcaaaactccgtctcaaaaaatagaaaaaataagtggctaagtcagtagtgaaactacgaagctaacttattacatttttcaccttttgaactttcaaacttgagtcatttatggacatctttgaagggaacagttattataaactctcactgttgacctaattaacattataatgtcaattatatatgtatagaaagaattctagatatacactcctgctaatatatttctaagattttttaatgttttatgatatacaaatttggatataagaaaaattataaaaccaacaaaattaaaactagtaaagtgaatgtaacgagataggctgtatagttcacaccacacaatgtcgtttagtcgacagtggaccgcacagataacagcagttccataagattatagaggagctgaacatttcctatgcctagtaacatcacagctgttgttaaggtcctatcacaacacattactcctatgtttgtgatgacactggtgtaaacaaacctactgcactgccaggcatatagaagtgtagcttatacaattatgtacagtaatacttgataatgataatatttgactatgttactggtttatgtatttgctatattatattatacattttatcattcaagtgtattccttctacttattttaaaaaatttgctgtgaaacaggcagggtacagtggctcatgcctgtaatcccagcactttgggaggccgaggcaggtggatcacctgaggtcaggaggttgagaccagcctggttaacatgcagaagcctcatctccatgaaaaatacaaaaattagccaggcatagtggttcaccctatgatcccagctactcggaaggctgaggcagaagaatcacttgagcccgggaggcagtttgcagtaagccaagatcgcgccactgcactccagcctgggtgacagaacaagactctatctcaaacaaaccgaaacattaagtgtgaaacaacctcagcaggtccttcaggagggattccagaagaaggcattgttaccataggagctggcagctctgtgtgtgtcactgcccctgaagacctcgcagtaggacaaggtgtggaggtggaagacagtgatattgatattcctgaccctgttaggcctaggctaatgtgtgtgtttgtgtcttagtttttacaacaaatatttaaagtacaaaaatgaaaaaattcaaagtagaagaaaaggctgatagaataggatataaagaaaaaatatttttgtatggctgtacaatgtgcttgtgttttaagctgtgttatcacaaaagagtaaaaaagttaaaagaaattaaaagtttagaaagtaaaaaaagttacagtaaactaatgtgtattaaagaaaagtatttttttacaaatttagtgaagcctaagtatacagtattttttaagtcaacattagtgtacagtaatgttctaggccttcacgttcactctccactcactcactgactcacccacagcaacttccagtcctgcaagctccattcatgataagtgccctatacaggtgtgccattctttttatcttttactctgtatttttactgtactttttctatgtttagatatatttagatacacaaataccattgtgttacaactgtctacagtatttagtacaataacatgctgtacagatttgtagcctgggagcaacgggccatagcatatagcctaggtatgtagtaggctatacagtggcagtttgtgaagtgcattctgtgatgtttgcatgacaacaaaattgcctagagacacactcctcagaatacatctccatcgttcaggctcagcaatgcatgactgtattagtaaactaaatttccactttcaatgagaattttttcagtgtagcttgttttgagttcattttgcctatacactataagtttgtgataattcaattttgctactacttttttctaatcaaactactatcaaatctccacccacagagcatacttttatgtaatttgctttcacttgggccaaatatcatttttgtattaagttggcctatgttcttttctcaataggtaaccaaaattaaagcagtagcatttggcagcaattacaaacagaaatgagagcatttatgtcctggcgggagttggttgttaagtggccatccggaagttatgcaatatgttttctttctcttttcttttctgtttttttttttaagattgctattgaaatgaaaacagaaactgcaccaactgatgttaaagataaatacaaagccatcgtaattaaaagagtatgtcacaaatgcaagaataggcagaaggatcactggaactgattagaatgtcagaatactgtttacataagaagtagtgcatactgaaactggcaatttaaatgaacggggatcctgcagtgtaaaactctgaaataaacaaacaaataaataaacagggatgaagacaaattttgctaagaaaattatgtgactatactttaaaaaatagtttctattttacgttagatgctaaaatgaattccaaagaattacagacttcaatgtgcaaagaggaagaatgcatagaaaagtgatactaaaagcaattcagtatttttctgttctctaaattttaaaaagcccttgtggctgggcacagtggctcacgcctgtaatcccagcagtttgggaggccgaggcgggtggatcacgaggtcaggagatggagaccatcctggctaacacggtgaaaccctgtctctactaaaaatacaaaaaattagccgggcgtggtggcaggtgcctgtagtcccagctgctcgggaggctgaggcaggagaatggggtgaacccaggaggcggagcttgcagtgagctgagatcgcaccactgcactccagcctgggcgacagacagagccagactccgtctccaaaaaaaaaaaaaaaagcccttgtaagcataaatacaaaggaaacttggtagatatggcaacataacaattaaaagttcatgtaagtacaaaaatcaacaaattaaaaactgagaaactggaaaaatatttgcaatacattgatataaaaatcataatatgtttttaaaaacttttaaaaactagcaacaaaaagtaaaagatgaacaaccaggtgatggaaaaaaaaaaaaaagatccagaattgttcagtaaaggtgtaaaaagtgtttccaatcaaagaaatacaaactgaaacaagaatataatattttattttggttttggttttgtttaataagcagaaaatggtgaggcatttttgacaagcaattttgcaagacagatcaataatctttaaaacgtatgtagttcttgagcaaggattttcacctctaaaattatatttcaaagaaataattgtagaccacatgcaagattttttttacagattatttgtcataaagttatatataattgtgaaaaatgcaaatcaatgatatctgtcacccagaaaggaaggaaatggttaaatacatttaagtttagccgtataacagtattccttaaaaataagtctcctaggccaggcacagtggctcacgcctataacccagcactttgagaggccaaggtgagcggattacttgaggtcgggagtttgagaccaggctggccaatatggtgaaacctcatatctagtaaaaatacaaaaattagctgggcatagtggcgcacgcctgtagtcccagctactcgggaggctgagccaggagaatcgcttgaaaccaggaggcagaaatttcagtgagcctaaatcacgccactgcactctaggctgggtgacagagctagactccgtctcaaaaaaacaagaaacatcacctaaaaaaaagtctttgaagactattaacatggaagcatgataatggtataattttaataagaaattatgatagaacactgatagaatattatcccagttttacaattccacatgtatttacatgtacctgggaaaattataatgaaaatgttaacacatttttttcttgtcagtaagtgcaggggaaccttacattttctttatggttttctgattattccaaatattgtaaaatacacattattcatatacttttaaaatgtggatcttaactgttttcctttaatctgctatcttacctttttaaatctaggaaatgtatgtatctcaaaatggtaaaactgaatatttaatattctagaaattaatgttttataaatcttaattttcttctcagtaatattgtataattttaaatattggcagattgtcagctatggctgtgcctatttaaagccaaaactcctgccaattttgtgaaaacttacgctcattatctagatttttgtttgtagtacgataaatattttcaccgtactttacctgctttggcaaaagatagatggcagaagaaggagctgattaaataaccaataaatacaagagaaaatctgggacattttttgcttttattattactttttataccattatgctggtaaattatttataatattatgattatgctaggattatagaacgaaaggtaataagttttatggattgtcagtaataataattactgtaaattgtcttttaaaataatgaaggctaaaatacttaggtattgagagtgttttcttcttgctactctgtgatgtatcgttgcagcaggctgagataatggaaaaggctgagagctacaagccaaaaagactgggtgttgagtctctaattccacttcttttttttttttttttttcaagacagagtctagctctgtcgcccaggctggagtgcagtggtgtggtctcagctcactgcaaactctgcctcccgggttcacgccattctcctgcctcagcctccagagtagctgggactacaggtacccgccaccacacccggctaattttttgtatttttagtagagacagggtttcaccgtgttagccaggatgttcttgatctcctgacctcgtgatccacccgcctcggcctcccatagtgctgggattacaggcgtgagccactgcgcccggctaattccacttcttattagctctgggattgtggacaatttctctaggcagagcttcctcgtctgtaaaatatgaatgagtctaatatgtatgcatctagtaatctgatttaatcacaaaatgggactagactatacagtccttaaagaatctatcactatgacttctctcagtggcctttttttttttttttttttttttttacagagctggataataaagagcttagaattttattcctgaaaggcaactagagtgctaggcattctgggtttctgatagaagacatgcacataagctttagcaaacactcagaactctatgctccctaactacaacttcgccagagtgcagaggccaactcttttcctttaaaaaactaactccaggatgtgttcacatggtcaataagatctatagttctttgctgatcatcccctgggaaacttttaaaatgaagtctgacacattacaaaccatgcacagaaacaaacaatatcagtaaaactctcaagtaatgcgtggttttgagccatgtagagtccaggtaagccttccaagcttggttaggtgcaaaacatactttctccagtatgtaaattaataggaatctttttttttttttttttctgagatggagtctcactctgtcagccaggctggagtgtagtaccacaatctctgctcactgcaacctcttcctccctggttcaagcgattctcctgcctcagcctcccaagtagctgggattacaagtggacaccaccacgcctggctaatttttttgtatttttagtagagacgggttttaccatgttggccaggttggtctcaaactcctgacctcaggtgatctgcctgcctcggcctcccaaagtgctgggattataggtgtgagccaccatgcccagcctataaataggcatctttgatggccttttaaaacaaccagactttgtaggctatctgcaaaagataatagtttgaaattttaatatttatttaaatagtcctcctgatggtaactgatcactaacttttgaagtgcgttgggttggactcagtaaaaatctcagcaatagcttataggaaattattcttctgttttctaaggcaggaggctatgcacccgtgtcatctaaaagagtggcccatggtgctatggagcaagccaaatcttcattgcagtccagttctgtcatttaccaaatctgtgacctccagagagctgttttattaatctacccctcagcttcttcatctgtaaaatgggacaatgatagcccttctcttccagattaggcacctaatgcagaacctagtgagatctaaatatatattagctacatctattattatgtttataaagacaaaggataaatggtagtcctgttttgtcccactcaaagctgttctctgagccacaaaaagactgtttcagctgcatgccaagttaacacattgcagttaagaaggaaaagcattgcagttaagaaggaaaagcattgcagtagagactagtccgtgaacatctttgtcctcaccattcctatcgccttcttttaaatgaaggaggcagtgggtttcttatattttggtccccatgattttgcaatttatagccttgataacctggccacagctaattaagccaaggttcggggctcattccttaggccgtgatgtgcaacttggcctgtaccctctaacatggcttctcatgagaactctacctaacagaaagttctgtgttgaatagcgatgaacggattcactccaaccttctctcagtgactttgaataaaagatatgcagactgtatagcagcctaaagagtgggctctgttccctcgcaaattttagcatactcattgagaagggagggagctttggggagacagtgagagaagagaatttaaacattgtgggcaatttcttctgcccttccatttgctgtggaattttccagccattttatgttctgtggatttttcatgcttgatatggttggtttctgggatgtgtttcagtcaacattgacccaaaaaccatgcagtcagttttctgtctaaaagccaaagctgtaacctcactgatattgcagaaatgtttctatcactttctgacccctaaaagtgcatgtctcttagatcatagctttgctggtatcaagattacatttttaacagtataaaccttttacatatgcagtagcaattagaatgctctccccaagaggaggacattctctgaaatcccaagtaggagtgaacccagagtagcatagcatatctgctaacttgattccatctgtctttgttgcaacatgctcactgagcatatgcccctaaatgaatatgagatgaagacaggatctgtggtccctcccgcaacattgatggggtaagtttttttgctaggctgagtgtggttcaaatatttttgtacaatatatatcctaaacacaaacaactacttcgtctgttgcccacccaaaaatatgctgatctgttttgtgctgaagtatgatcgttcgtgttggcgtccttgagaagtaatgggataaggtacttgaagggcgatttaagagctttccagagcagcccttggcttttcttaattttccagttttgcaacaacttttagagcccaatcctcatgtaagctttggatccactggaattaaaagctcagactttatagacaaacagacctgggtttgaatcctatttccatcacttgcctttaggaaagttgctcaacttttctgagtcttcattttctcatctgtgcccaccctcttattgcagtgaggcttgagtggtattcacagccctcggtgcagtcacttccatacataagagccactgttgttgttaacatagtttagaagttaagagagtcacaggcgtcgtaaaccctcagatagtaccagtcatgaggaagcagaattcactaagcggtgggtaggagggtgcacaagtagccaggtatacaagtagccgggagctgctgagtgtcccaggtctccatgaggatcaatcgctcaatagcttggatagtctgcgtgtggataacacatcagcaaggaatagagacaacgccttaaaacagactttcagcatttctggtgtcgaaaggtcctaacatgaggtctcactaaattcgagatttcatcagcctgagaagaactcagggtaaaataagagtagtaatacacaccccttttaacctgggttagaatgcgtttatgagtgtgaggtgatcttcaagtataaagccctatgtggatgtaacatgatagcagattataaatattaatagcattttaagtcaaagataactatttagaattgtgaataatagagaagaaagactgtgggcatcactgtacctcctaccctcagttaaaacttactgaaggaactgaaggttaaacattcttgataaccattgtatttctgcagtgtctcagaagtattactagaagacaagcatgggatttagagttaaactaaccttgggttcaaatcataatgctgccactccttgactgtgtgatggtggagaagttatttcacttctctaagcttcaaattctctatcagaaatgttttttctgtagctatctgcttaggaacaaagagaaaggcagcttcctgcatgactcagcttccagcttattattattattattattattattattattattattgttattatttgcttttgacaaagtgaactgaggtcccaagtttttatttccctttcacagagtcaagtttattggtataatcctgctaagaagtacttaaaacaaaaactagctattcacaaacaagtcaaatatataccctctagagtgtgttgataacgtgacttagtacatgaagagagagcatggtgttcaattgtgcaggtcaggtgaagctagtctttcatgcctcatcacaagtagcagatttccattaagaattggcaagctctcaaagctcagactctcccagagcagagcaaacaggcagatgcgaatacatgcctatcccagcagcatctgtttatgccagtggggagaaaccatcccctccacacacggttaaacaagtcagtgtgcagcctacctccagggcccttctcgttttgcctgggaatgtcctgggtggcttgtaggagatgaggatgcagcttggggcagccaaacctggggcatttcagaggcagagtataattcatgtggcaatacctggctctttatggcccgtagttttacacctaccatcctctgcacacagaaaactttaggcagaaatggagcatgcacaaccaggtctgcatatccgagagtggtcatttccttgcaaggcgtgtcgcttgactgaggggactagggggctgcagaggggctggcagatgtttggcttttggtgcagatatgagccaaataaattgaaaataggaagaaggagtacatgacctcacccaaattttaattcccatagaatagttttttgtttgtttgtttttagcgttgtatgcctaatagggtaaatgttattcaaaaaatagcccaggtgttagaaagacaaaatagttgttacctttagggaaatggttgtgaacaaaaggggcacacagggggtgtctgggccactaataatgttctgtttcttgatgtggattcgagttacatgggtgtgtcactttatgaaaattcatcaagggccatcaagggctcggtggctcatgcctgtaatcccagcattttgggaggccaaggtaggcggatcacttgaggtcaggaattcgagaccaacctggccaatgtgatgaaacccaatctctaccaaaaaaataaaaaataaaaattagctgggcgtggtggtacactgctgtagtcccagctgcttgggaggctgaggtgggagaatcacttgaacccaagacgtggaggttgcagtaagtggagatcatgccactgaactccagcatgggtgacagagtgagaccccatctcaaaaagaaaacaaaaacaaaaggtctggcacggtggctcacacctataatcccagcacttttggaggctgagcagactaggatcacctgaggtcaggagttcgagaccagcctgaccaacatggtgaaaccccttctctactaaaaatacaaaattatccgggtgtggtggtgcatgcctgtaatcccagctactctggctgaggcaggaaaatcgcttgaacccgggagagggaggttgcagtgagctgagacggtgccccattgcactccagcctgggcagcaagagcaaaactctgtctcaaaaaaaaaaaaaaaaagaaagaaagaaagaaaattcatcatgctgtatacttataatctgagtatttttcttcatgtaggttattaaaaaacagcagaaatattcttctctcaaaagaaatttctatattttaaaatatgcatatttatactatacatatatttatatttaaattatatatatatatttagtaaggaggggaatacatataacttgatacaaagtctgcactaagttagaatatatctaatgcaaattaatacttgagtgcatattaagatatatcaaaatttaaaaattggtcaaggtttttaagtgctttgacagttacagtaaggtaaggttctacataaaataacatgagtattgtcagcttccaccttacatttccaggaatagtcatttttcatgcattcattatattcttttcagcatcatttgcagagtttttgaacttctaagctgtaccacacagaaatgccataacactcattttgactatttcaacaaagtattataactaagccattaattgatccactagctttgctgttgggaaaatttacttattttgtaaatacagccacattgacttttaaagtcatctaaataagcttgttattaaataaaaatgttttgaaccttaaaactgctttaaatgattttaaataaatggtttatatttttttctcagtagtaataatttttctgaagtatttgcttattgtttttaagtgatttctttatacatatatatgtatatttacatactatgtgtatatattaggcaatattaaatgacctgaagcttttgatcaattctaatagaacagacaattgcaattctaaattagctctcataaaatggaacattttgcaagtagctaataaatatttgttgatcaatagttataccttgaatcctttatctattagaattttccagacaacaaactcatattgtttctcctttaggttcatttggatgtatcaacatagtaactcttgttacaaaaatattttaagtttaaaatcaattatttggttaaattctgtatgcatattttaatagttaatagacaaggtaaaatcagctcacttccatgtgttcaatatttattgcttgaaaattaaggcttataaattagagtatgctaactatgcctttttgttatagatcctcagcgctgttggttgtattatggaatagttaagtataggctctgctctccagacaccaaaggtttaactcagctctgtctttcaccaggcttgagcaccaaaggggaagtcagagaaaaagtaacagcaagtgaaataaaaatagaattctcaaaagcaatagttgaaagacaagaccacagaatggtatgatcaaagtgttgagagaaagagaaacagaaattgagagtttgagaccaaaaggtttttcattaaagcaatctctaaaggatttacttaatttttttaaataaaagaaacccagaagaaatgtctgaggtgtaagaagtattgatcaaagacattaatgaagatataggttaaaggtttttaaaactgtgtaataaaatattaacatcaaaattaatgtgttttaaaaaggagtaaatgaaacaattaaaaatgaagtctgttagaaagagaataatcaaaattacagttttttaagatccttgtattttaagaggatttaaaagagtgattaactttagactttcttaagtatgtaagatagaattccaaagtgcccactttttaaattttttattatttattttttgagacagactgtcattctgtcacccatgctgtagtgcagtggcatgatcttggctcagtgcaacctccacctcccaggttcaagtgagtctcctgcctcagtttcccaagtagctgggactacaggtgcacgccatcacgcctggctaattttttgtatttttagtagagacgaggtttcaccatgtcggccaggcctatctcaaagtcctgatctcaagtgatccacctgcctcgccctcccaaaatactgtgattacaggtgtgagccaccacacccagccttcaaagtgcccacttaatattaaataatatataacttcaaaaccagaatgggggaggaaatggattaagaaaacaaatataaatcatctattcagaaagactaaacaatataagacaataggaacaagtctgtctttcttgcttttacatgtgtgcatgtgtgtgtgtagtctagatacctagatagttagataaatagatatagatagatagataaacagatatagatagatagatagatagatagatagatagataaacagatatagatagatagatagatagatagataaacagatatagatagatagatagatagatagatagatagatagatagatagatagatagatgatagagagagagagagagagtgtgtgtgtgtgtgtgtgtgtgtgtgtgtgtgtgtgtgtgtgtgtgtttagtccatggcagtggactaaatatactagctaaaagatcttgtcaaattagtttaaaaagaagctaagtggtttttttaagacacatctgaaataagaggactcagaaagcctgaatggaaaataatgaaaagagacataatatgcaaataataattaaaggaaaaaccgggtaactataatagcaggtaacaaagacttcaaaaacctttttagaaggtagaaaggatactgaattatggcaagcgattcattttgccagaagaacttagcaattttaaacttgaattcgcaaaatactctcaaaatatataaagcaaaaattgacagaagtgcagggagaaattgataactcaaatatcatagaagaaaatgtggcatattaatttcagaactgatcatttaggcacacgacaataagtaaaaatagaggtttccaccaatataatttaaaaacttgattgacataaagtctaaacaaaataaagaacacacattcttctaagatataaatgaaatgtttaaaacatttatgactttctaggggaaggtatcttaaaaatacttagaactgaaggacaataaataatcctataaataaatattcatgagatgcaagacaaagatagttgtagttattttacactttaaatgcttaagtaaaaaatgagttaaggctagaaactcatagctaaattcaaataaagtaaaagtatgtgatgatgtaagagcagagcttaatgaaataaaacttgaagttatagtagggaggatcaacatagtcacaagttagtttcttgaaaacagaaaatcctccagcaaaattggttaagaaaaaaggagaacaccacaaataatcaatacaagaaatgaaaatggagataattataggtagcagacactttaaatgacaataagagaataccatgaacaaagctggccaaagcatttgaaaatttaggcaaaatggatgaattccatctatagtatatatgtatcagaatattatttttattgaaagatattgtcactgggtatcgagttctaggttgacagttcattatttttttctttcttattttaaaggtgtggtcctactgtcttctggattgcattatttcctgtgagaaatctgtcattgatatgtttgctcctttatgggcaattgtgtcctttttctctggctgcttttaagaatggccttatgatatacctcagtgtagtttcttccattcatgttttaatttaaagccattatctcttcaaatattttcatcactctcccaacccccacttttggaaattcccattatacatattgtaccacttgactttgccccacagctcattggtgctctttccttttttcttttttcttttctagtagcttttttttcctctgttttttattttggatagtttctatcactgtcttcaagttatctaatcttttcttctgtagtgtctaatctgctgttagccctttccagatattttttctttttttaatttttttttttatttcagtaggtttttggggaacaggtagtgtttagttacatggaaaacttctgtagtgggtgacaacccactctttgggttgtctgtttactctgctgattacttcttttgaggtacagaagctttttagtttaattaggtctcatctatttatctttgtttttgttgcatttgcttttgggttcttggtcatgaagtctttgcctaagccaatgtctagaagggtttttctgatgttatcctctagaatttttaggatttcaggtcttagatttcagtcttcgatccatcttgagttaatttttatataaggtgagagatgaggattcagtttcattcctttgcatgttgcttgccaatcatcccagcaccatttgttgaaaagggtgtccttttcccactttatgtttttgtttgctttgtcgaagatcagttggctgtaagtatttgactttttttctgggttctctattctgttccattggtctgtatacctatttttataccagtaccatgccatttggttgactgtagccttatagtatagcttgaagtcacgtaatgtaatgcctccagatttgttatttttgcttagtcttgctttggccatgtgggctcttttttagttctgtatgaatttaggattttttttctagttctgtgaataatgatggtggtattttgatgggaattgcattgaatttatagattgcttttggcagtatggtcattttgacaatatttattctacctatccacaaggatgagatgtgtttccatttgtttgtgctatctatgatttctttcagtcctagccagagcaatcagataagagaaagaaataaagggcatcaaaatcagtaaagaggaagtcaaactgttgccgttcactaaggatatgattgtatacctagaaaaccctaaagactcatccaaaaaacctcctaaatctgataaatgaattcagcaaagtttcaggatacaaaattaacatacacaaatcagtagttctgctatacaccaactgcaagcaagctaagaatcagatcaagaactcagcctcttttataatagctgttaaaaaaaaaaaaaaaaaaaactcaagaatatacctaaccaaagaagtgaaagatctctacaaggaaaactacaaaacactactatcttttgtatttttgtttcagtttcattgagttttactccgatctttgttatttcttttcttctgctgggtttgggtttgctttgtacttgtttctctagttccttgaggttttaccttacattgtctgtttgggctctttcagactttttgatgtaagcatttaatgctatgaactttcctcttagcaccaactttgctgtatcccagaggttttgataggttgtgtcattattatcattcggttcgaagaattttttaatttccatcttgatttcattgttgaccaaatggtcattcaggaacaggttatttaatttccatgtatttgcatggttttgaggattccttttcaagttgatttccaattttattccactgtagtctgagaaagtacttgatataatttcaattttcttaaacttactgagacttgttttgtggcctatcatatggtctatcttggagaacgttccatgtgctgatgagtagaatgtctattctgtggttgttgggtggaatgttctgtaaatatctgttaagtccatttgttctaggatatagtttaagtccattgcttctttgttgactttctgtcttgatatccagtgctgtcagtggaatattgaagccccccaatattgttgtgttgttgtctatctcatttcttaggtctagtagtaattattgtccaaatttgggatccccagtgttaggtgcatatatatttaatattgtgatattttcctgttggactagtccttttatcattacataatgtacctcttcgtcttttttaactgatgttgctttaacatctgttttgtctgatatatgaatagctactcctgctcacttttggtgtccatttgcatggaatatctttttccactcctttaccttacatttatgtgagtccttatgttaggtgagtctcttgaagactgcagatacttggttgaattcttatccattctgcaattctgtgtcttttaagtggagcatttaagtcatttacattcaacattagtattgagacatgaggtactcttctatttatcatgctagttgttgcctgaataccttgttttttgtcaccgtgttattgtattgtatgccctgtgagatttatgctttaaggaggttctattttggtgtatttcaaggttttgtttcaagatttagagctccttgtagcaattcttgtagtgctggctttgtagtggtgaattatctcagcatttgtttgtctgtaaaagaccatctttctttcatttgtgaagcttagtttcactggatacaaaattcttggcttttaattattttgtttaaggaggctaaagatagggccccaatcctatctggcttgtagggtttctgccgagaaatctgctgttaatctgataggttttcctttacaggttacctgatgtttttgcctcacagctcgtaagattctttcctttgtcttgactttagataacctaatgactatgtgctaggtgatgatctttttgtgatgaatttcccaggtgttctttgagcttcttgtatttggatgtctagatctctaacaaggccagggaagttttcctcaattattttctcaagtaagttttccaaacatttagatttctcttcttccttgggaacaccagttattcttaggtttggtcatttaacataagctcaaacttctttgaggctttgttcattttttaaattcttttttctttttttctttttttttagtttgagatggagtctcactctttcgcccaggccggagtgcagtggtgctatctcggctcactgcaagctccacctcctggattcacgccattctcctgcctcagcctcccgagtagctgggactacaggcgcccaccaccacacccagctaatttttttgtatttttagtagagatggggtttcaccgtgttagccaggatggtctcgatctcctgacctcatgatccgcctgcctcaacctcccaaagtgctaggattacaggcgtgagccaccgcgcccagccttaaattcttttttctttgtctttgttggattgggttaattcaaaagcctcgtctttgatctctgaagttctttcttctacttgttccattgtactgaaactttccagcgtatttttcatttctctaagtgtgtctttcatttccagaagttttgattgtcttttatttatgttatgtatttctctagagatttttttgtccatatcctgtattattttttaaatttctttaagttggttttcacctttctctggtgcctccttgagtatcttaataatcaacctaccgaattatttttctggcaatttgaagatttcttattggtttgaacccattgctggcgagctagtgtgatcttttggggtgttaaagaaacttgctttgtcatattaccagaattgtttttctggttccttctcatttgggtagaccatttcagaggaaagagctggggtttaagtcctgctgttcattctttggtgccatggggtgatgccttgatgtggtgctctccccctttccctagggatggggctcactgagagctggactgcagtgattgttattgcttttctaggtctagccacccagtggagctactggactctgacctggtactggggagtatctgcaaagagtcctgtgacatgatctgtcttcaggtctctcagccatggatcccagcacttgctctggtcgaggtagtagggaagtgaggtagactgtgtgagggtctttagttgtagttttgtttagtgcatgggttttcttgaatgttggttgtgctagcagttagttggcctccagccaagaggtggcacttttaagagagcatcagctgaaacaagcttgtcctaagtttgcctgaataggtatttgggcttctcaggtgatgggttggaccatagcgctcccaagagattgtattttctgtcttcagctgccagggcaggtagggaaagaccactgggtggagccaggattaggcgtgtctgagctcagcctccccttgggcagggcttgctgcagccactttgaggatggcggtgtggttctcaggccaatggagttatgttcccagggggattatggctgctctgcagtgtcatataggtttccagggaagtgggggaaagtcgtcagtgactggcctcactcacttcccacacagccagcaaggccagtctcactcccactgcaccccaccgatagcactgagtttatatccaggtgccggtgagcagagctgaggtcttgtcccagactacaagcctcccagctgagaaagcaagcaggactttcaggccccacctctccccacctgctgtagcttctttgctcatatctacactttctgttcaccccctaccccacccctgccccagattgtgcccagaaaaattcatatttggtcaaaattattacaaagttcagctagaagtttccttttccctgttgtctttccccagttccactggcagccctccccaagaacctctatgaggtaaagtcagaaacggcttccctgggcaccaggaatgcctacagggctctttctgctgcttcttctagttttatatttcactgggctctctaaattcatttcagctctaggtaaggttaaattcttctcctgtgatctgaatttacatgttccccagtgagggtatgtgttcagaagtggactttccctcctcacgctttgggcactcacagtgtgaatttcactttgttgagtgtagatatttttatatcctatattatgcttaagctttgttctgggatgaaattaacttattgaaaacagttgatcctttggagacttgcttttagacttcatgaggtgagaccagcacagcccttttctagggctgattttttcccaataatgttataatttccttttgagtactgtacctaataccctgagttacaaggttttgcactcagactggtgggaacatgaattattcttaatctgtgtgagtaggttgttccctcagctcctttcaggtgagttttctctgacccaggttgttttattacacacatgaatttattggtaccttgctgaagacttaagggacacttctgcagatcacttaagttttctctctgtacagctctctcctgtctggtattctgttctgaagaccctagactaccaactctgtctcctcaagtaaggagctcaccaggttcctaagtttcccttccctgcactgagacccagaaaattttatcaggcagtaggctgaagcaattgtggggttcacattgtttgtgtctgtctctcagacataactgccctgccctgcctgatctctatgactgttttatatattttgtccagtcttttagttgtttcagacaagagtaagtcaaatcctgctactccttctcggctggaagtagaagtttctagtcttatgatttttaactgttgtcagctaattaaaatgtaaagttttataaggacttcataagtgtatgcaaatgctcctaaggctttcctggatgtcagtttaggcccccaggcttcaggattaatctttaattaatactctgagtggagacagggaaaagaagggtgaatgaagtttctgtggtctaagaaatcccaatagacaacttctggagaaatgacaagagagggacataagcaatcaaaaagaagggcgaggccgggcacggtggctcacacctgtaattccagcactttgggaggccgaggcaggcggatcacgaggtcaggagattgagaccatcttggctaacacggtgaaaccccgtctctactaaaaacacaaaattagccgggcatggtggcgggcgcctgtagtcccagctactcgggaggctgagacaggagaatggcgtgaacctgggaggcagagcttgcagtgagccaagattgcgccactgcactccagcctgggtgacagacaaagactccgtctcaaaaaaaaaaaaaaaaagaaagaaagaaagaatggggaggggacatatgcatctccatctcaactctctaaaactaagactcagacagagattttggtgaaaaatgtgtgcctaataaaatacttgctctaaaaattagattctagatattatctgaatatgtgccagtcactattctaagcattttacatatgtggatgtatttaattctctgacaactgcataagtaagctattatcatctccagtttatggataaagaagcaggctaagcaaattccccaagatcccatagttaaaaaatggcatggctcagatttcaatccaggctctgtaactaatatattatctgctaagaatatcagtcttatcatgtttagttctctggcttaaagtccacaacataataaaagtgaattgtagatgctgagatgaagatattaaatgtaaatacaacaaatacaaggaaaaataaaaactgacaatttgtttaaaagggcaaggacatagaatcctctgaaatagacattgcactgagaagtctatcactagcatattaaggaatgaagactcagataatgaacttgctgttaaaaaagcaaacctctgttaataacttttaattaaacctttgattatatttttaaatgttttttatttcttaaaaaacagttttgggctgggcaccgtggctcatgcctgtaatcccagcactcgggaggccgaggcaggtggatcacctgaggtcaggagtttgagaccagcctggccaatatggcaaaaccctgtttctactaaaaatacaaaaattagccaggcatggtggtgcacacctggtagtcccagctacttgggaggctgaggcagaagaattgcttgaacccaggaggcaaaggttgcagtgagccgagatcacaccactgcactccagcctgggtgacagagcgagactccttctaaaataaataaattaattaattaaattaaataagaaacagttttgcatttgaataattctgacaccaaaataatttttatcctggaatacactattcaatagtggtaaactttgttatatggaaaacatttcttatttctgagcaatatcaggtaaatgaatcaggaattatttgaattagaaggtattgttactaaccccctcatacctccaatgtactaaaactaatacatcttaaaattccttttaatcatttaatttttcttttttccaaaattttccccacataaataaagtagaatttagcctcttctacttcaaaaataaagtattttctaacaatgtttatcattataagtttctcagggctcaaatgtagaacatctttttgatagcttttcactctttccccaaacatatcccagttttatgagaccaagtacaaatatcttcctgtcacacatcatcaggagaatcttgccaggtgcagtggctcacgcctgtaatcccagcactttcagaggccgagacgggcggattgcctgaggtcaggagttcgagaccagtctggccaacatggtgagaccccgtctctactaaaaatacaaaaaaaaattgctgggcatagcagcaggtgcatgtaatcccagctactctggaggctgaggcaggggaattgcttgaaccaggaggtggaggttgcagtgagccaagattgtgccactgcactccagcctgggtgacagagcgagactccatctcacacacacacacacatacacacacaaaatatggataaaatatctagtgtgagaggaacagcagaaggagaaagtaatgtcttgaggaaggtgcgaatcatctgtaaatactttttagagtaatggaattcctagacagacagcttcgcaggcagtattgccattcagtatcattggcaaccttcctaaaaggaaaagagtaatgttaatgccatttctgaaggtatgaattgaggattttgattctttttccataaatacttaccttgtgaaaactcctctgcaatctctactgtcagtaagttttataaatgctgtatacaagtcttcaattcaccattgcctgcttgaggcttatttattttttgagaaagaagctggagaagtcatttgaaaattcatgggtagttcactcttcaaggttgtggtgtgctcttcaaatagctataaaaatttccaagagacaggaccactgaccctgcgcttcgtagcaaatagctttacttactcattatctgactagcgtattagttaatcatgtaaacaattatctttcttttcaggtggcaataattcatggcatctcctcccccttccaccccacacatatacttatttattgtcacagcctgatttataattgttttttaggatttcttcatatcctccctcctacctttacccctgagttcagaaaataataaacactctaaatctccaagcaatggaactcttctaagagttaagctaaagtctatcctaccaccttgctatattaatgtcagctcatttgatgtgtctgtagagcaggatttgtttggcaagctttttctgtaaaggaccagatagtatttcaggctttttgagccatgtggtgtcggtcacaacttttcaactctgccatcatattgtgagagcagaagtagacaaggtatgtttaaaaaaaaatgggtatggttgtgctccaataaaatcttttttatagacactaaaaacttgaatttcatgcaaattttatgtgtaaggaaataattttttaaaaatctcttctttaaccttttaaaaagacaaaagccattcttagcctgtgggtcgcacaaaaacaggcagcaggccatgggccatagtttgccaacccattatctaaacggttaacagaatgcttactacaggttttctgaccctcagcactagtaatactttgggacagataattctttgttgtggactgtcttttgtttttgttttgagacagcatctcactctgtagcccagactggagtgcagtagtgcgatcttggctcgctgcaacctccacctcccaggttcaagcgattctcctgcctcagcctccccagtagctgggattacaggtacccaccaccatacctggctaatttttgtatttttagtagagatggggttttgccatattggccaggcttgtctcagactcctgacctcaggtgatctgcccgcctcggccccccaaagtactgggattacaggtgtgagccaccgtgcctggcctgtcttttgtattttaagatgtgtcatatcatctctggcctctgcctactaaatgccattaacaccctacatcccccaattgcaacaactagaaaatctacagacattgacaaatgacctttggggacaaaattgcccccagttgaaaatcactggtctaatacactgaaaacttagaatacaccgcataaaatatgagctggtaggctgcgtagtataagatagcgtcatgtgtcacctgagagatagccattggattctcatgcttctaatgtagaaaccataataccgtggtcttccccttacctacagtttcattttctgtggtttcagttaccagagatcaaccaaagtctaaaaatattaaatggaaaatttgaaaaataattcatcagttttaaattgtgtgctcttccaagtagtatgatgaaatcttacaccatcccaccagagacttgaaccagccatttgtccagcatatccacgcggtagctgctacctgttcctgagtcacttagtagacttctggattattggctcaacagtagaggtattgcagtgcttccattcaaaaattccttactttacttttattatggtatattattgtaattgttctatcttattagttactgctgttaatattctattgtgcctcatttataaattaaactttacatagatgtgtatgtattggaaaaaaatatggtacagctgacccttgaacaacacagatttgatctgtgtagtcttcttttatgtgttttttttttcaataaatacagcaggccctccatatcaatgggttctgaacctgcaaccaaggcaagacacaaatatagtattcacaagatttgaaacccatgtatatagagagctgactgacttttcatctgggagggttctggatggctcacttccatacttgaatgtgctcggattttggtatagaagggggtcctggaaccaatcccccatagatagcgagagatgacggtatacatagggtccagtattatctgaagtttcagacattcactggggctctgggaatgtataacctgcacataaaagagaatttccgtactacctccaagttaataaccactgaagaaatcctaggcttaagagagcccgttattggaacttagatggtggcgttagagtgcttatgctttggacttaggagtcagtatcccttccccccagctttgtctctttctatattcctttcccatttttcctctttccacctccttacactcaaaccatacagtgtgcacctgacagtggactacaaagattaatattcgatgaaaggactttgtccatttgaccagaccacttgaatgatgaggtgggagccacagaatacatagttgatattaaattaagaatctaggccagacccggtggctcacacctgtaatcccagcactttgggaggccgaggcgggttgatcacttgaggtcaggagttcaagaccagcctggccaacatggtgaaacccgtctctactaaaaatacaaaaattgctgggcgtggtggcaggtgcctgtaatcccagctacttgggagtctgatgcaggcgaatcgcttgaactcggaggtggaggttgcagtgagccgagattgcgccactgcactccagccggggcaaaagagcaagactgtctcaaaaaaaaaaaaaattgagaatctaaattaatttatagaaatcctttttccataaatttatcttttctccaagttttcttctgatatgcaaagtgtgagacacctactcttagcttttagatagtttacaggccaatgacacacagtagatgatgttctgccatgatgtctcaaaggcagagaaacattcttatttttatcaacactttctcatccccatctttaaattattggtataaacaaacttctgcttctcactttagattataattttatcattttttacaattcatcaaagaaagtttttctaaattgcacggaaagttctatagaatgctgagttatgtattctaaagaatatttctccttcccattttttcatagctaaactgtcaatatttttaccttaacttcctacaaagtcctatagctatttgattacttgatgtttcagtataaaaaaaaattaggtcaggtgtggtggctcatgcctgtcatcccagcactttgggaggccaaggcaggtggatcacctgacgttaggagttcaagatcagcctggccaacatggtgaaaccccgtctctactaaaattacaaaaattagccaagcctggtggcaggcactggtaatcccagctcctcagatggctgaggcaagagaatcgcttgaacccgggagacagagattgcagtgagctgagatcgtgccactgcactccagcctgggtgacacagcaaaacttaatctcaaaaaaaaaaaaaattaataatgctgcttctgcctgaaatacatgatttccagtgagtgaaggaccacttgctctactgaagtaaagctactttactcaagtctctgaaggagtaagagagtcctgcagggcacatttgaacagctcactttcagatacaagtgataaaaaatggagcctcagcaacaacaacaaaaattataacttttaaagagatagaacaacatggtttgaaaaggaatctggatttttgcctctggttgctgtcattgacagggaaagtcttatattttctgaacttgtttttaaatccccccaaatagagggattagactgtgtaattccacaaatccgttgattttatgacctggctatagcttgggaaagcaaccacatagtaccgttgttacactccagagctattcaaatattgttatcaaagtggtgccaaaaatttctaatcaaatatttggaagagtttggtgatgagtcgaaagtagcctgtatgtctctgaattctgtgatgtttctcatttttcctccccgtacagtcttcataggtatttagacaagtaaacacctgtaaaggaagaatgtgggcaataagaatgaatataaatgataaatcacataatctgatgtaatgaaagacttaagttattacagaaaacctagaattaaatgaaatatttaaaaagtgatgtcttcaggaagtctacagttcagattcaagggtggcaaatactgtccatggagaccagtagttctcaggagggtgactttttttctccaggagacatttggcaatgactggagatatttttacttgggcatgttgttgatatctagagagtagaggccacggatgctgctgaacacctccaatgtgtaggacaatgccccgcaacaaagaatgatctcgcccaaaatgtcaagaatgccaaaatggagacaccctggtgtagacctatgatagctctgacttctttttttttttttttttttttttttttttttgagacagagtctcactctttcacccaggctggagtgcagtggcccgatctcggctcactgcaggctcgatctcccaggttcatgccattctcctgcctcagcctcccgagcagctgggactacaggagcccgccaccatgcccggctaattttttgtatttttagtacagacggggtttcaccgtgttagccaggatggtctcgatctcctgacctcgtgatccacccatctctgcctcccaaagtgctggagtgctgggattacaggtgtgagccaccgtgcccggccgatagctctgacttctaagtcaactgtgttcatcagtttcatatctcccctcttactttccaccatcacaaaagcctctgcctcctaccaaatgttagtaaatgcagtgaatgttagcaatctatttgaaacaaggtttcttggcattcatctagctgtatggataaagttttaccagcacaaactctgtatgcatggggtagactggatcagacagagcaatctgaaccacaatgttggatttccttcaagcttgagaaatattaatactaccatatatacaggcggggcatggtgggtcacgtctgtaatcccagcactttgggaggccaaggcgggtggctcacctgaggtcgggagttcgatactagcctgaccaacatggagaaaccccttctctactaaaaatacaaaattagccaggtgtgggggtacatgcctgtaatcccagctactcaggaggctgaggcaggagaatcgcttgaacctgggaggtggattttgtggtgagccgagatcacgccattgcactccagcctgggcaacacagcaagacttcatctcaaaaaaaaaaaaaattaccacacatactaacaatatgaaagttctaattcatatttaaggaaacatctgcttctacatgtgtttctatctgtggttctgaaaagcaaatcctaatttttatgaatgataatttctgggcctctttttgtctttccccagatgttccctgctttgttgcttaagagctgcatggcacagaccataaaggttgtgagctcttcccatttcaagaaaccctggggagattcaaataaacaaattcaaaatgccccttagagtctttaacagaccagaattagtacgttgtttgtttgaaaatctttctttttttcggatataaaactatacactcaagactaaatggaggcagtacaattacacattttgactgaattgtctcatcagtaaaagtatcacctggctaattgtaactctttagaattggcctaaactagaaaataaacaaggaccttattcaagtatttcctattatgttacatacatacaagttaccaattagaagttgatatacactattttgtttaaaaataaaattcagcaagcttctgatgatttattctgttcttgtttttcttaccagttttactgccaaaataaactccttctcatacaaagtctgggattataccacagagttactataattggattcaactttaatagaatattacaatattaattttaatagagtatggtttcagatattaaaaagattaatgtacccaaaaacataatcattgttttgttttttttttagacagaatcttgctctgtcacccaggctggagtgcagtggtgtgatctcagctcactgcaacctccacctcctgggttcaagcgattctcatgcctcagcctctcaagtagctgggattacaggtgcatgccagcatgccaggctcatttttgtatttttagtagagatggcattttgccatgttggccaggcttgtctcaaacttctggcatcaagtgatctgcctgccttgaccttccaaagttctgcgattacaggcgttgagcaaggcattgagccaccccacctggccacttcttttaaattgcataattttcctgttctctatttcatccaatctaaaataataatgagttttaaatacttatttttaacattttttttacacctatgatttgagaatatatatatattaggccgagtttcatttttgttgcccaggctggagtgcaatggtgccatctcggctcactgcaacttccacctcccaggttcaaacgattctcctgcctcagcctcctgagtagttgggattacaggtgcccaccaccatgcccagctaatctttgtatttttagtagagacagggtttcaccatgttgtccaggctggtctctaacccctgacctcagatgatccaccagcctcggcctcctgaagtgctgggattataggcataagccatcatgcccagcctgagaatagatttttgacatttttaacttgattttccgagaagaaaaaattacatatttttaaaaataataaatacattgaaatctagattttaaaacatgtttactttctctcaaatttgttagaaatgtcacaacaaatagctttttcaacctatgaacagtatttgtagaagggaaaaatgaggaagaaatgggcacatttttctagtgattgaatggtggtgtctacatcttgaataattctcactgcatatcgttgcttgaattgtagatctgtatggcatgtgacttgcctgggtctatgatgttgtcaacagaaagagtcaaattctgtaaaatatttgaagagatttcttctgagccaaatatgagtgaccaatggtcccgggaaatcctgaaaacatgtgcccaaggtggtcgggctacagcttggttttatacattttagggggacataagacatcactcgatacatgtaagatatactttggttttgtctggaaaagcaggacaactggaagccaagggtagaagggggccttccaggtcataggcagattctcatgatgttgcccagatgtcctattgtaatttcaattggttgagtttatctaaagatctggaatccatagaagggagtgtctggattaagataagtggttgtagagaccaaggctcttattatacaaagcctacaggtagccggctttggagagaatagattgtaaatgtttcttatcagacttaaaaaggtgccagactcagtgaattctctcctggattagggaaaagacctggaaatggaaagggattctctacagaagttagatttttccccacaagagacagctttgcagggccatttcaaaaattgccaaagaaatatattttaagacaaaatacttggatttctttcaggacctgctatctgtcatgtaatgctatactagagtcaggctggatttgggtgtcttattgctacagaaagtcttaagatctctattaatgttaatgctggtcagctgtgcctggattccaaagggaggagggtataatgaggcatgtgcaacccccactccccatcatgacctgaactagtttttcaggttaactttggaatgcccttggctgagaggagaggccaattcagatggctgtggggcttaaaatgttatttttggcttatgatgtggaggcagaagtaacctgtatcactgttgtgccaaagtctctaagagctaatgtgcagttcaccaagttgtctccctatgagagtcagccatcactgcaaacagcaacactccaggttgattgtggttctgtcagcttcatcctgcaccccagagtaaagatgacatagtggggagcctgtcttacaatgagcatatagcagatgcaagaaataaacatttgccttgttaagccactaagatgtcagggttgtttgtcctgcagcaaagcccagctcatcctgactgataaacttatccattcaagtgatcagcttttggtgtaaatgcccctaagaaaactgataaagcggccgggcacggtggctcaagcctgtaatcccagcactttgggaggctgaggcaggcggatcacgaggtcaggagatcgagaccgtcctggctaacacggtgaagccccatctctactaaaaatacaacaaaattagcctggcgtggtggcggcgcctgtagtcccagctactcaggagactgaggcaggagaatggcataaacctgggagacagagcttgcagcgagccgagattgcaccactgcactccagcctgggcaacagagcaagactccatctcaaaaaaaaaaaaaaaaaaagaaaagaaaagaaaactgataaagcctgatgcactacctacctatgccttgccaaagaatggtaataatccaaaaactgtttaatttagaccttcactatgcaatgcatattttatctaggaacacttttactggtatcagtgatcaaaattatagagcagggggggaaatgtgaggaaacaaatctcaaatgtcaacatacgtggggatcttgtttgcagatgaggaagtgcattctcaaagctgtgtgaattgtcctcatcatacagctattttcattgtattctttcacaaaaatatgtatgtggatggattcttaggtgttagagacggggaggaaagaataaaggagactcaaggcataggtggaaaccgtgcatacagatggtatatctttatgtgttgagcatttatatcatgcatctgctaagtactgcaatggaaacaaggataagacgcacagacttccctaaagaaatgtaaaatctcaatgacaaagaaacatgtgaagaagttagtatcttaagcaaaatgatgcaattcatagtaggccactgtgtactggaaaagtaagggctattctattccaaagtgtgatttttttattgggtgagggggacctgagaaagcttcatggagggtgtgatagttaatactgagtgtcaacgtgattggattgaaggatgcaaagtattgatcttgggtgtgtatgtgagagtgttgccaaaggagattaacatttgagtccgtgggctgcaaaaggccgacccacccttaatctgggtgggcaccatctaatcggctgccagcacggctagaatataaagcaggcagaaaaaccttgaaaagactagactggcctagcctcccagcctacctctttctcccatgcttgatgcttcctgccctcaaacattggacccctggttcttcagttttgggattggactggctctctttgctcttcagcttgcggatggcctattgtaatcatgtgagttaatatttaataaatttccatatatatatctattttattagttctgtccctctagagaaccctgactaacagagaggagaggatatctgaactaagcctcagaggaggatgaatggcaaggagaagaaacatgtctccaggaaactgaggcctgagggggtagtaatttttcccgagcatatgataaatgacagtgatttgggaagacttcatggcatgaatgtatgtgagaaagtgggcttgcgagagcaagattggaggagttggttatggaaaggcgagtaaccagatataggctgatagatggagtaagcatagagaagggcattgttttgtttgcttgttttttttaattttttaaatgttttatagatatgggagtcttactacattgctcaggccggtcttgaacttctgggctcaagggattctcctgccttggcctcccaaagcactgggattacaggtgggagtcatcaggccggcttttaaagaagggcattgcagtaggaatagaatgaaaggaagagatgaatgaatggaagagatatatgagccatttcaaaataagaatcacaacagtggaactgagtggctgtggataaaagctaaaagggttaagtcagggttgggaccaacagaactagaacaatacttgtattttggcccagatgacaagggctgaagggcatccagtgaacacccagaaactgaggacgctagactgaagcccaggggaaaatccaagctagtgaggtttttctcttatgagttatgggaggagcaacttggagggaacacttattgattgcatctcttgtaatatccacagcaaaggcatatgaggcgaggctagggaaggagatagaggaggagtgtggtcagagacgcaaaaggcatcaaataaagctgatgtggaagagaaccaggacgctcattgtggtatgaaagtcaagagagagagcttcagggaggtgggggattcgcaggtttaaggagaaagcaaagagaatgaggaccaaggaaaggccattggatttgaagtttgagattttctttctttttttttgttttgtgacagagtctcactctgtcaccagcgtggagtgcaatggcaccatctcagcttattgcaacctccacctcctgcgttcaagcaattctcctgcctcagcctcccaaatagctgggactacaggtgtgtgccaccacgcccagctaatttttgtatttttagtagagatgaggtttcaccatgttggccaggctggtgtcgatctcttgacctcgtgatccacctgcctctgcctcccaaagtgctgagattacaggcgtgacccactgcacccggcctgaactttgggattctcttggtggttgtagagaatgcacttcattagctttagattctgggacagtcacattataaaagacaaggggaaataaagagggtatacaggacactggtgtatactgtccactccagatcagtggatgaagaggatctgcaccctaaggggacagcagatttatcccattgctttgttgtgttgctttgtcgagatgggagatacctgaaagcagaaggaaagcaacataggaagacgctcaaaaataatgattttcttaaatgcacatgataatttatggctgacactgacattttctcagttacctttcataataacattagagaaatgacataaggttgcagagtggggggcagtgggtttcttctgactccacttcggttcccttcatagcatgaacacatttgtaagggagaaaacgaggcaggaatgatgcacattccgagggtgggagtgaagaattaggagtcacaggtaggttagcatgtggaagagaaggtgactgaaaccagaggcagagaggagaaagtggactgagatttacatgttttactccctgaagagactagcagtccctatttccaccaagggcagaaacattcaaacattctgcatacctttccttttatgcatgaaataaaatactggcatttgaaggaagaggttgataatgtttatttcttagaacattcaagcttggcagttatgtgacttatctctagagcctctcagaagtctctggggacgcaggagtctttggagactcacactttctgcaaaagtgcagaaagaaatacaattacttaatgaatacctactgtgtactcagcaaatcctttatctgtcacttgtgttaatttctagaaattacataactaagagtctccatgaattgcacttgttttcttaagagggaaagagaaaaaaataccttctttccttaccatttaagccagtgctttttaaaccaggatctgacactccgtaggtgaccatagatgtagtatcacagatccgtctgtttccaaaatgttacattctgattttaagatcccctgaaagttgaaatttctcttttgctgcaacaactcacacttgagaaaaattttcacaggagactttattttcttaaagcagagtttgttaatatgaattctcacaggactgtggcaattcatttttcttttaatgcgttcattactctagaccaagacatcaatttttgtgcaaaccttgtttcctgctgccacctggtggaagccacataagagttttacagaggctttggtggtgctaggagaggggccagggctcttcctcagtcacagaatcccacacagtgatcaaagagcagatctttctattaaactccctggcagcaaaacagtagaggcttggctctctgccccgggactgtgcagaatgtcacaggtcggaagcccagagcatttttctcttcttttatctttagactcttgtggctctcagaccttgaatataattctttgctgaaaattctttaaaatcattatcttttctttcttccttttttctttctttcttttttctttcctcttttttgctatgctagacaggaagaaagaagggaatggcattttaatgtaaagaagattgcactgaaattatattacttgcttaattgtattaattcactgcaataacaatttaataatatgacaggtcatttacatgctaatcatttgggtctcttgtccagagaaatcatgaggaagggctgggaagtgctcttattatgatcaaaataatccacactctcctagaggagtgcataggtatagaactgacattgtttgtttaataaagtttcattcaaggcaatttggctggttcttttatcaagtgtaatgggaaaacaagccagtcctgatgttaaacactccaatgatccctcaagctttttattctgtaataagttttacagcattatgtgttacccacgacagtcatttagtcggtcaatttcaggctagtgataaaagtttgagtaatgggaaagctgtgttgatgttccatattctttgtgagatgtctatgaattaatgctcccaggtacacactcaatttatatttaacagccattactaaatgtaatatctaagtaaaacccagttatgacctatatatatggaaaactaattaaagctgttggaaacaacctatttccctttggattatttatgtaaatacatcgaggtctaaaaattcagtacaagtcagatgtgttcctgcctagggctattatataaagctcagaaaattttatgagaaaaatgatgattcttaaggattgagcttcaaatgtgaatttttctattttataaggatatagcttgggttgttaagcatcaacatagcttttcaaaatagttttttattctcacaagtttaaaggccttgtaaaatctcttctattaaatatacatatatacatacatattacatatacaccaattgactaacccctctaagtgctgtatctgaactaattttaaaagaatacccgtgtttttcagctcccaaattgaaaagattattagttagtaccgtgatttctgaacttttaatcaaattttcattcattttataattttgaaattttgacaatctgagaatcttctatgattaaatatattctttcttcctttcttttttctctttcccttccttccttccttccttccttccttccctccttccttcctgtcagtctgtcttgctctgttgcccaggctggagtgcagtggcatgaacatggcacacttcagcctcgaactcctgggtgatcctcccaccttggcctcccaagtgttgggatagcaggtgtgagccaccaagcctggccttataaccaattaaatgaaggaaatgatactatgacacagacaaccatttttcaatcaagttattctgccatattaaattttcagtcacctttctattgcatttattgaatttctactttttaccagttctaagcctagatctgtctctcttaaattattaaatgtcttattttcttatgaaacaaccttcagatgtaatacacagaagaaaaaggagtctcaggaagtttagtttgcccaactagaaattgagcacaattacttggtgtgttgagggggatttgaaactatgtccttatgataattgatagttatgataattgatgacaaaggggttttagaaagacctcttttgcttttagaaacacttctctttgcactttctttaatgcccattttttagttttatgaattaaataatatacatttatttaaacaaaagtatcaacatttctcaagtatctataggttacttatctactcaatgcaactaacaatcaaaaactagtgctccaacaaattaaattttccaaacactgaaatattgatcacaatgtctctaagcatttcattgaaataaaaattttgatgtatctaattttcctaaatattttaaatgcatttcaatatgcaaaactctcacaaaattgttgtaaatacaaaggtaatcagtatttttagattaaaatcagttataaatgtgctaatatagtgaatgtgacccttgtccggactcacatttttcttcttagtcttttcctgggttatattcttaacatatcagctatttttctatttttatagcttcttagggttcaaaaatattaccatatccaaatgaaaactaactacctgagagcagccaactgcaggatctgtgtcaggatccagctgattcttggtgaggacacagatccaggtgtctaaggagattcagacactagccagtcatcatcagattaagctgcacttaaatccacatatatcaaattgtttttttttatttttacaatggtgcgttactaccatgatgtcttcacaactgatttgagcagtgttgcaaatcccatttcattatcccatcgttgtgatatatagacttggcctgttggaataccttcttggaaatttaaaaaaatagtttattaagattattagggccattgaagaatttcctcctaggagataatgcattgagtctacctttcagtcctcctcctcagaacacgtgcccgaactatcatttttgagatcaccattgatttctttctacagcgtggtcactggtaccaataaaatgctagtcttcattcctatccagttattatgtggggccccatgttgttagtctttctgatttcattatgatactaagttttaagggaaacttgacttcctatttttgtgtctattgtactacccactatagcgactatatagtaaggaatataaatttgttttcataggaaataaaatacccacatatattaaatccccattaaacataccctatttcatttacccttctttaaattataactatctttttatatggcttatattaacttttctctctcaagcatcattttaagctaatgacctttcagactagacccaacttctttcagtcaaccataattcatgctcactttctccctctctctcatcaaatcatcgaaatttgatcagcaggaatctctttaacttgactccattgattttttagtgttttagtacagtctccaacattcttaaaaacatatttgttttctagcaataacaagatgtcccagactcattccaatttgttttgttttactgccccaaaacatggaatcagcttccctaccataagtagtaaagagtagtagagaatactattaaagtccaaaatctgggaactagggataaacaggagagttgatggtaagtaaaaccagtgctgctgcttaactatatttactaatgtcagagatggaaaatacaagttattttaatgtcataagctcacagtaattttttccaaataagattatatattgctatgctctacttttctcaaattatgtgattttattgaaaatgaaaacttttattttggaattgaaatatttgaccctcttctttctgcttaggggaattatttggaaagatttcttatgcctagttctgtagggttccaaaccatgtatactttcacaaaatgcatgtgtgcaatagcacacatgctatttccagcagcaagttgaatccttgtatctagcactgatggtcaatatgttttgcattttgctttcccacctccaatgaattagtataaactatgaccttcattgatatttctttagtttttatatttgtatgaatcagctacttcaaacccttaataaaatctacaacctctccaataaacccaaagttactagatggaaggaaacaaagattagagcagcaatcaatgaaatagaaacttaaaaacagaaaagatcaacaaaactacaagttggttttctggaaaaaaataaacaaaatcaataaaattttggctagactaagaaaaaaaaagagaagactcaaataaatgaaaccagaaatgaaagaggagacatcataacctataccacagaaatccaaaggatcacaagaaactgttatgaacaattacacagcacacattgaataagctaaaaaaagaataaattcttagtctcatagaacccaccaaaactgaatcatgatgaaacagaaaatctaaacaaaccattaatgagtgaggaaattaaatcaataaaaagcctcctatcaaagaaaatcccaagacctgatagctttactgctgaattctaccaaacatttaaaggataaaataccaattttttgcaaacttttaccaaaaaatgaagatgaagaaacattctcaaactcattttaccaggccagcattaccctgataacaaagccagaaaaagcaccacaagaaaaaaaattacatgcccatattcctaatgaatatagatgcaaaaaccctcaacaaaatactagcaaactgaattcaacagcatactaaaagaatcattcatcatggtcaggtgggatttatcccagagatgcaaggatggttcaatatacaataattaatatgatgcaccacattagcagaatgaaggacaaaacccatatgatcatctcaatagatgcagaaaagtcatttgacaaaatttaactttctttcatgaaacaaacactcagcaaattaggtacagaataaatgtatctcaacacaataaagagcacatacaacaagcccatagctgacatcatattcaattgagaaaagttgaaagctcttcctctaagattaggaagaagacaaggatgcccactcttgccatgtttattcaacatagtactagaagtactagccagaacagttaggcaagagaaagaaataaaggcatccaaattggaaaggaaaaagttaaattgtctctgtttgcagatgacatgatcttatatgtagtaaatcataaagactccatgaaaaaactgttagaactaaaaatgaattcactaaagttgtaggatacaaaatcaacatacaaaaatcaacagcatttctatatattaacatgaattatccaaaaaggaaataaagaaaacaatttcatttacaatactaaaaaagaaatacttaagaaaaatttaaccaaggaggtaaaagtttataatgaaatttataaaacattgaggaaagaaattgaagaacacaagtaagtggaaagatatcccattttcatgaatttgaagaatattgttaagaattcagtactacccaaagtgatctacagatttaacataatgcctataaaaattccaataacattttttacagcaataggaaaagtaatcctaaaattcgtatggaaccacaaaagaccctaaatagctaaagcaattttaagcaacagagagatatcacatgacctgattttaaaacctaccacaaagctatagtaataaaaacagcatagactagcataaatacagacacatataccaatggaacagaataaagaccccagaaataaattaatgcatttatggtaaataggtttttgacaaaggtgccaaaattatggggaaaggacagtctcttcaagaatgtatatccatacatagaagtgtgaaactaggctctcattttacaccatatacaaaaatcaattccaaatgaattaaagacttaaatgtgacacctgaaactgtaaagctactagaacaaaacatagggaaaatgctctatgatactggtctgggaaaagattttttggctatgaccccaaaagcacaagcagcaaaagccaaaatagacaaatggaatgacatcaaactaaaaagcttctgcacaacaaaggaaacaatccaacagactgaagagacaacctatggaatgagaggatgtattcacaaaccatacctctgataagggattagtgtccaaaaggtataaggaattcaaataattcagtagtaagaaaacaaataacttgatttaaaaatggacaaaggacctgagtagatgtttctcaaaagaaggcatacatgtgccaacaaatatatttaaaaggtttaatatcactaatcagggaaatgcaaattaaaaccataagataccacctcaaacctcttagaatggccattatcaaaatgataaaagacaacaagtgttggtgagaatgtgaagagggaaccattacacattgttggtagaaatgtaaattagtacaaccattagggtaaacagtatggaggttcctcaaaaaattaaaaatagagctaccatatgatccagcaatcccactattggctacatatccaaaggaaatgaaattagtatgtagaagagataagtgcactcctatgtttaccgcagcattattcacaatcgctaagatctggactcaagtgcccatcaacagatgaacaggtaaagaaaatatggtatatatacatgatggaagcttcaaaaagaaggaaatccagccatatggatgtacctggagaccattatgttacataaaataaactaggcacaaatcaagtatcctatgatcccacttacatgtggagggtaaaaaagttgaagtaattggaacaaagagtaaaatagtggttaccacagagactgggaggtggtgggattaggtagatcttagccaaaggacacaacatttcaattagacaaaaggagtaatttcaagagatctattgtacatcatagtgactacagctaatgacaacatattgtgtatatgaaaattgctatgagagtggattttatgtttccattacaaaaaaagataaatttttcagataacgcatgtgttaaatacctttatttagccattctacaatgtgtactgtgtatgtacatgtgtatatgtatataatctcaaaacatcatgttgtacaccatacatatatacaatttttacttgtcaatcaaatagtttttaatttttaaaaatttacaccttccttttggaataaatatcccagctctcaaagctgataagtaatgaagtaaggatgaagctacctgatttggctgatgtatggtccagagaaggcgatgcatatgggacaaaatcatgaattaaaaaggcaatttttctttagattaaaaaatgtcaacaaatagcaatgtttgttattctaaggaaaaattatttatgatacatgaaaacataaagaacatccaaagctgagaagtattctttcttcattctttttatagtcttcatcttaagtgacttcaatacataccatttatcagcatgtctgttacatcttatattgaactgtttccatggaacatctccatgggtcagactgtagcctcaaagatactacaagcaaaagagaatccagcagtgtagtgggagaaggaggaaaaccttccctgactgcttggaaattgatgtatttatgacatgaagaagttaaaagactaggccaagaggcacaggatccagataaaacaacttccctcgggttccagagacatgaaaataaagaatttatagttatcaggaaggaggtaatttgctgaaattcccatcacagatccaaaaacgaggaaggaggcagacatgtgttaatagctccgaagtggcctggaagtcttattttgccagtgatttaactgaagatcaaatacactcatgtaaggaaagcagagaaagcttgcataagtctctggcctggacctggaaacccagtctgctttatttccttgggggagcaggtttcctaattcttccacgacatttgttggttaaatgttgaccaacaaaagcagaatgttacattgtgtttgatgggaggggaaagtccttgttttctatctagtctggggaatcatacatcaatccacacaggaatatgcatcaagtgtttccatcttaatgagtggcatgattccagaagggcaacaggccaggagagctctaaagcttccctgaaaaaatggagaggctggttgtgttttgttcttgccttggatggatgaagaaatggaagcaggtgccccattgggaccatggatcaaatgcacttaggaacttaaaggaaagtctaggggctctgagtgaaccagcacctcctgccctgctgggggttagaggcttcactggctagtccgaagcctagtggttttgagtaagaaaagaacttcaaaacattttactgtgatttaaaaatcctccatggtgagcatgcccagcttttgttctctcgatgtacctccaatctctcaagaagacataatttagtaacgctggggttgctgctactataaatgctttgattaacattagaggaagaggacgacagaaagcagcttctgtcccagccaattaaagagcttgtttaaagtatgaaaatgatttattagacatgcaaagagggttgcaaagaagaaagacacacagtctcaatttaaaaaaaaaaaaaaaaaaaacaaccacaaagctttggtccaggtgcctgccttctgacaacacagataaacagtttagttgataatcccccacatcttcttcttcagcacagcaatttgttccagttatcatactttctaaatagaataaaagaaaatgatgctcctttataatatatatagggtttagataaaaataaatagcacagtccacatgctttaaaccaaagattgagtctgtgtgaacagaaataccagatagctgtttgatacagcatttcccaaatagatatatctgagagctctgctaaaaaaaaaaaaaattaaatttttttaaaaaggaaagctagaaaaaataataataaatagagccttgtgatcatatatgtgcatcaacaccggctatatactcctttcggaaaatcacaatgtacgtgactcttgcagtaaagaaatgtgtttaacatttttacatttttaatacagcatttctcatacatatttgactgtagaaaccttctctgatatgacgactattgtcattccctagaattagtattctgttcaacatacttggaaaatacttaactagccaatctatttacaatgggaagagctataaagtccctcagtcattaacagctaatacacttgaaagattgttagcagaaaaaggaaaacatgacgtcaggaagctggggccatggattttgtcccttacacataccttcgttttacagacatcacaatgacaaattcaccctgacccaactgaggtcacatcagcaactgaatgtaggtggattgtctgaaacccattaccgttgtccacccaccatcatagaaaattattttaaatgtatgtattatagtaagagtactcttgatagtattattttttctttctttcttttgagagagagtctcactctgtcacccaggctggggtgcagtggtacaatcacagctcactgcagcctcaacctcgcaggctcaacctcccaagatgctgtaactacaggccagtgccaccgtacctggctgattttttgtattttttgtagagacaggatttcgcaatgttgcccaggctggtctcaaactcctgagctcaagcgatctgcctgccttggcctcccaaagtgctgggattgcaggtgtaagccaccacacccagtggctaatattacttaaaccatataaaactaggcagtggagaaagggagtaagagtacaggctccagattcagacggactttctctgaagtccctcctactgcccatggggacttgaacaagttacttaatttctctataagcctcaatggcttcatctgcaaaggagaataatgacagcatctattttttaatgttttgtgaaacatatggaataatgcatagtaagtgcatagcacagtaaatgacacatattaaacatagacaaatattagctgtaatattttatcatcattttctttacaaataatagtgtttttggtaactaagactaagaagaaaagaaggaagacagaagttgaatgtccttgcagatggggggcaaatctgctggcaagatttgtgatgtgtgttgctaattatctgtgattaactggttaatagattagttaaatcatcctgttggctctgcggaggatgatctggaaggggtggtactagagtcagggagacaaaagcagtgggaaaagataacagaggatgactggagagactttggagctggaattgacagaatttggcacctgattttgcatgggcatgagatttctggcttagaagagaccctgaagtttcataatatggacggtgatattactaagatgaagaccacaagagaagccactcttggctgagcgcaatgagtttggttttagacttgctcttgcaagcttctggtaggaaatcttaatagttaagcacgttctgatagaattttggcacttggctctaggaaggaccctgattagacatagatggagctatcaatgggaagatagttgagatcacatagataaatgatacacagagagaagagcacagtggcatagtggagctcagaggaatgtaaatatttaagagataataagaggcagtggaaccaatgaaatgatgaaccgagagtaaagtagaaagatgatgagagagaataacgtcctgaaagttaaatgagcttgagtcaacaagcacagaaatcagggctacaggctacatgccaagcctctgaacttcctccgtcctggaccatggaccaagctcagtcctgttttccccagagacccacagaaacgccagtttgcctcctagtgtaaccctgcaaagaaagcaatgtcgttctgcatcaatgctgatgagcctgcgctgttcagtatctgtggggcttgccaagctactcctgctcatggaaacctcagtcaggagcgaggattccttggcagatcgtccctgtgttctctgcatgaggtctctgatctggctgcaccaataacaagaactaatgtcatgtttacccttcacaaagttcaaaataacggtacttcgaaattagccaggcttctaataagcagtctgagaagtacacagactccaaaacagtgtttgcagagcttctgtagaaaagatcatctgcatcagaggcagctgagatcctaatgaaaaagaactgcaagactgagtgattggaaatagctagggttatggctcagcaagctgccttttcagcaagccttgcagatgattctgatgctcaccaaagtttgtgagccactgatgactacagaaatagaatatcaggctgaaacacacaaaaagagcaccatcggggaaaaataatatgaagaaaatactacatttttagtcctggtccctaatccttcaaagagttgttatgctttgtggaaactaatcaggtctagtctcccacctttcaaattatttctgttaaaatgttctcccctcctgcccagaattttctaatacacagtggaatgctttattgctctctttaagcatgtcaactagagcaggagaaaagtttcccatgtattttcttcaaagaaaaagatgtttaaagtttaatattaaaagaaagagtcatgaagtagtttaacatttttttcacagggcgcagagagttgcttctgcatggttatttttactaagtactttccaatttatactttatttttctcaagtataaaaatggatcttcctacttaaaaacaccaatgtccaacttcatggtcaaatgtaaactttggaaattattacttgatttctgttagtggaggaattagaagagtttttgttccactatgttattccaacctcatctcctcgtttgtcaagattcttaagctgaacgtttttctgcgtgcatgcatgcatgtgtgtgtgtgtgtgtgtgtgtgtgtgtgtgtgtggtcacagtgaaacatagattaaggctgagaagtaacaaccagctaattattataagtatagatataggccatggatattaaagtacccccattttgtgttgatacatgaaatcatagaaatttcatgtatcatagagattaatcacatagagattaatttagaccataaaaacatttcaattttcaggaatcccttattaaaataatttttgaaaaaacaggggtgaatattcatgaagccaccacgtcataaaggtttggttgatgaatagtgagagtaggggtgaatagaggtaaagcaggagacacattggcaaggtcagggctgcaagagacaggagagcatcgaaaccaaaccccaccttcccacactcctaaagactgtccagtgagtaattttcccatttatacaagagcctggtctatgaaggcaaataaaatggaaggatttaccctcactgggcattgaagcacaaaccttgcccaaggccctgtcccgagcaaaagagcttccctactgggaaagatcaagatcttaatatcccttaatataactcaaataatcattagccaacctgagagaagaggacaggctctgagtctgaggagaagggttggaagggtctggttagtgcctgaccttcctataatataaagctacttggagatattagagctagtgaatgccttctcccagccaaatccatgctccaggaatgggcacagagttgcaaactaaagatcaattgttcatcgtggtacatgtctttgtgaggtattatgggacaaacttcagttcatatgggaaaaccgaacccttcccacgtggtccgtgaaaacccagttgcacattttcagacaacttctttatgagtacagggcattaggaagttgaaccagcccggccaatttagaacaactggtctctttaacatgagcattccccgtcagtgctaccaaactcctttccatgtgtcccatgcaaccagaaaatgtgttgtttaaattcagctcgtgtcatttgtaaaaaaaaaaaaaaaaaaaaaaccataaaaaataaaaataaaaataaaaaaattaaatagtttgacaagataaatcagggactttggaataaagagttagtaatatgttgagtagtttgtcacatgatatcatttttaagctactcttttttgggggggcggggcacggagtcttgctctgtcgcccaggctggagtgcagtggcgcgatcttggctcactgcaagctctgcctcccgggttcacaccaatctcctgcctcagcctcctgagtagctggaagctactctttctaaataacttcaacaaatattactgatgtgataacaaggcttgatttcatcaagcagtaactctgtctccatgtggatagcggtcttttgaagccctcctcggctgttagagtgcataacccacagctctcaaactggtggagacaaggtggtatgtttgactaattcagtgacgttcggtaagcacctactatgtgcccagcaaggtgtcaaaaacagagcaaagaacaaaataggcaaagtgattgtatatatcactttttatcctaggtcaggataagcaagcagtacataaatttttaaaacaggtattttaggtagtgatacatgctataaaaattacatggatagagaatgaccaaagatgactagattgaatttaccacttctttgagtaggtggcagtggttcaagttggtgactgagttctaaacgatgggaaaaagacagccctgcagtggtatgtgggaagtgttctgggcagaaaacatgttctgaagctggaacaagcttggtactttaaagaaaagaggctgggcgcagtggctcacgcctgtagtcccagcactttgggaggctgaggagggcagatcatgaggtcaggagatcgagaccatcctggcaaacatggtgaaaccccacctctactaaaaatacaaaaattagctgagtgtggtggcacacgcctgtagtcccagctactcgggaggctgaggcaggagaatcgcttgaatccaggaggcagaggttgctttgagccaagatcacgccactgcactccagcttggtgacagagcgagactctgtctcagaaaaaaaaaaaaaaaaaaaaaaaaagcatgcttgtgtgactggagcctaataagcaagtgagagaatagaattggatgatttcagaggcagagacaaaatataaggaggtcctagctgggcacagtggtgtgcatcatagttccagcaactcaggaggctgagcaaggaggatcacttgagcccaggagtttgagtccagcctaggtaagatagaccccatctctttaaaaaaattttttaaattttcattaaaataaatataaggtctttacgtgctatgtattccatgaagtccagagctatgaatgccatagagtaggttctcagtaaacatatgagacaaaatatggctgagggtgaccttagatcaggctttctgaatcttacagaaaaatcttcttttgaatctcttttagctgaactttgaagagaaggataaagtagcatctgtttcaggtgccagggaagcccagaataaaaggctcaggatgacacagccgcatcaacatccagtgtttattggccatctgtcccctaggaatgtcttaagagctcatgctctatttacgagaacagccggggacagtgagaggaaggaagaaattgctttataaaaaagagtagctgcattcttttgtgtgtggaaagagcactattgtggaagcgacgaaacccaggtgtgtaaaaatagaaccgagtgttcacattaaactttccgtgcctcagtttccccacatgaaaagtggacataataacagcacttgagtgagaattaattgagataaaacctgtgttgaaatactgcttagaacatgggaagggtctgagctactatttattaataatgccattatcatagattttagctacatttattaataactccatgaatttagaatgttaatggaataaggattggagaagaaaaatttgctatggccagtgagaattccttgcaagaaaaaagcattgcaattgtgtgtgtgtgtgtgtgtgtgtgtgtgtgtgtgtgtgttggatatgggcagttgtagtgtggaacacctcagcagcacccaggcctcacttgtggatggtacaacctcaggaaacttactcttcctcagtataaatgagaaggtccccttttcccccaatggctgcagtgttggtctaggatgaggtcttctctaccctcatctgcgtagttccaggatggactttctcctcaaaatcacagtccaataaacaaaagtaatgaaaagggtctaacttccgtttgtatctcatgaggagcatcaaaaaccagttagttcctagcatagcacacagcactcttgaattctttcagccattcccagggccctcgcttctctaccctgcccctcccatccctgtcaggtcctgagctcctccttgctcctccctccttttttttttttggttttttttttttttttttttttgagacggagtctcactctgtcacccagacttgagtgcaatgtcacagtcttgggtcactgcaacctctgcctcctgggtttaagcaattctctgcctcagccttctgaatagctgggattacagacatatgccaccatgcctggctaatttttgtatttttagtagagacggggtttcaccatcttggccaggctggtcttgaactccttccctcatgatccactcgcctcagcctcccaaagtgctgggattacaggtgtgagacaccgcgcccggccacgctcctccctcttttgaagacttgttggactcttgtctttccttctccttcctctttccttttccttttgttctgtctaaactcctacagaacaaataaatcaatgaacgaaacacctaggtccttcccagtgtgaatcctttccattaccatccacaaaggtgaccaccattaaagctgtgtgtgaaggcttctagacattagtcctttattctgagtttaagcaaatacacacacatacagatgcatgtatgcatatgcgtgtatgtgcatattatatatgtggggtatatacacatatctttgtatcaggcacataaacaatgcacacatacttaataggtttgtgcaaaaaaactgcaattacttttgcaccaacctaatattactataataaaatggagctgtgatatacattttattctgaaaatagcttgtcccttaacaacatacaatggacaatttacatagatcgattttatggtttatgccacattatgtcacattttttgtccaaatgaatgcatgtttcttcaaatacatacagtaataaatgtatacattgtggttacttccattttttgctatttgaaactctttataaacatttatatacccaaaggattataaatcatgctgctataaagacacatgcacacgtatgtttatagcggcactattcacaacagcaaagacttggaaccaacctaaatgtccaacaatgatagactggattaagaaaatgtggcacatatacaccatggaatactatgcagtcataaaaaatgaagagttcatgtcctttgtagggacatggatgaaactggaaaccatcattctcagcaaactattgcaaggactaaaaaccaaacaccaccgcatgttctcactcataggtgggaattgaacaatgagaacacatggacacaggaaagggaacatcacacaccggggactgttgtggggtggggggaggggggagggatagcattaggagtaatacctaatgctaaatgacgagttcatgggtgcagcacaccagcatggcacatgtatacatatgtaactaacctgaacattgtacacatgtactctaaaacttgaagtattataataataaaattaaaaaacaaacaaacaaatcactcacaccatggaagcacaaaactaaaaagttcagtgtgtgtgtgtgtgtgtgtgtgtgtgtgtgtgtgtgtgtgtggtgttctacttgaggtagaaggtaaaagattaaggagaaaaccaagtggattgaaatctgcaataaagcgaccattctccagtactaaatgcacttgaaatttattcccctgcatctgtaggtaaatgtccttctgttcttgaaacaataaatccccataaacttcccataaagttctgcagaagtgaaatgtgagattggttcccttggaatccattcagtgctttgtttgtgcatcttccaatcttaattttagagcccttgttcttcgtccagagcccctagactgggaaaaggtcagaatgcaacatgtttcaaagctgctgtgctctgggtggctgtcagactgttggagagaattgctttcaaaacccagagtatgccaccatctactcagtttcagattagcgtaacccacagcaccatgctatggcaggggaagctataatctttgctttttgttatcatttaaattcacttttaaaaatattaagattctcaaacagccagattctgaacatgcagtcttccccattgctatcaattatgtctaaggcaaaaaaagaggaccaaaacttctattttttctaacttttattttaggttcaggggtacaggtgcaggtttgttatatagttaaactcgtgtgacggggggttgttgtacagattattttgtcacccaggtactaagcctaatacccaatagttattttttctgctcctctcccttcttccagcctccaccctcaagtaggcccctgggtctgttgtttccttctttgtgtccctgtgttctcatcatttaactcccacttataagtgagaacatgtggtatttgattttctgtgtcagtttgctggggatgatggccttcagccccatgcatgttccctcaaaagacatgatctcattcttttttatggctgcatagtattccatggtgtatatgtaccacattttctttatccagtctgctactgatggacatttaggttgattccatgtcattgctgttgtgaatagtcctgtgatgcacatttgtgtgcaggtgtctttataatacaaagatttctacgcctttggatatatacccagtaatgggattgctgggttgaatgcaaaacctcaattttacaacttgaaatattgaagcgggaaatgtaagtgaaatcccaaattggcatgccatactaaatgttattgtaataacttatttaatatttgattatccaagcacgtacttttgtaccacattctgctcaataaatgtagaaggaagtgccgccattttggattgcagcagtacctcttcgtgcagtgaaaatcttttatgttgtggcccagccagaccctcagtgcagtttgcatatagctttggggcctgtagtgctgtggtaaccattgttgaaccccaaatatccaagacaggtctcagtcaatttaggaagtttattttgccaaagttaaggttgcgggcccatgacacagcctcaggaggtcctgatgacatgtgcccaaggtggtcagggcatagcttggttttatacattttagggagacatgagacatcaatcaacatatgtaagatatacattggttctgtccagaaaggcaggacaactcgaaatggggagggggcttccaggtcataggtaggtaagagacaaatgcttgcattcttttgagtttctgattagcctttccaaaggaggcaaacaggtatgcgtttatctcagtgagcagaggagtgattttgagttgtgtctgtcctttgtccacaaggatattccttgtgagggaggtatgtagctttttttttttttttatcttagtagctatcgtttttaggaatacagtggaggcaggtttgccctaagcagtacccagcttgacttttccctttggcttagtaattttgggggtctcctttcacatcatccacgcagcagcaacttctggtgaacacactgttcattattccaggcaccacttatgcagtctgtctttccctgatacaaattctcagatttctttgaaattaaaactgttctaaatctgcatactggatattacttcattcacattatatttattttaattatgtaacacaaagttgtaaaacttctgttagtcttaatatagactcatatatgtcctgtgtcatcaatgtgaattccattttcaatcctcacctcaggatgattacgagcaaagcacagtgtgtctaagctccaatgcttcacactaaaaacagcaacaaaggccaccagttgcaaaacagaatcgttctcgctctcagatgtgttctttttatccttaaaatcagagcattcatttccgtttggatgcactatttatttttatatcagaaattattttcacttagcagttgaatggaatttgtttgcaggctttctttcaatagtatttccttcttcttgaggatatatgaattctaaggaaactgcagcacattttgtaaaaatccaaaccaattatctcacccctgcctacaaagaagtctttgttatttttctattattattaaaatatatcagcaagattttttggcctttatagttctttggtatttcaaaatgcttctgtatgatgttattgctttaaatcatcacaaaccctgtgaagaaagaattatttttctaatttacaaataaagaaactgaggtcttagaagactgaattcatttcctcgtctctctttctttgcactatgggttatcttgatgctttactgatcctgctctcccctgagacatgtggactctgttactgttttcagcaggaaaatcatggttctattaataggacatgtgaatctttttatttcctgtaatgaaaagagcacaaaaaggaaactttgatttgtgtaacgtaatcgtatggatcatatcaacccattaccctgggtatagagcagtttcccagtttcacatccgtcattctgctgaaatgggtggcttttttccacattttactcacctgatggatttgatataaaacctgtttttctatggatgtgaggctctggaggttttgtagtctatcaacacataaaggctgcctggcattacagcactcctgctctgcacagtggtggagtgtagctaaatgcagctcagtctttttacagctcagctatgaccatccttcattacaacagggcagatgataaaatggaaacttaatgctattagatcatgaattccaattatatgaagagagatggaggtaagagaaattagatgccaaaaggagatacaataaagacagaagtgacgttcacagggctggcagttctcagaaccattgtcacccatcattgtcagtaccacctgaggacccggtgaagatgactagcatatcagatatctgagaagggaaatgctgagtgtgtccaaacatccaaacaaataatgccaaacctagaaaagcttctgtccatatgggttaaatagctcttcaattctgaaactgtcaaaagtaggctttgcagatggtcatgtcaagcaatgataataactggtagtggaattcccatggttcaaatttattaaaaaaaacacactattttcatttattcaagaaacacatattgaatacctgtgtgtcaagctagatattacagttagaaatatatagaaagcacaatctctgctctctgaaatttgcagcctagcagaggagaggaacacatgaaagtaattataataacaagttagatgcaatgatagatacaagatatcctaggaggacagggaaatagtaccatgcccagtccggggatacgtcagaaagactgtctggaggaggtggcatctgaactgagtcttaaagaatgagtagaaatcaagtccaatgtggtatatgaactgagagagagaaggggaggatgttgtagaaaaagacaatccaaaaagaggaaacagtgcaaataaagctggaatccacacacaccattgtcatggtgggaacaatggtagctgcatgttgctgaaatatacattctgaggctaggagtagaaagagataaggctggcaaagcaggcctatgcttactatgccatgtcaccgagcttgcaatactatatattctgcaagctatttggaaccgttgggatttgatgcatgagagtgaaatggtcggttttgcattttattttattttttattttttttttttatttttttgtgatggagtcttgctctgttgcccaggctggagcgcaatggcacactcttggctcaccacaacctccacctcccaggttcaagtgattctcctgcctcatctcccaagtagctgggactacaggcacctgccaccacactcagctaatttttgtatttttagtagagacagggtttcaccatgttggccaggctcgtcttgaactcctgacctcaggtgatccacccacctcggcctcccaaagtgctgggattacaggcatgtgccaccatgcccggccttgttttgcattttagatggatttctctgttggctttatcaaggatgaatttgagatgagcagcagcaggaacagaaccaagttaggaggctgctgccacatccaggcaagagacaatgcagagccaaggcagcagaaggaatggagaggaggagacacagcacagactatttagaaggtgtggctatcaggccttggggattgactggatgctaaggaagggctcccaggttcctgccttgaatggcagagtgggaaaagctctaccttctgagatggagaatactgtggatatagttaatttggaagaaaaatgcttgctttcagatatttagagttagatctctactatgagtttaaggctaaaataggcatttcttactggacagctttaccttgatgatttatactgaagatctaacttatgcacaaatttgggaatcgttaacatatgattagtacttgaaatcatgaaatgggtgaaaattactcaggaaaagaaaaaaagcataaatattcatccctgggacacaggaacattttgaagttgtcattccccagagtcacccccacccccatggcacttcagtgtactgcacactttgagatatatatatatatatatatatatatacatatttttttttcctaataaatagagacgaggtctcactatgtcgcccaggctggtctcaaactcctgggctcaagcaatccaccggcttcagcctcccaaagtgctgggattatagacctgagccactatggccagcctgatagtctactccttaacctacaggaagcagacatcaatttgttttacaacctctacatgcaaaaaatactacatagtcttatttttactaaatcaaaactttgtttcttgctaaatcttcttcccctctttgccagggtgtaaaagattcagtcttgttattccccgctttctggaatcaatcacatagcaacctttagggcttacccaggacagaaattggagtgaggacaggaaggccacaagttcccatgacacacctagctattcacgtctccgcttctagttattaactttgagccccggtagacctaggattactcaggcataaataatagccccccaaatgaaaagtgggaaattgtagagccctaatgtggagagcctgaagagcttcataaaaaaatcttagacttgttcccaccctccaaacatgtgaaacacacaactgtttcaaacattttaaatgtaccgaaattacctcataagtaccctttatatttaaatgcactaataatgggattgacatgtaagaatttccatgactaggaacaagcccgttttaccacaagccccagaacctggctataggtcagctcacagcagtgcaggaagcacctcaactgctttcaccagcatattctttttctctgtgggaccccatccccattctagcccaaaggacccgaatcacagagacacacagggtgaaatatttatgttgttgactcctcccgcaaacttgtcctctgatcattttgtgttgcagccgtgaaacaggcttgctggacgggaagaaatgctgcagagagagtggctgactcaaacccatggacagcattttattaataacttgcagcccttcattctaagtgaagcttgcccaataaaatgaggcctagagctgaacaaagctcctcttacctaacctgaatgtacaaaaaaggtttaattaaggaagtaatttttttctcccgtaaggaaatcttgacaaatagactcaaatttgcatgcaaatgaagccatctggttgattgttgtccacagtccccagctcacaggaaacaatagaaggccctttgcataactcagagaatctgcaaatctctaacatttgggtcactaataattttcagagtaattagtctcttcagagctgctatttacattggaaggtgtttgccatttacagcagaagctatagatattcttctaggtgcagccccagtgtgagccatttggtgacctgaggaaatcactcaatctgggaggggaatgacaagaccattggccactggagccagcctggcagcgacactcctcaccaaactgcagcccagagtgccttcacgcagtcttctccatgcgagccaaacgcagactcttctagccaccatctcttcccccttcctaattccccatctcccctctggggagggaggagacagggcaggggcaggcacaccaggcagggcctctacttctcatcacctgtctctgctactctgcagttatctcccgtaaacatttgttcaaatgcaatcatgtccattgcttgggtaactctaccttcttagtcgtcaggtccctcctcctttcatcagatttttacttaatggctactctacaaagcgtaacacagggctggtgctcaaggatgatagctctgattcatgtgtcctgaatggaattaccaaaaaattaaaaaaaaaaaaatcagtggagatgaagagatagggagtacagagttttggaagctagtgagggagcagaggaaggaaagagatgacgaggacaaaagggcagacatgggtgaggttgagaggagtaaaccagctgaggaagtgaccgctgcaggcttagctgtcaatcctggggtttgctgctccccgtggttggaactggaggacataatgctctgtgaaataagccaggcaccgaaaacaaatactgcaagctctcatgcatgagtggaatctaaaacaacagactcagagaagcagagaggaagatggtgggtacagaggctggaaggtgcagggaatggggagatggtcaaagagtgcagttaggaggaacatgcttggttggttaagttgtattgcacagcttggtgaatgtagttagtaatagaatatgtatatttcacaattgctaaggatgaatttcaaatgttcttatcccccaaaatgttaagtatttgaggtgatggatatgttaagtaccttgatttaattatttcacttcatattcataaatcataacatcactttgtaccccatgaatttatacaattatacattgtcaatttatgatttctaaaaaagcattagtacctgtggtaaatcaggctcaggggaaaagcctcagggtttgtcgtcttactgttcacacattgaaggaaaagaggctcctcttccatctttccccattccttggccaagcccttgcacaggctgactgtaagtgaaattaaagaatatcagtgtagtagtaagtaatcacatttgttgatcttttgttttgtgcctagcactctgctaaatgtatttcatgggttatctcctgagattcttaccataccctataaaagaggttccactgttattctgttcctggaccaaatagggtcgagctgcttattctcaccacccaataagagatgcagatgaactgggaaagaagagaggtgttttgttttgttttgttttgttttgttttgttttgttttgttttgtttgagatggagtttcgctcttgttgcccaggctggagtacaatggtgcgatctcggctcaccgcaacctccgcttcccaggttcaagtgattctcctgcctcagcctcccaagtagctgggattacaggcatgcaccatcatgcctggctaactttgtatttttagtagagacagggtttctccatgttggtcaggctggtttcaaactcccgacctcaggtgatctgcccgccttggcctcccaaagtgctgggattacaggcgttgagattctatttctgtaactgggtacagggagaacacctggaaattatcgccagatcaactcaaacttacaaagttttccagagcttacataccttgtaagctatatgtctatgagtaagtgtgcatttatctaaagacataagtgactcacttcttttaatttataactaagatctgagtcctgaagaccttcctctggagcctcagtaaatttacttaatctaaatgggttcagatgctggactaatgacccttgtctcctgctaaatcatggaggtttggggagttccttcagacccccattaaacttgtttgtggaggcctggggagtttcttcagacccccaatgaaacttgtttaatcctaaacaggtcctgttaagaattccttcattatcttgccatgtttcaaggtccagaaaaggcctaggcaaactctcggtgggcttttgttacatcctaacctttgtataagggcactgcttctttcagcttttaatatttaacttaaccattcagtcagtgctgaaacagttgttatggaggcctgcattagtaagacctggtctgccacaattccactgtacacatgaggatttaggaaggccaaatgatctgcctcacgttgcccagtaggtggagatggtagagccagaatgggaacctggaggtcggcttcctcagcctgcacacggaaacagtgcagggaagcttcaccaggtgacagcccagagcagcccagggactcacttcctgtcatcactcccaccccccaccacctcatcctggtagtaccacccgcgccaatgcttctagggctcttgctggacccacaggtggactgtgacttcagtctgttacctccttctcttcattctccacgaaagaacttcagcacatcacaagttcagttacttcactactggcagtaaaggaaaatctgtaagtccaggctgttgacaggcaggtgggaagcaagctgtggagctccaagaggcccaggaaccggaggcaggcaagggccgggctcagagccggaggaatggcggaacgtctatgtgagggtcagtcacaccccagctccccgctatgaccctgccagtgactgtcctactctacccatgcaggaagtgggggttcacactccagacaccaggcaccaaaaaatgggggtaaagctccttaataaaaacagaggaaattgacttaataaggttgacccctctccttagccttcttcctgtcagcttcccaagcactgagcaacagacatatattcctcatgaggaaagtagcggattcttctctcaagatattgaacattcagtgaccaaaacaagtcacagatactgacattcggagtcccttcaatgggacaggggactctccatgtgatcatgaagcccaaacatcaaatccaccaccatcccagacacacacactccagattgcagtcagctgtctagtacttgactgttcggtataaacagacaggtgagagtcaccaactatgtaggataatgtcagagatgtcataaaagaagggacccccaaactcacaatccagggtaggggtgggtggcaggaggtctgggaagaaacagaggcgacagagaaagcagaagaaaacttttgataattaaattaatattctcagagagacaagagaagatattgagatattgcctccaaaaaaattagaatggggtgctatgaaaaaggggactatcagagaacgagaaataatacttggaaatttaaaatatgatagctgaaattaaaacacaatgacagtattgaaaataaagctgaggaaatttccaaagaagtagaacacaaaggaaaaagatcaaaatgtggaacaaaattagaaaaaaaaaaatctaaaataaataggtgtttgagaaaagggatcagagaaattattaaagtctcagacctcatatgggagaaaaatctatatcaaggcaatcatgaagttccaattaaaagagttaaagaaaagatcctgaaagtttccagaaaggaaaaaaatgtaggttgcatataaggcttcgtaaacagaaagcagttgctttcccggtagcagccctgacagcctgacaattttctttctggagtttctcaattaagtgcgaaagtagaataatgactcatcagaggaacatgggtttagaaagttaacctcgagtatctcttttctcaaggagctacctgagaatgtgtttcaggaaaatgagagtgtagacctaggaagtggatgtcatgagatcctgaaacttggggatgtaataccaaagtgtggcaaaaggaagtccctgcactaatggcagagggaggtcccaggacaagggctgtgcaggaaccctgagaagaccccgtccaggtgggaacagaggaaagagagccatagaagatgcctccaggggacaaaaacgtgactgcagatggcctgatgtgtgcaatgttggaaaatgtttgagaagagttttactgctgtgttagagaatctggagagaattcgtggcagatacatagaaaaataagcaaatgaaaaaaataattatggattttaaagaaactaaatacaagaaaatacaattgcaacaaacaaaaatataagaaaatacaattacatacaacaaaatgcaagaaaatacaatttaaagaaaatacaagtagattttattggttggcttttaaataatattacatagtcctaaaatatgaatactgtgctaaattttagtattattattattattattattattattatagtgtcttactgttgcccaggttgaaatgcagtgacatgatcacaattcactgcaacctcgaactcctgagcacaagggatcctcctgcttcagccacccaagtagctagaactacacagctattttttttcagagacaggatctcactgtgttgcccaggctggtcttgaactcctggcctcaagcaatcctcccacttcagcctccccagtcactgcaattacaggtgtgaggcaccatgccaagcttgaatttcaatataaccaaaaatctgtgatttagctatttggggagaatatagagaaaggggctggggaagcaggcttataaaagtgctaaattctcatcttatattcaggaaaatcagtagagaatatctaaaaggtataaatcaataagtagctccagaggtttttttttttaaaaaaaaatacagctgtttaattgaaagagttaaaagtgtgagaaggtgtctctaaggaattgggaaggggcgggaagcagggaactgctttttgctttagtcctagcaccactagacttttataactatgtacatgtaatactttgttagaaacaaaaattaggttgaaaatgaaatgctgtccatcagaaaatgtgctcagaaagcttgaagttggaatcctatactatcttagtctgttcttgcactgctgtaaaaaaatacctgagactgggtaatttataaagaaaagaggtttaattggttcacagttcccgcaggctgtacaggaagcatgatgctggcatctgctccgcttcttgggaggcctcaggaaacttacaatcatggcagaaggcaaaggggatgtacacataccccgtggatggagcaggagcaagagagagaagggaaggtgctgcacactttaaacaaccacatctcataagcactcaatcactatcacaaagacagcaccaagggcaatggtgctaaactattcatgagaaaccgcccccaggatccaatcacctcccaccaggccccacaacattgggggttacaattagacatgagatttgggtgggaacacagatttaaaccatatccaataccaaataatcactggtcggattcaagtaagtggctgctatgaaatttgtgtgaagatatgatagtgcattttctattgatgcttaattggggtttaaaatgatgtgatgatggagaccagcaagcctgctttgcaggctcagccccgctctcctgcactagctagaggtgcctccctggttcctcttgccacacgtgatgagccctggccttgcctaacatgcagtcacaaagcttctcatgtgattgactcacttccaagctgcagagccttcagtgtcatctcgatcattctgtaaagcttttgactccagccccgggctgggtctccagtccctctctacctgcctcattattctgttactgttgactgacccttccagtctcagacactaatttctgttctgtctcacatctttcatatcttccctctcagtttccagccttgcctcctccacttatccgtgctggcctggtccctgccacctcctttggcactctctttgccatatagtgaatctcttattcccagcttggcattctcacccattgtcactttacctccatagcactgaccttggtagcaagtacaaattgcagtgatttcaataaccttaaggttatgataccatcagtcttgcaaatgcatggtattgttcaatgaagtctatagggagttatagaaataaagccatggataaggagaattatggtgtgctagtggaagcagtatccagttatcagtaggtgctaaagcagcattagtttttatttatatttatttagcatctttaacacccaggttaccaaaaagaacattctgtctcatgaggactttgtaaaaggagtgaaaatggatataaatgagaggggcaatgagttacttatgtattgattgaataattatttatgaatggtgactatattctgaggctgaagattactgagaggaaatgttttcatgccggctttcatggagtctatgatcagttgggagcagtatcaacaaacaataataactctttgcatccagaagcgctatcagcactggaaaaggcacgcatataatcttgttataataaaaaaatcccagagattgggcaacagattcctcagaacaggactcagagatggtgaccatgggctggagcagaagcatccatgatttattatttgtaccacactcactgaaagcctgtaagtccacatcccattaagcatgtttacttacaaatcccatccatgtgccactgcatttatatagtgtacattataaagtataactaaaatcgatattaaaggataacatttttaaaataagtaaaagcagaagttctaacatcatctgcctgagccccagtgatcacccttggcacctcctgagccgcactcctactttgataccatcagtctaatccagagtggagtcctccctgttgcttctgaagaatctggatttaataagctcatccagagatttgagataactcacaattgacaactccaagggcatcatgtgataatccagatgtttccaggatagtgggaaaaaccatttgtacaaggcatgacttccccgtgaatgagtctattcaagagatcaaattagattgaagttgcttagtgagcatagaattagaataaatggaattgtggtctatagagatatttcatcacacttgaataactgatggaactacttttctcctctctgcggatatttctgtctgaataaccagtgctgggcctcaaataaatactgacatgttttacttttagctttcctttttctagaatcattttagacaactgcccttctgttaatacatcaccacctcagaaaataagaaggtacttgattggattgaaattttaaaatgttaattgcattcgtatcctggggatacagcctaaagagacagaattgctttgcttaaggctgaagtctggctggggactttgatctctgcaggctctcgggtccttaaagggctctcacccaattaggatgagctgaatccttctggccctgggcctcatctttattccctcccagcttcaggactctctgatgagcgagagcgtagatttaggttttctcacagaggtgcacctgaacgcctcttgctgtgtagtaaggcagatgttgaggggggaggaaggcttacccttgataactagcaacttgagctttgcaaagcgcctttctgttcctgttaccagtagcctacactacatcatacaatattctcctccccaagaagaaagcaacctatttgcctattttctcctactgaaatctatgattttatactttgtttaaaaaaaaaatagcagccgagcatggtggctcatgcctgtaatcgcagcactttgggaggctgaggcaggtggatcacttgaggtcaggagttcgagaccagcctgaccaatatggtgaaaccccgtctctactaaaaatacaaaaattagcctggcatggtggtgtgtgcctgtaatcccagctactcaggaggctgagacaggagaatcgcttgcacctgggagggggaggttgcagtgagcctagatcgtgccactgcactccatcctgggccacagagcgagactctgtctaaaaaaaaaaaaaaagaagaagcttaagactgcactaagattaggaacacattaagaacagtttttaccctaatgaagatatttacaaacatattttgcactagttccctgtttatgtattacctgcgacagtaattaataggaatgccattggctgagacagcttcagagccctagatacctagggaagcaagccaaatcctcttcaatgtaaatactgaaacgaaactaagcttatcagcaatcagaaaccaccacctaacctctaactaaagactttccacattaaccaatcaaacggtttctttgtcttgcatccacaaacacatttctctctctccaaccccgcaccccagtagacaacttgaattctggtgctgcccaattcacgaatcactgaatgtccaaataaacatgttaagattttaatatgcctaagtttatcttttaacatgcctggggacttatctagatgttgctatattctagacatttctaaaaacaaaaacaaacagcattaattaaataagaccatattttaatatttcataatttaaaattatgacttaagcatggcagaaccaacacaaagtaacttttatttgaaaatagtagctcaatttaatattgcatatgtgtataatttgcataaaaggaaggaaaaatatcatttgtgtatgaatagaaactaatggagtgcacttagttgattcattgtgccttttggagaaaagatatagcaaataccgtgttttttaaaaagcatacatttggagtttagtatcagagctcaaggctttagtaactgctttaaatcacacccatatattttagtctttagctgtgacagtaagtgtactcagaaatgtgcacattaaaaaggaatttctcccctgaagatgaagttgagagccaactcttgatcccatattaaattcttagtccatctgtcctaatggagtctgagtaacgcagtttggtgtttttattgcatcctgcgagctgcttttctcctggaaacactggctgctctgtcaggcaatgagtggggagaggcagctggtacaatcacatcttctccaagagctcaaggacagaggctggctgagagccatttggtgggctcactgcctcatccccatactatacaacaatcccacaggccagagcctcacctgcagtccccaggaggaagtaggaagggaagagaaggcaactcacctctgagagtttggcgcaggagaggtgaggaaactgccctagcctagtctggtcacttctgcctcgttcccggctcctcacctcctccaggctccgtcagttgtattcctgaagcacctgcaccaggtgtctgggtggccgttgacacaggagtgagcactggctcttccaaggcagaggtggatgaaaagcaagagcaaactaccaaaaactttgttcttactttgtcatcctgaggtttatctcagatgctgcttgcaccagaccaaagctaccagtacatatgcaggagttcaaaacagcccccacccacccacagagtaaccccaggggcttctcccaattgttgtgtctattggcatttacttcttagagtcccataggactccttggtaggaaccccaactatatcaatctttattgttatataattataaaatattgtttatcataaatattataaaatattttattgtacaatttatagaaattctatattaatatttaattttatatagattgtatatattaatactttaaatatctttatatgtaaatgaatattatatagacacacatataacttttggaaagtcaaaaatatatttgtgaggatttggtccaatgttgttcaacagaatgagagaaaataatgactattgctaatggtacttattaaactcaagcaatgggtatctgttacatgactaggctgatcagggtgtgagttaacctgatttttttgttttcttcccacagggaattattggaatgccgcctctttcccaaacccatcctcctacctgcacttctctactttccaaggggaaactagcgctgacatttctttctacttcaaaacattaaccccctggggagtgtttcttgaaaatatgggaaaggaagatttcatcaagctggagctgaagtgtgagtataagttgcttgtcaactcatggggagccactttcgtcacctcagggtggtccgggtcctgattgtggaaggccttttgattcaaacgtggaaggtttcctttgttccaggagcaggactagaggtggacacacaagcctgagtttgggctccaacctcagtccctgtccttgggatgctctcagggaagcaggcacatccagattctcaagcaattagtcaagaagatgagagagaacacaccgccctgagaatgtgggagaggaatgtttatcttcagcttcatgtcttgtgtggctgttttccaaagagacagggtcaaaaataggtgaggggtgtgtgcattgacccgaggagcagggagtgaggaaaatcatgtcaaggtcaaggaagacaggaatgataactagtgacatccgtgtgagttcaggaggccacggagaccacaggactgggcaattccatgacacagagtctgcaggattcctacagaggacccacacctgcccaccctctgcaagtgagttctggatgtcatgtacttagccaaagatacagagacaataagaggcagagcaagagaggatgctgcttagctcagctcagctggccttggagcaaacatcctaagggggcgttcaggcttggggagctccgtcagtggaaggtgggggttagctgcacaagacttgagaagcgcaatgcttgccctacctggaccctttaaacatcagggccccaattcagctttaggaagttacaatcccctgacttccaggccagttgattatttgcaaatgttgaactccgttggctgtgagagtcagggagactccactggctgtgagagtcggggagatcaaccacaaggacgaggccaggctatgtcccctgtccctttacaaaacctcagccttacactcagcatatcaaaaagtctcccttccggccaggcacggtggctcacgcctgtaatcccaccactttgggaggctgatttgggtggatcacgaggtcaggagttcgagaccatcctggctaacacagtgaaaccccatctctactaaaaatacaaaaaaaaaaaaattagccaggtgtggtggcgggggcgcctgtagtcccagctacttgggaggctgaggcaggagaatggcgtaagtaaacccgggaggcggagcttgcagtgagcctagattgcgccactgcactcaagcctgggtgacagagcgagactccgtctcagaaaaaaaagtctccctttgccaagtctgtcccctttaaatgagtgcttatgttcctgggtctggtctgagaatgatcccaaatccatttcccatttctgctgaaatgctattggattcacagtagcattcttaggttcaattccacaccgtcaggtaaattgctcaatctctttgaatcctaattttctgatttataaaaaggaaatgttaatttgtgggattgtgatgagaatagaatttaaatactcataaggcatttattttggtatctagtagttattgtaattatcatcttctgaggatgcccatggcagatctgatctgagccaggtctgattgaaagggaggctaaggctatcctggtcctagaattaaaattaactaattaattaaaatcccccctttactgaattctggataagaataattgaaaggggattcttgcttccctcagttaaaattaactaactgaatcaaactattttctgacttctacataagttggatcaaattttagaaagattttatggccacaaaagaaaattgccagttctatatttgagtggttctgtaagtttctataaaagtgcttggattcccccatctttattttatgtcctcaagttttgtaaagccacgcctgggtaagaaggaacacatactagatagagggagagcaggtgtttctactcagccctcggggtcaaagaatttctctactttcttctacttttttctttttttttgagacagggtgtcactctgtcacccaggctggagtgcaatggtgcaatcatggttcactgcagcctcgaattcccaggctcaggtgatcctcccacctcagcctcccaagtagctgggactacaggtgcgtggcactgcacctggctaattgttgtggtttttgtcactgcgggatctcgccatgtcggccaggctggtctcaaacccctgggctcaggcagtgtgcctgccttgacctcccaaagtgctgggattacaggcatgagccactgcacccagccactaatttctaattatgaaaaatctttagagctgtcttcagagttttccaggtctttccacagtatgaaaaccatgtggcccatggttcacagtatgaattacagcctccttttgtcaaatacctttactttcactgtatcctttactctgggcaaaaacatgtgaaacgttcaagacccagattcgagcctctaatcttccctcagagccccctgtatctactaataaccagagagggtggaaagacattttcacgatccccaaaatgtcacatattagatgcccatcattatatgtcatctccatcagggttcaaaggagcctcatggagagggaggcagacttctgtatttaagaaaaactacaaagcaaaccaaaagtggtgctttcatgaagaacatggagaaaaaaatggccatgatggaggcttgttgctgtcgctgtctcatcaatcacactttttctttaatttttttttatttttttttatggtgtctcgctctgtcgcccaggctggagtgcagtggtgcaatctcagctcactgcaacctctgcctcccaggttcaagtgattctcctgcctcagcctcccgagtagctgggattacaggggcccgccaccgcgcctggctaatttttgtatttttagtagagacgggctttcaccatcttggccaggctggtctcgaactcctgacctcgtgatccacccgcgtcggcctcccaaagccctaggattacaggcgtgagccaccacgcctggccgctgatcatactttttcagtcagacacttcgccatcaggattcctgagacattgggtagagaattctctcaggcccacttccttgtgtgaggaatcactctgcaaacctaattgttttcacaacagtggcgggctaccagaggggcctcaggaaacgttgattctgaagttaaactctttagaactgtctctatgtttttcccatttagcttgttaggccttctgatctctttctgataggaattcacattttttttctctaagcgtgtctcagaggaatttggtcacagttcatgactacatattgctttccagaatgacagttctgttaattaattacattgtgcccttctgtcaagagtggaagattctcgactcagaaaacaatgagtcagtgtacactaagttaatgagataccatcagcatcttatgcacaagtagaaaaacacagagataaaattagggcaatctcactcattagcatgctttaatggtaacattttaaccctatacttcatgtatttactattcatatttattcattcatttaatgagtatttactgagtatctactatgtcccaggtacagtgctagtgctgaggtaatttagtcaaatcaagtgtgatttctttccctcaaagatctttctgtttgttttagaaagcaggcaagtaactcaggagttatgataataacaaaaatagctcagcttcattcagactttcaggcctcgttccaggcgttttacgtgaatcatctcacactcctaaccaccctgtgaagtgcatactagcattcacatctccattttacaaacgaggaaactgaggcacagggtgagcaagttgcctggccaaggtcatacagccaggaagtggcagagctggtgtttgaccccaaacattatgtgtctgtcccaaagtcattgctgctaaccttaaagcacactgcctcacagaacagatagcaagaaagaggccgggagcactgaggggaatttttaaacctgactggcttgacaaggagcgcctcccagggatggaatgctttaattaaattttgatggataagtagaagccagtaaggtgaagaagtgggggaagaacaggagccagggaaaaaaggaagtttcaggataacaccaaatgaacgaaggtgtcggagactgaaccgaaggacccaggaggggacaggtgcagtggggaggggcaggggccagcaatagcaaggtgggcacagatgagcacccaatgcactctgccagggggagcatctgactcaacatgaccctgaaggctatggagagccagggcgtaacttgatcaggtttgcattcaccagagaaaagactggaagccagacaaccagccatgggagcctctgttaagacagaggcagaatgcatagaaagagaggaagacagtgatgaagcattgtagatatgaaagatccttcaatgagccgagatcacaccactgcactccagcctgggtgacagagcacagagcaagaatacatctcaaaaaaaaaagaaaaaaaaagaaagatccttaacagatagattccacagacattcaacaaatactcgtgagggttaagtggacgggaagatcctagaatgaaaccagtgtttctagttttgatgttgtgtgagtggggcacctttcatgaaggagtctgacattcaagagcaaaatacaaactgcattctggatattttgagactgagtctctgtgggctataggaggatctaatcaagtggacacatctagaggatgctgaatggacaagtccagaacccaacagagaggtctcagaaactcagtttgggagtcatcatcacttagaggatcaggaaataagcattcagtaccctcagcatggatgagattgcccaaaacaaatgtgtagagagaggaagcaagatgtacaagaaagacaaccagctcacacctgtcatcccagtactttgggagtagcagtaggtcacacctgtcatcccagcactttaggaggctgaagggggagtatcacttgagcccaaaagtttaagaccagcctgggcaacatggtgaaaccctatctctacaaaactaaaaataaaacattagccaggcatggttggctgcacctgtagtcccttagcctcctgcccagaggctgaggcaggagaatccctcgagcccaagaatttgaggcagcagtgagctatgatcacacagctgtaccccctagcctgagtgacagagcgagacctcgaggaagggagagaaggaagggagacaaggaagggagagcaggaaggaaggaaggaaggaaggaaggaaggaaggaaggaaggaaggaaggaaaaagaaagagaaagagagaaacagagaaagaaagaaaagaaaaaggaagaaagaaagaaaagaaaaccacattcaaggaatagaaggaagaaaactagtttgcagaaaactaacagagaagtaggaagacagtggtacccagaaaccaaatgaaaaagacatttcaaaaaggaaaaaaagagggttagatattgctgagaggtccctaaaacaaggacataaagtgaccatcagatttaacatgtagaggtcacggtcaaaaagtcaggtatcactagggtgagtggaagtggatttggagatcaagagagggtggttttgttcattctagtttgaggatggtagagactttagcattcatatagttgaaggagaaaactatggtagagaagggggattggtaatacaggagataaagggactggctgaaggagcaaggtccccatggctgtgggcatgaggtagacccagcatcgcagcacctcacaggggtgagaggaagaggcggaagtaaagagaacagcgtaaaccgcccactaggaagtgcctttccaaatcagaatttgttgttgttgttgtgtgtggacgtttgtttgttagtatttttgagatggcaaagaaatattgttcaaaaaaaatttatggagcagatatcagaaaacccagactctaaacttttcttcatcactaacaaccatggatctgtccatgtattttttcagttacccctaagggattagcttgactgctctagatcctttttctgactgagagggccatcataaccagggtcccaacctcgggccaccacctcctgagcacctgccctactgctggtgctgggaggcgctggggaagctgaggtggaaacaggagaacccagcatccacctcctagtgaaggagacaaacacattagtgacagtgtggatacataatttcattgagagctttgcaagtgccaggccctgttctaaagcttttgtaggttattaacttttgtagtttacacagcaagttttatacacattttacagctaaggaaatgagagcatagagttgacactgccgaatccagatatggtgcatttaatcgttaaaataagtaaattacaatgataggcacaaagtattatgaacaatcggtggagaggtatgtgacctatcctgggaatgaaggggaagatgagggaatgcttcagttgggtcataaaaatcaggcaaaaaagttaaaggaatggggaaaagaattctaggaggaagaggcaatgcgaacaaaaacacaggaatggggagtgtgatgggcgtttgggaaactacaagcattttgtattgttagagtgtgaagtatgacacaggcagtgaagatttggggtcaagtctcagatctcattctaaatatatggtcatctaaatatttatctagtatttattgagtacctgctatgtgtgtacctaaaatgaacgtaagaagaagacatggccccatcccagaggcacacaccatctagtgggaaagactagtaatcttaatctctctctgtctctttctctctttctctctctctccctctctctctgtctctcttttaggttcaggggtacatgtgcaggtttgttatattggtaaattgcatgtcacggggatttgatgtacagattattttgtcacccaagtaataagcatagtacctgataggtagtttttccatcctctccctcctcccgccctccacgcttagtacacgtatccatgcgtactcaatgtttagcttccagttataggtgagaatatgcaatatttggttttctgttcctgtgttagtttgcttaggataatggtccccagcttcatctatgttgctgcaaaggacattatctcattcttatttatggctgtgtagtattccatgatgtatatgtaccacattttctttatttgagactagtaatctctgttattataaaactgtgtgtgtgtgtgtgtgtgtgtgtgtgtgtgtgtatatatatatagttttttttttttttggacagattctcactcactctgccagctgggctagagtgcagtggcacaatcttggctcactgcaacctctgcctcccgggttcaagtgattctcctgcctcagcctcccaagtagctgggatcacagacatgtgccactatgcctggctaattttttatatttttagtagagacagggtttcatcatgttggccaggctggtctcgaactcctgacctcaagtgatctgcctgcctccacctcccaaagaactgggattataggtataagctaccacctacagccagcctataaaataatattttggataggataatattagaggtacgaacaatatgctgtggttacttagatgaggcaatatttacttctgactggagaaggagaaaagtttccttgaagatgctaacattttaaaagagccacaaagtaaatggaaaaggaagtttcaggtttagaatgccaaaggaaaaaagcacagcatcatagatggcatgaacacatcaaaaaggtgtggctccgtcatacacccatgctgcgagggttacggaacattagttaccattatatctccagggtcaccacaatgcctggcatgtggtaggaactaaataagcatttgttgaatgaatgaaatgaatgaatgaggtgctagtctgaatggagagccccagaaaatctaggtggagaagcagatcaccacgactgaggtgctggcgatccaaatatagacaaggaataatatgtggaaaggtggaaggacaggtcacggttagtgaaattttggaactcacgatttcacaggaaagcagtttgggcggtaagaagaatgaaaattgaaatggaattttgtaggttgtatcaaaaggctgcggagaaagtcagggcactgggaggccagagtagtgttggttggtcacctatgtcactgttgaggtcatcaatggtgaagacaagaggtgaaatggacagggaatccatgacccaaactttactgtcctggggttcaaacagtgaccacaatatgaacggggagaggacgagtcacaggtggacgcgaagccgtttgaagactctggagccatagagtggaagaagtacggagaagggaagaataggccaactgttcgcctggccccaagatatgggccactcagaaaaggggttacaattctaagggttgtaagttagggtccccttagggtggactgcaatcagaggaaggaagtgtttgaaagtgtttaatgatacaacaaatagtgaccatagagtctatttttgtttaacaatttaaaagagattttagtctgggcacggtggctcatgcctataatcccagcactttgggaggccgaggtgggcagattgcttgaactcaggagttcgagaccagcatagccaacatggcgaaaccccatttctactaaaaatacaaaaattagctgggcgtggtggcacacccctgtgatcccagctactcgggaggctgaggaacaaggatcacttgaatccaggaggctgagattgtaccactgcactccagcccaggtgacagagcaagaccctatctcaaaataaataaataaataagattttagaggacatttgtgaaggggatttttggagggaaattttgaaggaaaagctcactgagtaggtaacattcaggaaaagcaaccagaaactgttgtaatactttaacataagcttccatgttgcccaagtttgagatttttaaggtatcaggataacttggagggaatatttgcatttagcagacatatctccacaaaaatgtgcaggcagcggcctaatgtcctactaatcttaggaaataatatgaggaaaaactttcatgttcaagatgcagccttatgcaatatacatgctcaagaaagtcagaagaaaatattctgcaatatacagaaactgatgagtcagaagaagtaaactaatggcaatttatcttccagtatttcaaaattggaacaactttttatttttaaatagtttcactcttgtagatgtgaagaatgtctaattccacttaactgggctgttgttctgttggggtgttatttaggatgttttaaaaaatattgtgttttttattagtacaaatcaggtgttagcacctggatttttcacacatatattatatttatttatttagaggcagggcctctctgtcgcccagcctggagtgcagtggtgcaatcttggctcaccataacctccaccttctagacttaagtgatcctctcacctcagcctcccgagtagctggtaccacaggtgcacgccaccacactcggttaatttttgtattttttgtggagacggggtttcgccatattgcccaggctgatcttgaaacctggactcaagcgatccacccgcctcagcctcccaaaatgctgggattacaatcgtcagccaccatgccgggcctctggatttttctttttaattatccaagccaacttgggttatcaacatggatttaggaagaattttagtgtttctactactttgcaagtctaattatggtttcaatttatattcaacatttggaatctgaaaagtgattctgacttggtcattactatacataagaaaaaaaactattctctccccaaaaataaaatttgaagacctgaatatttaataacaacacttgtgattaaaaagaaattctctaacttctcgatttaaacctttgatttgaattacagaccaaaaagaagtttggaagtgtaaactaaaatgaaatttgtgctatattaaagcttttcatataatagctttttgttcttaataaatattaaaagatatataaatagttggtaaatcaatttagattaaatttatccagatttctttgccaattacactgaagggacagttatttgaatgtacagtagaggtatcctagagttatgaagatggattttagaatagaatgtcttctggatataaaaatatttcaagttactttagagtttactggtccactcatgtcctgatctggaaatttccagagaagattgggaattcctcctaagctggccagacagagtgacatctctctacagattctagagttctgcctctctcccactacacttcagaggtggctttgaaagaccacccaggcctcctgaccagccctctcacgtggcagctcctatgggtgccacataaccgcagtctctccacatcgcctttcctccccatcgtggagggtaccttcctggtaccaggaaggatcttccatttgaagatacaactgccttcttggtaataattcctttgccttgggcccacatcctggattccaagtaaccaagggcaggctacttccagtcacacccaaagagatggcttgtccctcggctggggctcaacttctgctttggaaaccagctgaagtccaggacacaggctccccaagacctcactagagatctggtgtccttagactctccctattaaactccagcttatttacatagtcacgggcattttaggacaataaaaagaaagtaaacatcagaggcaggatttcctcaaagacattacattgtacatacatgacggtatgtcctgatttctttcatgcgatgctcgaaaataacctaagtaatccacatcgattactgcagagaagccagaagagtaactattcctggggatagctgatgtcaactaggagggggtgcaaaggaactttctgggtggtagaaatagtctttatcttaatgcaaggaatgattgcatatgtaaaaatgtatccagctgtgcattaagatatgcacattttaccgtgtataaattacagctgaatggaaaagtagaaaaagagaaaaactctgctctgagaaaatcttgaatgacaaaaaagttaataaatcactcaatttttcaactacacttagagagaccaggattctaagctgactgaccagagaccagtccttgaacctctccagactttatcatatccacttgtaaaacaagaaggttgaacaagatggtatttaaggtctcgtctaccatgaacaattcggcaaacctgccggagaccatcagccatccagtgtggcttaccacctcccaacctaagtgaactcacagccaagcagcaccttaacttttcatgccagggttctcagttctcctaaggatgatggggggagggatgtgccacaataaaacacatctgcttccagtaattccagtcagcatatatgctttcaccaaacgtagtcaggagatctcctaacattattgccacctaattgtaaatgctaactaaggagccatcagaatggcccacgatacctcaagctcaacatatcgaaactgaaatccatcattttcactcaaaagcccccttctgtgctcccacttagttaatgtcatggccatcttcttcattattcaaattagaaaactcaatgtcctatttaaagttttactaacctccccataggggatagactgttttatcttgatagaacactgcatttttaatataaagaaatgctattcttcctgtaagccatcataccagaacaatgccacagaaagcatcaattcctactagtcataaaaggcagctggaacatagatgtgaacataatgaaatcataccaaatgtctctacctcccaggatggctttgctagttgaaatccctggattctggattcagacaggctcataatttgactccctcactccagtccctctatcctgataaccaccctccctagtgaggccaaatttctacagatctggtccagttactcctttccttacagaccaccatgattccccctgtgccttataagacaaagtacaatcccaagcttggtaagtgatttacggcctaacttaattttcaagtttttttcccctactccatacaagctttgcccctcacccaccagcaccatgtgccacagcctcagctatgtccagctactgatattccctggacaccactacagtttcctaagactgactatgtgtctgcctgttccggaattgcttccccttcattgaaatcctgcccacacaaaattttttttatcattttgcatcttgatttataatataaaaaataagacagaagacttcatttccccaaaaataccaaaatttttacaagacaattcattaggtgcattgcctggaaagtagcaggaatcctcattagtcagcatcttcacatagcatttgtctgaatggagtagtttatcattactccaaagacatactgaagtttcattaaaattttttgatgtaatttttcttctatctcactctcttggattctaacgttttcttttctcttttcttcttcttttttttttttttttttttttttttgagacagagtctctctctgttgcccaggccagagtgcagtggtgcaatctcagcagctcaccacaacctccgcctcccgggttcaagcaattctcctgccttggcctcccgagtagctgggaccacaggctcacgccaccacgcctcgctaatttttgtatttttagtagagacaggttttcactgtgttggccaggatggtctcaaactcctgaccttgtgatctgcctgccttgacctaccaaagtgctgggattacaggcataagccaccacgccctgccaacactttccatattatttactctatgtggtagttcatgaaacctttcccttctaaaagatggcctgttaaagtgtcaaaaagaccaacaactagaattggcctgcctatgaccatctgtaagacaacagaccctctaagagaagaaatcaaagaagtttgaattcacacattctgagacagacggaagaaagatatgctattattgctggataatgaacacatggatttatgagaaaagcagaaatatatatgaaaaatttaaattataataaggttagagactttccatctgccattctaggagctaacagtatctccataggcttgatatttttataaaaacaagtgcttcaagaaaagagttaacagtcagtcagtgtgtgttgctaatgctggagaattgattcaactagggatgacacttgggaccaattaattcaaagctggctttaaaaaaaaaaagtagatacaataaatcagggagtagagcttcatttaaatatagtgagggactgggatagattacttgaaaaagctcagaaccaaagattgtctcaaaaggccaaagacaactataagtaaaacaagtgctaggtttctataagctatcaaacactgaaatcaaaaccatgaaagaaaatactggccaactggatgtcaactggaaaatttatacaaagtttgttaatttgtacttgtatcccctcaatctataaaaattttaaaacatgttttaaagcaacaagaaataaaaacagtttgttataaatgaaaattttcaggaagttatcgttctcaagatgcattttactgaaattacaagacaatttttaatagcaatcaagtaggaaccttgaggagaaatggggaaacgtaaagacttacatgaaatcttatacgggagtgtggtcacagtaaaaatatatcttctttaaaaagatgtttctatttcttttgtattgctgttttacctttaattttttaattttttttttttttttagtttaggtacttctcaatttttaaggggattgtgctctagaagtttctgatctagttgttcagaacctgaaatgtattttaatgtagacaccgcattgtatatagcactcacattccatagctaaccgtaaagagctctgctgttgctgtagttgagtgttgattcaaggtacacaggacaggctgagatctgggtcctggcttctggaggccatgagatgtagaatagaaatgttgaagaacaaaaagaattgtttcttgtatttctgaaggtcaagcttgagcatgacaaacttctccacagggaaagtttttatttgcctttttgatagtcaaatcacggtcctgcctctccttttgttgggagcctcattttggtgggttagtaaagggaacatctccaacattcataggagcatttgtttaaagggctcccacgtggcttccagccacttctctccactctgaaacttctatgaattagagaatccccctaattcattcaaatatattacggcctatatttttttaatattacaatgatctgacacagttgggtattgaaaatagagtaaaaccattacaccacaattatcccttcatccctgatgaacatcctcttgtccatttttttaatcatacgaataaatgaaaaaaatgtgataaggtcataagagagttaggaacattatgtaatcttctttaaaaataagataagctgctctacccagtaaaaccctaggtttctgcagccatatgacagtctgatatgcatgctatggtcggtcacggtggctcacgcctgtagtccagtactttggaaggccgaggcaggcagatagcctgaggccacgagatctagaccagcctggccaacacggtgaaaccctgcctctactaaaaatacaaaaattagctgggcatggtggcgtgcgcctgtaaccccaactactcaggaggctgaggcaggagaatcgcttgaacctgggaggtggaggttgcagtaagctgagatcgcgccactgcactccagcctgggtgacagaatgagaatctgtctcaaataaagtaataataataataatatgcatgctatgctctggtccatgaagaccttccacacagtgatttagaggttcagactccttttctctgtggctccaccatcgtctagagcccgggaagtctagctggcaaagagagaaagggaggatagagaagcattctctcttcttgaccacactgaaccagcgtgaacacattccttgccctcctccctttggtaagagctagtcacatgtctccacctggatgcacagggaccaggaaggcagttactggctgggtagcagctttgcgggagtgatgatgaaaaggggaaagaaaccttctgtgaatggttagtggtctcttttacaggtactatgacaccaaaaaggagtaaactttaaagacaccaaggtaagtttccaggagatgcagcatttgatttgcattgaaggatgacaggcaaaaatgagataagggcatttttctggagagaaaacagcataggcaaatgcaggtgggggaggaagaccgtgcaacatagaagcaattgaaaggaataaagccgaagcccaaggaccacttcaaagatacctctctctagagaaatgacccaccgcctatctgttaagagtttgacaaatgaaatctggctgaacctcaggccttgtcggaaattagtcattttgcttgcctttgcggatggtgttaaaatgatcaaatttggttttctgcatctctgagtttgattcctctgatgagaactgatgcgaatgccaactgactttttatgaagagtggttgatatttagtattctacagagtctttctgggtaagtgtaaccagagccagtgaataatagaagcagtgtatatctgtcaagtgtaattataacactgaattatgctcatcctgcattccggttcctgtatacattagtttaaacatcagaacatgctggcatttcagacctgtgaggattttactttgaaaaatagcatgcccttgtttttagccatttttaacaggaaaaaagaacttatatcttgttcaaaattattttatggtaaagtttgaccactctgttttttaaaaaaatcttctcaagtttctaaaaatagggaagaaatgaggaatatttcagtctagttttaaatgccctctaattttctgtatttaaataaaatcgtatacaataaaataatatcttattttgataaactgaactttctgattaaatagttgttaaagttacagaatagagttgcttataaagtcaccaatctttgccagagaaagtggaaattatcagattgtaactttaaaattatgcaagtattgtttatcgttgaatgatttaaaaattcagagcagcaaaaaggacaaaacaaaaattcagctataatcccatattccaatatatttaaattatcattttggtgtctatatttctaaacatttttctatgcatttatatatactttttttttacaaaaatgagatcatagggtacatactgttttgtaacctacttttttatgtaataatattttaagaacacattttcatgtcatttttcttaagactccataacaatatttttttttcaactgagaacaaggaccataccagaatctccaagagggcatgtgtagtttgaaaacttataattttatatttagaaagaaaacccaaaaatagctattgttttggtaatataacctacagaatataaagcatagaaatttccaattggctggtcggatgtttatctgggatcttctgaggtttgttatattaccattagcctcctacatggggcatgattagattactatgtcaacaaatgggagcacagattttgaaagattgtgaaatacagtgcctcaactgccaagcattccatttaacccacagtcccttgctgttgggcttaacttttgaaagataaatttccacacattctgatccactggcttctggttgctcattcccaatcataacatatgatagcatactatctattttaagtatgtgatatgcgattgctttttatcacatactcacatatcacagcctcaagctgcagggcagctcaaatgatgaaagtggaagacaggccgggtgcggtggctcatgcctgtaatcccagcactttgagaggccgaggcaggtggatcacctgaggtcaggagctccagaaaaacctggtcaacatggcaaaaccctgtctccactaaaaattgaaaaaatagctgggtgtggtggcaggtgcgtgtaatcccagctactcgggaggctgaggcaggagaatagtttgaacctgggagggggaggttgcagtgagccaagatagtgccactgcactccagcctgggtggctgagtgagaagaagagaagagagcagaggggaggggagggggggaagggagggatggggaaggaaggagggagggagggaggaaacaaggaaaccacactggaaggaggaaggaaggaaacaaaccacattgggaagagagggaggaaggaaggaaggaaggaaggaaggaaggaaggaaggaaggaagggagggagggagggagggagggagggaggggaagggaagggaggggaagggagagggagggggaggtggaaggaatggagggaacggagggaggaagggagggaagggagggagggaggaaggaaagaaggaaggaaagaaataaacaaacaaggaaaccacattgggaaatccaagcaaagatgggctcagcaggtcacatggtttggatatttgtccctccaaatttcatgttgaagtgtgactcccgatgttggaggtgggaacctagtggacagtatttgggtcatgggggcggatccttcatgaatggcttggtgctcttcccatggtaatgagttcatatgagatctggttgttttaaagagcttggcacctcctcctcctctctctcgcttcctctcttgccatgtgatgtgctgctgttccttcaccttccgtcatgagcataagcttctgaggccctctctagaagtcgatgccagcactatgctcatatagcctgcagagccaagagtcaaataaacctcttttctttataaattacccagccctaagtatttctttatagcaaggcaaaatggactagaacagctggatagtactgctaaccgatgaccctatccccaaagctgtttccattcattctctttgttgagagtatgtcaaaccatcccaggatggaggctggagatgagtttaaccccacctgcaactgttctctcgatggagctactctacagaaaaatcatgttccattagttcactaaatcgtaacaaaagtaaatgtacttgtttgaacattgtacaaactagtcctaaaagggttctcacgtattttatatgcgcagtctttagggaggcaaaaatgttttatgcaatctatacaagaaagttatattttcagctgttatccaaaacaaaggaagcgtactctgtgaaaaattggtattattgtttaacaatatccatttccagaggaatgcttttcttaagtagaagttggctgacacaaccataagggatgctgtgaagtgatttctgtcatttttcatacatggaaacatatgaactcaagggtctactaactcttctacaactttaaaggagcacttatcctgggatactttcaaacctgagattctgagattctatatttttaatgttcaacccttagtttcctcatttctaatattcattactaagtagacgataaagatcaagttaagcatagcttcagaaaaactaataaaataatttaaattggttatgcatctcttgtgacgattctaaggcaaaaggcacttttatagaagtctttcacactttaagaaagcttgctatatagaaaatgattcagttgggcacagtggctcacgcctgtaatcccagcactttgggaggctgaggcgggtggatcacctgagttcaggagttcgagaccagcctggccaacatggcaaaaccccatctctactaaaaatacaaaagaattagccagatgtggtggcgcgtgcctgcggtcccagccactcgggaggttgaggcaggagaataatttaaacctgggaggtggaggttgcagtgagctgagatcacaccattgcactccagcctgggcaacagagcaaaagtctatctcagaaaaaaaaggaaggaaggaaggaaggaaggaaggaaggaaggaaggaaggaaggaaggaaggaaggaaggaaggttctcctttcctctctaatgtctctccattcccatttaaagtctctgttgatctgcagcataattttacttttttctccactatttgtccaatactgcaaatgcactgtagttgaagagaatctgttgttgtaatggaaaacagaatcaatctctttttatactctgagcctatagcatgtagtatatatgtcctcatttggcactttttaattttcattacagagatcttctctgaagtcatatcaaggtgacactgaaaggatttgatagaaaggaaacaatttgtggcaaaacagagagagaaaaatactacctgtgatacaacctatcggcagagtcacaagtcagtccacagaaaccagaaaacagacgtccccttggctgctttccttctgatagacttatctaaagctctcactagcaagcatgctccttccaaagccatagcctttcatcctcagagttcatctttggcttttcctcattatcagtgtccctatcaagatagccatgcatagcacagttatttagaaggcacaattaattgacttgtatgctgtctccttgtaagcttcagcttggtctgtgttgaaacttgtcagcttttcccccaattcatgttgtttcaacctgcagttttattacctcctttggatgccaaattctcctttctccttgcactctccaaagccatgtattttgatgaactggctctctctgacatcacctcaaaccaacttaataaatcacccctagtcttctaccaaagcacatttccttaaatgagttttctcattttgccgcacaacctgaatatggtcggaagaaacacttctttgaagtccatcccctcctcaatctgctctcctcttcatctctaggggatccttaggtatgagtttcagagtttctctaaagcagcttctgggtttccctttattacaacactctatccccagagtaaccatctgggacctttatctattcttccaaaatgggtactgtctgcccaatgaacagctgtgctctttccaaacaagagggtatttaaaacccaactgcaagtcctacatggggtacaggggattgttgccagccacatatcattttggaactatttttgccttctttctttttaaatcatataggcctattaatattcaaggagttattctcaaaaggtggttaaatgcatagaaaaactaaaattagaagagctttgcattttaaagacagctttctgtttttgtatggccaatggtatctcccttttgcttccttttctctgtggatgtctttgtttgtgaagttattttttaaccataataaaaagcttaaaggccaaaatacataaagagaaatacttcttatactcaagaggttatcgagataccagagattttaaaatgagttcgtaacattgattcctaagctccaggcatttccttgaagaatttccagaagacttcaaataaatttttcttgccaatgttcattttcagatgtgtttaacaccaagttttctggtgtgaatatgcatatatgactctaaaaatctctacattcagaaactaaaactatactaaaagaaaaataggtcattttttatttccttcataatatgacaggcaatacagtagttaggaaaactaaagctctatatctagtcattactggattttagtgtctctcagcctcagtttcctgactaatcagtgagggtgggctcaggggtcgaagtctattcactgaagcttttaggtcttaacattattggattcaatcacatacttcttttttttgagacagagtctcacactgttgcctggtctggagtgcagtggcgtgatctcggctcactgcaacctctggctcactgcaacctccgcctcctgggtcaagtgattctcctgcctcagcctcccgagtagctgggattacaggcaccctctatcatgcccagctaattttttgtatttctagtagagatggggtttcactatgttggccaggctggtctcaaactcctgacctcataagccacccgcctcggcctcccaaagtgctgggattacaggcatgagccatcgtgctcagcctcaatcacatacttctaagctgatgtgattgtttctgtttttgtggagttacaaccagttgcaaatttagagagaccacattccccataagactgcatatgcttctgacaccaattgcaagttcagaagttccccaaaccacccccaggtttgatagttctgtagaaggactcacagaattcactgaattctgctgccgaaggctgctatactcatgctgcattatgggtgaagaatgcacgtgaaaatcagacaggggtagaagcacagatggcagagtccaggaacagtaccagatgctgagtttacagtcaacctctctatatagattcaggagcacatttctttcctggaacgggtgtgtaacaatttgcatggggtattgccaatgagggaagcttcctgagcctccatgttcagagtctttactgagactccgttatataggaatgattgattgcccacatggctgacctcagtttccagcccctcagaaggctggagaatataagccaaagccccacacccttcatcacattgttggtcaatctggcatggtaaggccccatcttttttctttttctttttttttttttttttgagacagagtttcgctcttgttgcccaggctggagtgtgcaatggcaccatctcggctcaccacaacctccacctcccaggttcatgtgattctcttgcctcagcctcccaagtagccagattacaggcatctgccaccacgcccagctaattttgtatttttaatagggatggcatttctccatgttggtcaggctggtctcgaactcctgacctcaggtgatccacccgcctcagcatcccaaagtgctgggattacaggcatgagccaccacacccagcccaggccccatcttaaatgccatctggtgtggccctacccctaaaacacaatgttagactatctggaataacccaaggctcccaggcaaatgaagacatgcttaccaggcaggacatcccaagggcttagatattaccttcccaaagccaaaggcaagggccagacctcttgagggcaaggctaaattctctattacacagttctgaaaatctctctgttgaggacaagaaagcaaagattcctaggacttactactagaaggaaacctgaaactcctaatgtttcttaaagtaagattccaggaccacttgcgtcagaatcacctggcattaacaaaatgcagactccaaagccccaccccaaacctactgaatcagattctctgtaacagaagcattggaatatgcattttaagcattttcctttagcagttttttatgtaggccaaaacttgagaattgtaattaagatccaaggtccctgttcctacaagtagagtgaaactagcatgcaataaagcaaagggagaaaattctgcttcttattccactggtgagtttatcttgggcaagccattagtcctcaaacatcatatgtttgaaaataacgtttagctacatttgttttaaacagacataactaatgtagcatgctcttagactgagaaaatattcattgagttactttgtgctcttgggaaagatgcttgtggaatacaagatggaactccatctagttcggctggccttgggaaaatgagtggatttctcttttcagagtatccatgtgatcactgttgccttcctaggcaggagtagtttctattcatcctttcattcattcacaaattggtatctactgtgtggcaggcaatgttctcagtgctgaggagagaacaatgaacaaaacagaaaatgcctctgccttcctgaggccaggaccacatatatattattccagatagtgatacatgctatgcagactttttaaaaatcaggattaaaggggaaaggacagctgagagcgaagtttgttatttaacatagaatgtttagggatggagtttctaatatgatgacttgtgagcagagaagtaaacgctcagccacagagttatttgggtaaagtgaacagcaagttctaaggccctggggcaggagcagtttcaaatgttgtgaaggagaaagtcctatgtggtggaattagaggaagactaagaggagtggaaatagatatggggagtacagacatctctttcaaggaatttggaaacaaaagggtgcatagaaatgaaatggtaacttttgggatagataaggtcaaaagaaaggttttatagtgccagtggttgttaagagtagagatatgtctctgtgtgtgtgtgtgtgtgtgtgtgtgtgtgtgtgtgtgtgtttgtataacaacccagttgtagagggaggggagaattgtcagagtggtgtccttgagctggtaggaaggatggcatcccgtgtataggtgcagcagttggccttgaattaggaacatagatgaactctttacttctttctccttatctctctgattcccatggcgaccttattttcagccttcctgcctcttctcatgaccctttcgtgttaaataaatccttttatcttctgatgtacagttagtacttcattcagaaaaaaaatacaggaaacaaaaaaagatattgataacactgttcaccatagagtgaggctgaaatatctgttctaccaattaccagttttgttgtatgactcaaatgagatttattgtacagaagatcccccaggaagctgccacccctcgaaccttattttagaatggaaaaaacgtatcattaccaaaactaaacagtgttagctggtctgcccatcatgctcatgctatataactttccttctcttttctcttatcctgttctgtactgaatggccaaattttttctgctacttcaactgaaactgtggtctaatatctaaatgctccctcacctgctgagaaaacttagagccaaaaacacctggtattggtcagttgttaaatttatcgctcaatatactaagcttggagtgatttgttgagttagaatgagagcaaatagtgccacctgctggaattacacttggaaggggaagcgtgaacatgccaagagctctccatggttttgtcccaatcattactttaagcctttcagatgaagtcatgagcctgctttattagaaagtaatttcttccacctatattcttttctgatggcaatatgccaccttatgtatttctcttttagtatttctcttttctccctgtaatgattcagtatctaaaattaccattaagaccagctgtatttcattttatttctcttagaatctcttgaaaaattatagaatgttgccatttgaaagaaccttagaggttctccgtagtttcaaacacattttggacacaggaacttttgggaaactatggatataatcctcactttggacctcaaactgaggcctgaagcgtgaaaagtgaaaagaccaaacagctgaggctctatatcagttaagatgctttcagttacaataaaaatggcttgagcaataacataacagcatatctcacataagaaatcctaaggtagatggctctgggattaatttaaaagttgagtagaccaggtgtggtggctcatgcctgtaatcctagcacactgggagtctgagatgggtggatagcttgagcccacgatttcgagatgagcctgggcaacatggcaaaaccccatctctacaaaaaatacaaaaattatctaggtgtggtggtgtactcctgtagtctcagctacttgagaggctgaggtgggagaatcatctgagcccaggaggtcaaggctgcagtcagctatgatcacactgccacactgcagcctgggtgacagaacaagaccctgtctcaaaaaatacaaataaagaatttttaaaagttgaacaatgtcagccatgacccaggctcatcctctgtcctctctgtcctctgtatctctgacatttgtgaggcagctccagcaacattaagaaccacagcttcccacccaatattaaggggcagaaaagggactgtcttttccttataactcaccaaaagactccactcatgtttcattggctagaagggaattatgtgtctcatccaaagtgggtagctggcaaggagcctggaattgccatctttgccttcattaaatccagatccatcctgtgggccttgggtagggctgtccttatgcaaagtgcaagactctggaaacacagagattccagggcaaaatccggttagctcacaaagaaaaaagggaaagtgactaattattgggagaaaaatctccatgggtctcttccacttttgcctgccttctgagcaagaagcattgacagctttgtttataccttttttaaggatgtgtgtatagctaacagccttggaagatacagatagtgtcttcctctgggacagagggtagatttatttcatggccagagtaagaaatataatgtcactctccggggcagaaattgagcaagtttgctagtagctactgtaaaaagattggggtttcctaagtccagggtccctcagctgtgaagcaaacttattgcatgtgcagcatccacctgggatgccctgcattcccctgcaagggaaagcaatgtgaacgggaagctcaggctgcctgctgtgttgtgagtaaagaagtcctttgtctctgacccaggagtttcatgtcttctgccagcatcatcagactgtggccatgttaaactatggttctgccagcatcatcaaaccatggctaacttgttagcctgcaagtggggtaaagtctcagacccttcccagttcttgatactcatggaaaggcaaccattcatgtttggcacagtgttctttccaatgagccaggctatatgcatccaattctcaaatacttatttctggaaatgagaatttgttcggtatataagaaattcctttttcacaggcagaaacagggcaacacttcagtctccaactggagacacacattaagcgaggacagtgtcattggctcaagtgtcttttatgctgtctcccttttattcgctcactctctctataattatctcttttaaaatgtcagttgctctcacccagaagaccaagagcaatcagccacaaactgaacttagaagcttttaaaacacactggctgtctgactgggggatgggatttctcaaaggcttcccgcagcaatgtcagggaagctgacattgagtggctgagaaaaaagagccctttccttggctctcacagtgggtctttcagatccttcctgaggaagcaacggaaggggtgtggaatgtgctgacttcataaatatttctccagcagagcctgaatggaggctgtttgggaagaaagttgctcgtggggtcctttggccttgagtccctcttactgtatcccattagggtgagaggctctgagctacggcatcgtcctggcaactttcttcccttctccagaataaaatattgatgttaaggtgacggtgaagaaataggggatctattgggacaagcaaaaagtatagatattttctagcgacttctggcactcagagtttttccaagtagtgacagtttgaagacctggacacgaattcatcatagcagtaggagaatcacagaggaaattagaacagcatttatccctacgagtcaaaccttagggttaaactcaatttatccctaaattctatttccttgatggcagttgatgcctttaaaatgaaacaatctttcctacttagcccaggaaccctcgttctcttgctgttctgacaacttacatttaaaaaatgctcctgctaaaatacagtgttatgagaacagaacagatttaatctgaaaccaaggctactttttcctcatctgctgtatcagaactacagagaaagatcacacagcctgtgggtcatattatcatcttcctgcattctgatcatacttccatggaaaccttgatggaggtcactggcctgcaagttcaatccagtcccaatgacccctggaggcaggggcttctaatttagatgagatatttttctgaagtgtgtgtccaatgaccacaggtgttgaaatgaaagttctctcgctaacgacatgaaggatcaaaattccttggtacaattaggttgattaaattgagctctgtgtctaatatccctgtagctcaataaagttaatgcagctttccaaggggcccaacacagaggcagggaacagtctaggtcctgagagaatctggcccaccatggtttctaaattagaagtttgattgcttgtgacatcgtcttaaaatggtaccagccaaaagaagctgaattttccattagcccaggaaaaaaaaatgacagatatttaattaaactgcttagagattaggtggaaagcttattgatggacagaggggctgaatatctttataagcaaagttaggcactggtgtgccacatctttaatgttgagaagaattcacccagcctaagggagctgaagacgtgtgtgctgcttcagcctgaggctgcctctcctgtcaatcacaagaaaaaatatacatttaaaaagcttgtttataaagcactaggtggtcactgaggaacttaacataaaatataaaatgtgaaattagaaagctacttatagctaaagttaataaagcaaccacccaatccatttgccaattgttgagaggtgactaattgcagaggaaggttgatttggaggtgatctctaaaaaaaagaatttgtggtcagtgctagagggtaggttatgagaaggagcctacaacccagatggggaataaccaaggtttgcaacagacgatgtacgacagggattattctccagaaatgttgtgctacctttcaggtaggcacaggtggtcataaaatgtaggtcaccctcattacaccaacaataggtcaccctcattacaccaacaataggttaccctcattacaccaacaataggtcaccgtcattacaccaacaataggttaccctcattacaccaacaattcaagggtccccaactttcaaaagagtataaagatcaatgaaatcaagtttcataaattcccccaaagcagtagctctcaactctagctatgtgttaacatttcctggggagtttttttaaaataccagtgccaactcttgaccaactgagtccaaatctctggacacaggtgtttcaagagatctccaggtgactatgaatcacttcccaaggagctacttactgaaaaggtaaattgtatgtggaattagaagatatcaggctctgaaatctgacaaaccttggttcagttcgtgactccactaacttactgaatctaagacactcaacatgcgctaacttctccagacttcagtctccttatctggagagggtcaatgatggtcacatcttggaaggcttctaaaattaaataaggaaataaatatatacctgacacatagaccccccaaaacacccttggttattaatggttaatgattgacattttatccttcttccattgattttgccatcgacctttgtaggacgtgacaggcttagatgatttttcctctccctgctttgtttgtcgtctagaatttactgctatttggtatctgggagaaaaatactcatgtttttcatgctttctgctcctccagctgccacagaagtgtccttttcatttgatgtgggaaatgggccagtagagattgtagtgaggtcaccaacccctctcaacgatgaccagtggcaccgggtcactgcagagaggaatgtcaagcaggccagcctacaggtggaccggctaccgcagcagatccgcaaggccccaacagaaggccacacccgcctggagctctacagccagttatttgtgggtaagtaatggaaaggtaaccatggcttccctctgttgatttttaagagcctgcacaatacaaaaaaaaaaaaaaatcagcctatgcaaggtttgatatagagatccttccaaaagtaaaggtgttggcctcttgtagtctccttcaagacagaatggaataaggaagaagtttcaggagacctagatctcgttccacttccactcttgggagctcactgtcctcagctataaaatcagagtgcaggctgagacatctctcaggtctctctaatatctgcaattttaggtttatggttttagaagtgtataaagttatttgatcatttggggcacttgtaactgtgtggaaggaaaggaaggaaggaaggaaggaagggagagagggagggagggagggaggaaatgggctaagttcagatttttttgaaatgataaatataaagccattcctttcttgcctattctcaaggttctaggcagagaaagatttagacttttcctgacataggaaaaaagatcagtacaaaaaagaaatttaaacagatcaaaaagttaaactacctatgcaagaagtggatccagacacccagtctaatctttttcacctgtctttctgctactgacatatttcagatgaacctaaaattacttcaaattcatacctgcttcccatggctagttgaattttaaattttgtttttgagaatattcatatgttaggaaattagcaacttttcctctgttgaatgaaataaagaagtgagtttgaaggactttgtggatgcatcatcttagacccctctctagggggtcaattgatcagtgcagtcaactgtggaagtctcagacaaagcaagataagaatgtgacttggttgctgttcatattcataacacctgccacttgggctccaccctacgttacagcctcactgagagccagttaattttaacaaggggcagagtccccacagtgtctttcatagttgtgttgggaagcttgaagagcggtagaatgtcattaaaggaaaggtaaaattagatctccattcattttgtgtgatgtcggccaactacaaaacaaaggtgtgggtcaatgagctttgaaagtgagactgacttttaacaaccacatcagctggggctataaaagagttatagatttagaaataaagtatttcctaattacaactggaaatcagccctttccaaatccttccctcaagttatagatcacaaaattacacattattttttaattagctaaatatcaggtccattgatccctgctgagcacagtgaagaaatttcacttcatcaacatgtgtggcccagattagctaggacaagtttcttcctaaatactgttaattctgaacatgctgggtagattctatctggttttcatcataacaggtgaccctacttgactcaacttctcgtttttttgaccctgcccctggatatagaagtccaactttagttttgttcctttctgttggctaactgtggctgtgtgtaagaattttgaagacctagtaaggttgtaaaatgaagagatggaagagtatttattatggtcttggaaggaacatcaattcacttaaagaaggtgacccaataataacttaagaaaagagcaagggcctgagatcagaattctacagaaccatggaatataagggataaacagaaaaagaatatctcaggaagaatgaagaggaatagaaataaggaaaattaggagagagtaatgtcacaagaggaggaggatttgattaaaaaggtaatggcaaataatatcaagcaccatgagtaaaataaggctagaaatgtgcgtgtgtgtgtgttttgagatggagtctcatcctgtggccaggctggagtgcaatggtgtgttctcaactcacgactcactgcaacctccacctcctgggttcaggtgattctcctgcctcagcctcctgagcagctgggactacaggtgcatgccagtatgcccagcaaatttttgtatttttagtagagaaggggtttcaccatgttggccaggctggtctcaaactcctgacctcaggtgatccacccacctcagcctcccaaaatgctgggattacaggcatgagccaccactcctggcctgtgttgttttaatttagcaattgtaaaaccattgatgaccgcagaaacagaaatttcagaacaggaggctgacgtgatgagtcagcaatttcttttgactagaaaatagtctctagtcccagtttctaattcctgtcaccttaaagggaggcacaaggcacatctctcagatatgagctactttagccaatttgtgaaatattgttcggcaatagaagtctacctcaggtgaagtgagaggggttgttacaaaaaaaaaaaaaaaaaaaaaaaaaaaaggacggccacggtggctcacgcctataatcccagcaatttgggaggccgaggcaggcggatcatgagttcaggagttcaagaccatcctggccaacatagtgaaaccctgtctctatttaaaaatacaaaaattagggctgggcgcagtggctcacgcccgtaatcccagcactttgggaggctgaggcaggcggatcacgaggtcaggagatcctgaccatcctggctaacacggtgaaaccccatctctactaaaaatacaaaaaattagccaggcatggtggtgggtgcctgtagtcccagctactcaggaggctgaggcaggagaatggtgtgaacccgggaggcagagcttgcagtgagccgagatcgcgccactgtactccagcgtgggagatagagtgagactctgtctcagaaaaaaaaaacaagactctaaaactaacacctagttcaacagctatgaatttctggagccacttatctccaaactattcagttagaatttagggacttaggtgttagtctcagttcacctctaatataaaagcattttcttgaccaactattaccatcttccctctctgagtatcttctatttctatgttttgtttgtttgtttgtttgttttacatggagtcttgttctgttgcccaggctggagtacagtggcatgatcgtggcttactgcagcctcaacctcccaggctcaagggatcctcccacctcagtccccaagtcgctgggactataggctcatgccaccatgcctggcatgaggtctccctatgttgcccaggctgatctcaaactcctgggatcaagtgatccttccacctcagcctcccaaagggccggaattacaggcatgagccaccatgcctggcctcttccaatattagacattttttattacatgcttggtaatgattgaacaataccagggttgccaagtggtcagtcttctcacaatggtgtgtggttaacaatatggtctttgactaccacctctgcctcttgccaattgagaaaccactgacaaattgcttaatatttctgtgttaattaggaatacagctcctacaccacagtattaaatgagatattccatgctaagcactcaggagagtgcctcgcctagggcccataattattatcattattattaataatagtagtagtagtagtatttgagacagggtctttctctgtcatccaggctggagtaaagtggcgtgatctcagctcactgcaacctctgcctcccaggttcaagtgattctcctctctcggcctcctgtgtagctgggattacaggcatgtgccaccgtgactggctaattttgtacagaaagggtttcaccatgttggccaggctggtctcagacccctgacctcaagtgatctgcccgcctcagcctctcaaagtgctgggattacaggcatgagccactatgcccagcaggtccattctcattaaatgtgagtttctttttcctttactatcctttaccttttattccctttattttcttcttcctccatgtaatagttacccttctcttaaagaagcctctttcaatgggctcattacttctttcttgaaatattgacttgaaatgtgatcacttccactcaccaaccctacaggaaagctcacatgcagagatgtccctcaatattcagaattattctgctagtcctcagcttacctgcagaggccacagagcagcaaactaaggcccaaggattttttcacagtcagccaagaaatcagaagttcatctgaaaacatcacaccagcatccctgcaacagctaagatatgtgacagaatggcccaagagctccacctaggttccggaaggaagggctttcatacaaattaaagctgaaacagactgcaaatagttcttggctttgcacacagagctctacagaaggccaccttccacccactaacctgtgttaatgtaattgcctgaagggtttttcttgcccgctacacaggtaaaccaaattcactgagacaatgttattgcagtaaataaagcgtttaattaacacaaggacagccaagcagaaggactggagttattactcaaatcagcctctctgaggactcagaggctagggtttttaaggacaatttggtgggcagggggctagggaatgggtgttgctgattggttggagatggaatcataggggtgtggaaaattgtcctcatgtgctgagtctgcctcagggtgacagccacagaactggttgagttctgcgtcccaagtctggatggaggcaggtggtttccagaatgcaaaaatctgaaaaaaaaatctcaaaagaccaatcttaagttctacaatagtgatgttatctataaaagcaactgaggaagccacaaatcttgtgacctccggccacatgactcctgagcattaagggattctagaaactacacctacattttaacagagttcaggcctctcccataattctaatctcatggcctttcattggttttacaaaggcagtttcaatcttccagccaggagggaaccagttttaaggagggacaattatcatccttgctttaaagctaaactctagctgggcacggcggctcacgcctgtaatcccagcactttgggaggccgagatggggggatcacgaagtcaggagatcgagaccatcctggctagcacggtgaaaccccgtctctactaaaaatacaaaaaaattagccaggtgtagtggcaggcgcctgtagtcccagctactcgggaggctgaggcagaagaatggcatgaacccgggaggcggagcttgcagtgagccgagatcgcgccactgcactccagcctgggtgactgagcaagactccgtctcaaaaaaaaaaaaaaaaaaaaaaaaaaagctaaactctaaaccaaatacctcccatggttagtttagcctgacctatgcccaggaaggagcagggacagccaggctgtgaggctagaagcaggacggagtcagccatgctagacttttcttgctgtgtgatctttgcaaaggtggtgtcattagcgaggccaggctcacatgtccttttgcaaagtaaccgaaaaaaaaaaaaacagagaagacacagttcacctcactgcacatctaaaatataattagaagctgtcatcccaaaagggttaacacaggtcttttggaagttgtaagaatccagagattattctggtttaatcaaaaagtaacaaatacatttaaaaactaagagacacagaaagaaaaaaagcacttgctggtatttgtctgaaaagtgcaggaaacttttcccattttttgatccaaaatgagtgtccagcatatgacgagctccctggatggcccagcagaagcacttaagccacatgttgatctgaagcctcagccagcccaggtgttcggacctgggctgtccgtgggccagatttttcttaggcggtggagaaagcaaacaagctcatggtcattgtctaagcatgaacaatgccaggctggattgagcaaagccagctttggcagagacatacaaggagtttggagccctgacagctgatagcagcggcaggagtgggagaaggcaagatatctgctgggcccccagcctgggaggctggctgccagcccagggcatggccaggagctggcaagcaaacaccactgcggggagccaagcaggctgttcaggtcagggagctaggacagggttagcatgcagcaagctagacactagccagagcatgcaactgctcttggcagtcattaagggaggagatcagagttacaagatctggaggccatttcagacagcttcaggaagaagtcaagctcctaagtggctccttgacagaggctaggtcatcttaactcatgacaaatgtccgtgctcaatttacttggctctggcctcttctgatatctctctagaggttaaagggaaccatctcttttgtgcagtccaaaaaggagttgaaaaatcaccctcagtgcttcaagctcttttgcgttgggcagaaagcctgactgagactcagtggaaggcacgctgtcttcaggaggactcagagactacctgagagtggggaagcccgcagcctcttcttcctctgacagtttgtctatcaggagacttttttctcctgggtggcaacctgagtttatggaagagttgaggtttattaaatggacgtataagcaactacagactgaaatgttataaccattctctgagtccaacctccccaaattctaaaatacagcttgtttggtcagctgcttctcatactctctgtattccaaaattgcaaatggatcattccagtgccatctgaaatgcagtatcattgagagaccaaagagaaaatcgcatttgtgtgtgaaggagaaaaatagaattctaataatgaaattcacccaaatctatgtatgaataaaatggctgtttctcatatctaagaaattgataataaaagatgtacaactcaggccgggcatggtggctcacgcctgtaatttcagcactttggaatgctaaggcgggcagatcatctgaggtcaggagttcgagaccagtctgaccaacatggtgaatttctgtctttactaaagatacaaaaattactcaggcatgctggtgggtgcctgtaatcccagctacttgggaagctgaggcaggagaatagcttgaacccagtgggcagaggtcacagtgagccaagattgtgccactacactccagcctgggtgacagagtgagaccacatctcaaaaaaaaaaaaaatgtacatctcaaattgcaggaattataacctagagaatgtgtgcctgcccctgtttcctgcaaacctgcctcaaaagcaaccacgtgaatgctgactgagacaccccggtgaaccccagggccaagtgcttcccatgcttcccctcaatgagtccacacgagtctataacatagataacattgctaattcttgttttattctcacattaaagattagttgacttaccgaaggtcgtgcatttaggaagagacagagatgggatttggttccagacagtctgactccaaagactcagcgctttaatcattcctcttgtcaaagcaaaaattgcactgggcaaagttgaacaggcaaggaagatcttcattcagggctgttgcgacagggtagagaagccagaatgcagtcgagctcgcctccacttcagctaagggcaggagaattttgtttctttattttgattttttggttttttttatttcactaaaatacaatgggaaagtttttacaagctgggataggagggatcatagggtgtctgtgtttgctgattggctctacccaaaggaaaagtaaactttcacaacttggagttaggctcccaccctcccgtggaggggagacagggtgctattttccttgacaattaccatttcaaagagatgactcccaagtttttgaaaaagccattcctgggttgtaaaactggcaaacagctttttaaaaaatttatatctcaaaagggcagagaaagaattaacaataacaaattttctaaagtaagtgctcttaaaaagtgaggtcaggggtctagggtggaatggaggggtcctatgtaaagtttagtcaagctgaaggcaaagttcaggccctcttggtcagtctataccagcgtcccctgactgagatgaccctgtggcccagagggtatgtggaaaggtgcggtgacactgggtgctcccacagcttcccacaacgtgcaggagaatccatcccaaggaagatttgcaggccccacgtgcaataccggccccttgtggagcactctcccagttatggagtctatgggagagactgaagttgacaggcagtggtgaggctggacatcaggcagccctggctggtattatgcagattataaagtcgccatggcaaagatctaggcctgcagagggccactgtcaaacgcaaagggtttggtttaacgagaagttaatgcaaaagcactcttctcagggaatgagacttcttacttgacagtctctatgacatggaaataatgttttgtttttgttttgttttgttttgagttcctttggtaaagcttttataaagtcgtcaaagtcagcatggatctctaagtctcagacacattcttcggggctttgcagactctctcagcagcatgtctcctgcgctctttcctgaaatactttcttcccacagattccacagccgtgtgctgtcctgcttatttttcctaccaagctggccatcacttagtctctcctgcattccctccttcctccgcttgaccactaagcattgcagtgtcacagagccttcctgtcttctcatccgaatattgtcttggatgatctcattcagcccaccatccaatggcttctgataataatttgtgccaatgtctctcaaatttaaatctccaggcctctcttctctcaggaactctagatccacttatcctactttctactttgtgtttcaacttagatattaaatgggcatcttagaataaacatgatgggaaacaactcttgatgcctcctggaaatttgttcctccaaaagccctccccatctcagtaggtggcatcaccatctaatccacccatccaccctaaatttggagttacccttgatttccttcttccctttctttcttctctttccctcatcacttcctatccaatagtaagccctgtgagtctacctccagactgtccctcaaatgcagctgaggcaggagaatagggtctggaggcagggaagataggcagattcatgctgacttcttggaactaaatcaaatgggaacgcttcagcaatgacaggaaggtgaacggctgtgtagcttcacttcatcctctccatttacttatgccacacactgagtaacatccttgccatttacatagggtgcatactgagtaaatgactttgtcacttgacttcgtcttcttcatttacatagggcatataccaagtaaccaatgggaaacctctagagggtgttgaaaccccagaaaattattattattcagaaataaatgaatacgtttatttatgtgtcctccccctagaacgtaagctacatacagcatagacggaggatagggtccaataacaactggtcaatggttacccaataaatatttgctgagcaaacatctggatgaataaataagtgattgtgatttttctgggttaatatccatattcaaaattagatcatctcctttccaaagcaagaagggtttttccttataaactttctccagaattcttttctcaaaatgtgatgatatttaccatcttgggaaatatctttttactgggaaccacagactgaaatcaagcatgacagaagcagaagcagcaaaaaaaaaaaaaaagtcacagagaaagtcagcatattatggaagacagcatttcaaatcagtctagagcctgagcatagttttcagtcttcctgatatcaaattggggtcttgcctgtttggcggtagctgtgatgctggctgcaatcctaatgcagagtttctaccccaacctttgtaactagttcttggttctctctgggatagaaatagggagtgatgtcgtaattagaaaccattgccatacattaaagagtaaattaatttgctggacaaaatctagcaaaaaaaattactacattgaaatcaatcgaccatatgcaaagcaaaaatgcaaataaaatatagaagctcctccaagaaatgccttctccttcacagttgttcactacaagggttaccagccctctattcttttctgaacctgctgggccaccacgctcagtcggctgctatcttctcaatagaaccatctccacctacgacccccacaaagggcaaaggatagccccttcccacttacagttgccatgtatgttttctgccctttgccctttagggatcaaaactaattgacttttgcaattccagctacctttcagtcagagcattaccataggaagtgagtgatgataggtacaatgtttgcgctttttttttttttttttttgagacagagtctccctctgttaccaggctgaagtgcagtggcacaatctcggctcactgcaacctccgcctcccgggttcaagcaattctcctgccttggcctcccaggtagctgggactacaggcacacgtcaccacacccagctaatttttgtatttttagtagagataggatttcaccatgttggccaggatggcctcgatctctcgagctcatgatccgctggcctcagcttcccaaggtgctaggattagaggcatgagccaccaagcctggacaatttttgctttttttaaaatgtgctcccaaataatcaaatcaacagtgtacttttaatgtcttttgagctcccaactaactaaaagataatctgttaactatattatatgggtagaaactttacggtgaacattctgaacctaagaaactaaaggttcaccttctcatgtgtcacaagaccaaatgcttcaggaactctggtctttcttccaacatcctcatggcaattggaatggtctgatgcagagaagacattttaatgtaacggtaccacttttgcaatcaatatggaaaaatgtttttcaacaaataaataatttcttatacagattttttatctttccgataaggactgaactaaacttcatgataataaatggcaactgtcccacagaaaaagattgtaataaaataaattagtatcaatgacacaaatattgaagaagggatagatcctcgcagccccatagttcctcccacagtacactatgagcgtgagaaaaaagaggcccacttttagtattccgcattcagataaacagggtcgtttcccatcagacgcttccctctcatgtttttatctcacagtttggtttctgctccttcgtgttttcaaggccccctgatgtgcaggatattgcgtgggtctctcttcctttcatggtcctattgtcacatcctgacaatgttcctctttcattttaatttcattttattacgttttttcttcaccattgccagcttcaccctctcgccatcgccgacacccactgaaacgtattttatggatggtcttctagtcccaccctctatatatttgttcaaagtatacatatcattgtggaaattcgtgttgtctcttgtgtgccatgctttatatgggtggcattgtactacagatcccattctgtttcttactctcttccctctgccttacattgttaagatctatttgagtagttctctgaatactatgtgcatagtgctccattatgtgtatttaccacgcatcatttattctatcccctaatgatgaatacctaggttttctgcaactctgccaccacgaataaccctccagggaatatatttatgtgcattctctgccacctgtgtgaggacgtcttgtgtgtgtgtgtgcctctgtgtgtccccagaattactgagtcatagagtatgtgtgtacctaatttcactaagcactgcttgacctatcagtttctgagtataaattttaaactttatttactgaatttctatcaatagttctatcagtggtagcttcgggtaattgaagtctattttgctagttagatgtgttcatgatcttcttgatttattgttccttgtaccagtatataatttccatctttgttccttatgacatttttttttaaatctcacagttttgtctctgctcttaaaactaccacactgctgggcgcggtggctcacgcctgtaatcccagcactttggaaggctgaggtaggcaaatctcttgtgcccaggagttcaggaccagcccgggcaacatggtgaaaccccatctctaccaaaaaatacaaaaattggctggatgtggtggcacacacctgtaatatcagctacttgggaagctgaggtgagaggatcgcctgagcccaggaggtctaggctgcagtgagccgtaattgtgtcactgcattccagcctgggtaacagagtaagaccctgtctcaaaagaaagagaaaatgactacactagccaggcataatgatgtgcgcctatagtctcagctaccctggagctgaggcagaaggatggcttgaacccaggaggtcatagctgcagtgagccgtgatcacactactgtactacagcctggggacagagcgagaccctaactctaaaaaaaaaaaaaagaaaaaagataataaatgaacaaactactatgctagccttcttgttgttgctaatattcctgttataacctggtattttttgtacaggtgtttgtatccttttgtttaaatgttcctcttagatttcatattgctgaaccttttaaaaatccatttggaccaattactcctataattttgacttggcagtgaaaataaagatgcaatattttttccatctatgttctcaagacttgtgactcctgtacatggatcggaaggatccctggggctgggggtctctggttcagatccacagctattgatgaaggtgttgttttttggttttggtggtggttgttgttgtttttcttacctaccctgtttaaacacttcatgagtgccttccatttgaactctaatattgtttgttctggaaataccagatatttcttcagatagtttcttgcctgtgtttattcttttcttatgaagctactattgtgcagatgttgacacttctaccctccgtaattcttgacttttgttttattcttctaatctctttattcattcctattgtcttcatggaaggtttcttgacccaatatcccaacccacgaaaatgttcatcagctttatccgttctgccattcagcccctccaaggatatctttattttgacagttatagatttttcacttcaatatctccaactaattcttattcttatagtttgtcattgtcctgtgtctccaatatcaggaaggtgggattctgctaattttgctgccgcttcatgtcggcaccataacgcaggtgtcttttatgcaaatcctacagttttctgctgtcattggttctgtgtcttcagcgctgcttcttgcccttatttcgcagtgcttgctgtcctcagaggtcctgtcatttcgccttctgagttcaagcatattcccttgagatttccaaatgccacctttgttattgtcttcctacaatgaaaaacaaaagttcagggcctgcattgagctcctcctggaaagttgagggggcaaagaaaaactcctgcctcaggacaaacctctggcattgtcatccctctcaaccctttcttgtttccagtccatgtccctcacccacctcccatacacacacacaacttcagagtacctcactcccacctagacaggggacagccatcttccactgtcattgattcttaaaccagtggtgtatctataccactaaatctagcctctcactacccgttcctccactaataagcatcttattgctatattgaagtgtctgtctcaaaaataaccaaatccaatagcctgttactgttgtctgattttccttgacttcttgctcttatttaacaattgtcactgtgccctccttgaaatcttgacatcaaaacactccagtcttctgttttctcagcctctctgccaactcgcctcccttttcccttttcctcaatccccaagcttctcttctttttcctccacccctttgcttggatggctgacatacccatgaggcttggtcatcagagctacactaatccctcacggatccatcccaggcttgacctgggactagcatccgcaaaggcttgtatgtgaagtctgagagtgaagagaacagggtgccagcttggataataacaccagggattcttgactccggatttaaaaaaagactagatacaaatgtttaaatagagactttaaaagacagatggaagcaggagagggggagggggagatacatgaagatcagcagaaagaggatgcttattttacttcaaagatgacaaaactcaccagcaggacacttaatatgaacaataacctaaagatatttgcaaaaatgtatttagacaagagttctaggctgatatatttgacatctgggtttattaaagtttactaaaatagctgttaataattttgaaatttggatccaactagaaaatatccccactttcagatgcaacttggaactgtaggtcccacagtaaagcaatggcttctgaaatcagtgctgtcagactgagcttagggaaagtatccatcatccaccattttagcagtggccaaagcccataactgccttggtttcaaaactgtagtactgagcttttgcactaagaaataaatatgatcttaatgacagcatcaaaaaagtgtcttctctttgttggcttagagattaatttggacattgacattcctggctctgtgagtattgcatttcccctttcagcttcagccatccttgtagctttagagacaatggtctgcccaggtgcaggggctcacacctgtgatcctaacacttttggaggccaaggcaggaggagcccttccatccagtagttcaagatcagcctgagcaacatagcaagaccttgtctctacaaaaaaaaatttttttaattaaccaggcatggtgacatgtgcctgtaaccccagctactcaggaggctgagacaggaggattgcttgagctcaggaggtcaaggctgcagtgaaccatgattgcgtcactgcactcggcctgagccaaagagcaaaactgtgccaaaaaaaataaataaatataagacaatgttctggcaggtggtaaatgtcttgcctcaggtattaatcactctatcagcattttgtatacctaagtacaacaatgtctagaagcatatcagacgtaggagaagaaagtgccttatatgatgtaagcccaaaaatcaaacggtggccagagcatagtaagagtgcaggcttaaaagctatccagcctgggtgtgagttctggctacttactggctatatgacagcaaatgaattaactctcttattctcagttcactcgtctgtaaaatggagataataatatctagctctgagagtaaagttctggaatagtgcctgatacttctagtatttaattaatattagcttttgaaataaccaatagtttaccatgcttatcctgccaccatagcctctacaatgaatcagaccacttagctccacccccattgcataacatttcacatttggacacataggagtgctttatactatggaaacccagtgtcccttcagtctctattttgaagctttcttctagtttaatagtttggattcacatgttctgcatgtcctttactctgaggacacaagaaaatccatgcaataataatgaactgaaaaaaatccatcctattgatggagttatgaatgagcactcatgagtgtcatctgaaaaagcaattttccaaaccccagttctctcagtatgtgaaagcttttttcatacttgccctccaatatctagctgacagagaaactactgatcaatacttgtcaatcatgcagctctgcactaaagaatatggagcaatttcctttaactctctacaccactgaagactcttggccattctgctgttctcagttcaaccagataactgggtttatattttacacacctgcactgacaccacaggtattttgttttgttttgttttgtttttttgagacacagtcttgttctgttgcccaggctggagtgccgtggcacaatctcggctcactgtagcctctgcctcccaggttcaagtgattctcctgccacagcctcccaacaagctgggattacaggtgggcaccaccacacctggctaatttttgtatttttagtagaaatggggtttcaccatgttggccaggctggtctcgaactcctgacctcagtgatctgtctgcctgcctcggcctcccaaagtgctgggattgtaggcataagccaccacacccagcccaccacaggtttttttttaacgggttcaagttgatgcttcagacctaagaaacaatggtagcatatagaacaggagaaatagcaggtacagaattgcaacttgggaaggcccagcctgcccaaacacatagctgcttttgccccctgacctagccagggcagctgtggctgccatgccagagagccaaggtcagggtgggtcacctagacacagaggagtcctagctctttttcccaccagtcactcacaccattccagtggcgggctcaagacctctatgctaattcacagctctccagtccagacacagccctccacgaatgataagatagcaacgacacccatcctaactctgtgctttcttttctctctctttttttttttttttttttttttttttgagacggagtttcactctgtcacccaggctggagtgcaggggcacagtcttggctcattgcaagctccacctcctgggttcaagtcattctcctgcctcagcctcctgagtagctgggactacaggcagatgccaccacatctggctaatttttgtatttttttattttttattttttattttttttttagtacagacagggtttcaccatgttggccaggctggtctcaaactcctgacctcaggtgatccacctgcctcggtctcccaaactggtgggattacaggcatgagccaccatacctggctctaactctgtactttccatggaaacagtgcagtgagaagagggaccccaaggtcactttctcagggaggtctagatcagcccgagcctgataacccttcctcattgtcttggtctgcttgggctgccctaacagaataccatagtctggtggcttaaacaataaacattctcacagttctaaaagctggaagtccaagatcagtgtgtccgtagggttgctttcttctgaggcttctcttcttggttttcagactgctgtcttcttgccgtgtcttcacttgatcttttctctgtgcaagagcatccccagtgtctgtccctcttcttacaagaacaccagttctattggattaggtctcacctttatggcctcatttaatgttaagtacttctttaaaggtcccatcttcaaatgcagtcacattggaggttagggattcaacagacaaattttgaggggacacagttcagtccatagcactcctgatacctctagtatcagatttatatacacatcatctcagccatatttaatttattccaactatgtgcttctatagaatgtgcctatactcaataatagcaataatcgtaacagctaccagtaactagaattagtgcaaagaagtgcattatctgttattaacacactcctacgcggtgcatattgttatgccaatgccacacataaggagactgaggcccaaataggacctgggaagctcacatgccatgagcggcgaagccaacacatagaagtagatctttgtgaccacagttcatgctttcttcatccctgcttgctgcctcccatacatcaaattgtgcctggcatcatcgtgcagctatttgtgatcaccttgggattaacctgcaggcaagaagcacgtcctcatcatcattttacaaatggctttcctgacgcctttcactcatgaactgatcatgcaacagctttgctcttctgagcatcctgcaaccgctctcatctcatgcctccttcccttccaacaggcctcccctacttgcaggatggtacccccttacctttttcctgaagccctctctccatggacgagctcatgatcccctttctgtcacttcctcagtggggcctatcctaaccaccctacttgaaattgcagcctcccccaccccactccaactctggatcccagctaaccctgcttgacttttttctccatagtggctaccaccttctaacacacagtatattttattttcttattgagtttgttgttaaatttctctttctgcctgcaagaatataagctctacaagaacagagacttttgtgtgttttgcttcaatactatgaagcagacaaacaaaacatctaaaacaaggcctggctcatagtaggcgtgaaataaatattttttgaatgaataaattagattttatgtgtgtgggctttagtgtgattccttctatggtgaattagtggccagtctctttgggcaaaagtactcaggaacccaacttagctctttattaagttctgaatttgaggacagtgtttttttttttataattcctcttgatcattgtttttgccctttttgtttaatttaatagccgattattttgtcccagtcttctgtgcattttacagttgtattattcattatgggtagttccagcattttcataattaatctttaattgcaatacttgcaaagcatttcacaagaaaaaatgatttacaaattaaacccacatctcaccttggataattatcacaggtctgactaatgtgcgtgaagcccttgcatggcagggggctctctacaatgacaatgtgttgattttctaattaacaaaggttaagtagcgtttttgcttgaagacctataatttaaacttatgacgtttgtcaccaagaaagatttctacagagcgcagaagtggaactcaaataattttcactgattctagtgcattaatgtcttttacataatatataatgaccgttttcaggacagaagatttttcttcatattgactagatcaggaaaagtaccttctagctcactgtcccatttaaataaatcagggactacctaagcaagaaaagagcctaatttatttagttttcctttatagagcgagaaatggcatttcactcacctgctttataaattatgaagagggaggacaaaactttttatttatttatttatttagagacagagtttctttcttttttgcccaggctggagtgcaatggcatgatctcggctcactgcaacctctgcctcccaggttcatgccattcttctgcctcagcctcccaagcagctgggattacaggtgcatgccaccacgcctggctaattttgtattttcagtagagaagggatttcaccatgctggccaggctggtctcaaactcctgacctcagatgatctgcccgccttggcctcccaaagtgctgggattacaggagtgagcaaaactttacttaatgaacacaacaaatacaaactagactacagtcatatgttacacccagttaaaagagggagaaaaaaaaaagtcagacatcggtgcaaagaaagaaaaagcaagcaaggaagagatttaatagaatttgagagtgtttactgaaattcagaaaaaaagacacaggcccagagggagagcctgtgaaccgtgagccagagtaattcagagctggaaggagtcacagacaccatctagttcagcctcctttatctgtggatggggaaaccgacgctgagagagactatgtaatttgatgaaagccacacaactgagtagaaatagttgatgatcctgagaaggaaagatccacaaacacaagtgcaggaagagagatggatccatgtagaacctaagaagtccaaagacccaagaatcaagacagaagcagagggagaaaactccgccccactaaatcctttctgaaatgaaccctgtatatataaataattaagtatccatgaatagatctaaatatctgccttaatgatataataaaaatatgatttactctagatttatttgctctgccaattgaccctttgaaaaatatctccattctcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggattataaatcatgctgctataaagacacatgcacacgtatgtttattgcagcactattcacaatagcaaagacttggaaccaagccaaatgtccaacaatgatagactggattaagaaaatgtggcacatatacaccatggaatactacgcagccataaaaaatgatgatttcctgtcctttctagggacatggatgaagctggaaaccatcattctcagcaaactgttgcaaggacgaaaaaccaaacaccgcatgttctcactcataggtgggaattgaacaatgagaacacatggacacaggaaggggaacatcacacaccggggcctgttgtggggtggggggaggggggagggatagcattaggagatatacctaatgttaaatgacaagttaatgggtgcagcacaccaacaaggcacatgtatacatatgtaactaacctgcacgttgtgcacatgtaccctaaaacttaaagtataatttaaaaaaagaaaaatatctccattcttcatcatgttaacattcagagtcttttcaaactctcaatcattgctgaagatccatgaaataccaattgtttccaaattaaaatacatcccagatagacaaaaggttaacatgtggagagaagcaaaatcacaaacatgttagaagaaaatatggttgaataatcatattattttgtattgtagaaggtctttataagcctctgaccaaaggcaggaatcacacaaataagacaggtggatgtgactacaaaaacatgcaaaactttcatcgggaaaaagaaacaccatagagaagtcaaaagacacaaactggaaagatacagctgcaataaagagttatttataaccaagagttaaagctcatattgttattaatcaataagaaatatattctcttgtattcccagcaaaaagcgaagaacacaaagaaacaaaaaataagaaaagggaaaacattaaaattactcagctcacagtatttgaggtgatgcagatttaaacagtgaatcctttttgcccccgtcgagcagactggcatgaatacaaaaaggcactgaccaatattagaattgtgtggagaagatgaaaatctcataccctactggtgaattagaagttggtaaattcttcttagaagaaaacatatttaaagtgcctttaaaatgtatatgcccttcatcctagcaattagacttaaaagtatgattaactaattttaaagaatgaattctaaggaaaaactggacgacaagtgtgcaaaggttttcataaagattatattattatagtatcatataaaatggaaaattttaaaaacttaaaagtccactggtggtgcaagagcgaaataagtgatagtgcattcacagaataggatgctatgcagatactaagcaagatgttctcgttgtacatttattgcttggaaaatgttgcaaaggctgggcacggtggctcacacctgtaatcccagcactttgggaggccaaggcaggcagatcacgaggtcaggagttcgagaccagcctggttaacatggtgaaaccccatctctactaaaaatacaaaaattagctgggtgtggtggcgtgtgcctgtagtcccagctactggggaggctgaggcaagagaattgcttgaacccgggaggcggaggttgcagtgagctgagatcatgccactgcactccagcctaaacaatagagtgaaaatccgcctcaaaaaaaaaaagtttcatgatatgttaagtgcaaaaagcaagtttcaaaacaatgtgtatattatgattccatttcttcctttttatttacacatagtatgttcatagaaaaatgaaaaaggctgttccctaaaagtgaaagtagttaaatctgagtagcgtaacagaatctgttttgtattctgcttctcagtatgtttatagtgaccacaatgactattacattgatcaccaggcagaaagagatggggagatctaaaaatgatttctacattttagcatattttgatagaatataattgtcttaattgactagtgataaaaaatttttaaggccagacatttatttaataaaatgtcttttggaaagcccttattgcaaggacaaaagccataatggctaaaataatagaagccaaattgaaattctaacacacaaggtgtaactagagggttgaagttcttccaaatcaggcaaaggccctcattctcttcagcgtagaggtgtgaagcccagttgacaaacagatggcagaatgggaaatccttcaaagtagttgtttttaataacttcttttgccatctactctctcatagctttgatcaaaaaaggcactggactctcttcacttctctattccaatatgttagaagaaatcaaatactcccaagggagtcatgattaaaaccaatgagtcacccagtgagagaactgcaaggcttgggtttgcagagatggtacagcaactcatttgccacttcactgatggggttttgcaggcataagcagatgctaattcatctctgccactaaagcctttgatattccagtcctgtctgaccaatctactggagtttatgacttttcttaagataatagagtaagtgatcagaatcaatccccagcctactgatcttacctgaattccagtaaccctactgactactccatgtttaaagacctccaaatctacatctcagaaacatgtacatctatgagacccctgactggaaagttcttctcggtattaagtggtctacacagaacagggcttaagacaataaaccctgtttgttgccttaggaataagacagatctgatacagttgccactcaggaactatgagtccttgagtaaacttcttaacttctccaagcctcagtttctccatctgtacaatgggaataatgcaaataatatctactttgataagttgttgtgaggaccaggtgagtagcatatataaggtactgtatatagagtgcctagtatgtagccctcaatgaaggagaaacttgggttttatttttattaacagtattttcttttctaaatgctcatcacctatttctttcaacagttttacctactattcattttagattagtttccagaaaagttgttactctaagatgcaagcatgtatataaatttgagttcgtccttttataccagctgctttaaaaagattatagctaagaatactatagacacaattaaatccatttgtgatagaatgcctcaatgaatctttctgtgaaatttcttgggaatattttaatattttcatgctcatgaacctcagtccaactctataacttactccaaaaatcacagtgaacgtgcttattgtgctatatgtcgtgtaatgacatttagacaaaagcaatgaaatctgatctaacctagcaataaatgtggtatagctgatttctgtgtaaagttatcagttccagcttccagctaccccagacaaggagccttgggtagtcttgacatgaacttaaaagcaaagcctctcttgagacaagaaccaagatctacaatcacatttcaaacggatttatgtcttccaactaattgacttgttaactatgctaatacattcatgtctctgcctttatattttttcaataagtaatgctacagaactcgatgttgtgagattaaagagcaaagaatctagagatttctgtaaacgctttttctataggaaaccagattagacttccaaaacagctgatataatttttgtgcatctccaaatattttatttctgtaggaaacgtgttgcttctcagaagatggctcttttaattaggccttatagcctgcagggagaaaagcttcaactttctctatttagataggaccaacttgatagtgacaatactagatgtgctatgcagtgtcatctcctaccacagttgttcaaaatatgaagaattaagcaatagcagaggttattccctctgaactctgtgccttctgtcattcccaggtggtgctgggggccagcagggcttcctgggctgcatccgctccttgaggatgaatggggtgacacttgacctggaggaaagagcaaaggtcacatctgggttcatatccggatgctcgggccattgcaccagctatggaacaaactgtgaaaatggaggcaaatgcctagagagataccacggttactcctgcgattgctctaatactgcatatgatggaacattttgcaacaaaggtaaggtggaacccatttccagagccacttttgcgtgtctttttaagcccaaatcatctatttaatgatttttcatatgtaaacaagtgtaccttattctgaggttaagatgatcagaatttttctctcaacttaggtaggaattttccaaccaaaatcatttcctaatcatttttgtttgataaaatgagagaagctctgtgtatggtgcagaatttcttccagattctagcaaattattcactgcccgaaacactacaaaggcagtctcattacatcttaatggtgagtgataaaataggtggccttcaaaaggggaatcaggcctgaccctcccacgttaggatctccaatagatcaattgatcagtcaatttctgtagtgaatcagccagtgcaccccagtggtcttgatgcccccaccccctgcagttgctaagagactggattcaagctacactcaccagaaagctcctctggtcagtcattaacatcattattattactcttactcaggatgcctttgagtggctctcagcctaagctaaactgcagaaatgctgaaaaaccacatttaattggtcagcttagagcatctgttattacttggttattttagtcttgaataattcctttaatccccagtagattccgcagagccaatgagcagagtacaagagcccaatgcatatgcatgttatcatttgaactataccctgtgatcctgcttgaccagaagaagaaattgactcaactggtctgtggcttaatttcccatatataaatgagggatgaagagaggaggagctggtgcttttcctaagccacaattgaaatgcatgtaaatcactcctctctttctaaatgaatgtatagcatatgggtaaagttttctgtgagcggttggtgcatctcttaataagaagctttacataagtagcctgttcagactctgatgaatacatggagggttgtttacactggcattattcacacaagatgccacacacagaaggaggaattgttccataacattctctgtacctccaggctactgtttggcagcgctataatatgagcatacaaattaggccagacagggtatgaaaaatgagcatgagacaacaacaaaggtggaaaggaacaccattgcagaataataccaaagcacattaacagtgctattacagtgcatttttctgttcagaacaacatggttccatgattttcctgcggcacacaattgaatgggcctgcagaacacattaattttgcacttgtagaaatgacagtcttgcaattaccattcattgtgcttgatgctaatttaatgcagtcatttccttgccaaagtaatgtctgaatgcaatcaagtaagcactaatgcctgcgagattccactacataagtaccagtttaaagaaaatcaccatccctttatttttggagagttaggttaaacacagtagctcacgcaaaacctctggagattaataggcaatagtcatgaatagaaaggcaggggcatatcctctccaggttaggccacattgcagataaagtgaaatgacgcctgtgtgttgcctctgacattatttcaacatgtttacacaaaagacatctaaatatttccttattatctgtttagcagaatgagttttcatttgattcaattagtgactttaaccaaaaaatttaaatagaagactgcaaaacatatttggaaatcatttatgagcatccttctgagtcaagtacctccttgacttggtagaatgacagtggaactgtttcagaggaatcccacagctgtccaggaaagctttgtctgcactgaggcaagctccatcagggactggaaggatctcccagcctgatgctgtctctgctctggacctcactctccaggtagcctggtgcctgcacagcagttcctgtgaccgccccccacctcaggctggtgcttcagccaaacagctcagcctctacaaagagctttggcattggccgaagaatgagctccatgcaaggccttctctggccttcctttgggagtataggtctatgcttgcagatgtggaaaacatcgctaatattttgccaagtgaatgaagcaaggcccaacctaccacacacagccggactacgtgtttatacaaaataaaacatgcatacacgcagagatgaggcaaacaaactgtgagaatacacgccaaaatattaactgtggttattttttgcaggaggataaaaatactagtattttttcttattttattttgctttaagttctgcgatacatgtgcagaacatgcaggtttgttacataagcatacgtgtgccatggggtttgccgcacctatcaacccgtcatctaggttttaagccccatatacattaggtatttgtcctaatgctctctctccccttgccgccaaccccccaacagacccctgtgtgtgatgttcccctccctgtggccatgtgttctcactgttcagctaccaattatgagtgagaacatgtggtgtttggttttctgttcctgtgttagtttgctgagaatgatggcctgtagcttcatccatgaccctgcaaaagacatgaactcattctttttacagctgcatagtattccatgttgtatatgtgccacattttctttatccagtctatcattgatgggcatttgggatggttctaagtctttgctgtgtaaatagtgctgcaataaacatacatgtgcatgtttcttattttgtttttgcttagctacattttccagtctttgcacaatgatgtatttcctctaacatcattattttttcttctttggaaaaataatagtaggaagccaagttcttaccccagacatttgagggataactatctctggtcataaaatatctagctatttattagatattattggaccatctagttgtactttctggaatggagaagcatggtcaggtgaaaattttatgtaattatattgtccctgagaatctcaatacatttaacaatgcatttgttaaatctcaatacatttagcagaactcattttccacaagcagctgaagagatcacccttcagatgggcatcggaggaagggctgccttgttggggtcaggttgcatgaaaataaagacctcaagacactagtatcacactcagctatgtgagaggctcacactaggacaggcttgggacccaaaatagcccaggtcataaaatagcccagggggacagataagctaagtctcacccctgtatattattagcccatccaggagaatggtgggcagacagcccatactgtttgaattctgtttttccctcctctccttctccccctcctccccatcctccttatcatcctcctcttcttcccttctcttcctccttccttctccgttcaccataagcacaatctttatttctacatcaatccctgtctctgtctctgtctctccatattccatacctactttccctctctccctttcttttgctggagtgtatagttgaatatgtaagtgaaattaccgtgtcttgtcactttgttgaactaggaagacagggctggatttgagtaggttcctcatgatcatctcttctgctttgtagatgatgcactgatactcactattccgcactagtcaaaaccacacaagaaggggacttcctctaacctcttatccaaaacccttttttcttttctttctttctctttttttttttttttttttttttttttgagatggagtttctctcttgtcgcccagactggagtgcagtggcacaatcttggctcactgcaacctctgcctcctaggttcaagtgattcttctgcctcagcctcccgagtagctgggattacaggcacccatcaccacatccagctaattttttatttttagtacagacggtttcaacatgttggccaggctagtctcgaactcctgacctcaggtgatctgcctgcctcagcctcccaaagtgctgggattacaggcatgagccaccacacccagcccagagccctttttcaaagagatgcctaaagatttgaccaccagttaaagtgttagctctcccagggctacttgaatctttagtaggagtgctgactggggaatatttcatggtttggagatagcacaagggcgttgtggaaaccctacaactagaccatgcaggcagtctcctcatctgtcggcagataactgagcagcatcccatcttctcagcacgttcatcaatgaggagcagtttaactcagtggaggtaggtcccttccaatgcagaattccttggcaccccatcggctgaggctgaggggagaatcatcccagactacatggaaggtttaactgtgggtctgtcatccccaggattattggggaccgaatggatagttgcttggtcatgccaaagatagttttctaacattaaaactgctccttcttggagagtcagatcccaaaacactcaagaattctataattatcaatgtcacttttattactaaccagaaattagagacataatttgcagtacactctctgtgtgtcttctctgtgtgtttaagcaagagagaaaataacatacctatagtagaggcagcaatttctgtgtttacttttcgtggttgaatgccatagtagattgaatagtgtcccccaaaattcatgtccacctaggacttcagaatacaacgttgtttggaagtagggtccttgcagatgtgattatggtaagttgaggtcatactaggaggttggccctaaatccaatgactgtgtcttcataggaagaggagggggcacagaggtactgacagacatagaaggaaagccatgtgaagacggaggcagagatcggagttacactgccccaagccaaggaattcctgaggctaccagaggctagaagagtgaaggaaagattcttccctagagttttcgaagaagcgtagccctgagaacaccttgctttcagacttctggcttcctaggaaaataatacaagttcgaagaaaaacctaccatcttcttaattcttgctcttaacaaggatagcagctggtatttattgagaacttgtctgctaggcagtgtgctaagctttctaattgtgttagcatcgtttaatcctcaccacaacctggtgaaatgattgctattactagtgctcctattgtaccaagaaggagatggttgtagtagcctgccccaaggttcacatattagtaagaggcaagactccctttcctttcattttgtagcaactaaaagcatagcctctagtcttaaagctttttgattattgtgattgagtaaaaagaaattagaatattactggatgcagagtttatcataaaaaataggatacaagaattgaacagacactgtttttttttttttgctacatctaggtgtaaggtttattcatttattgactcttattgagcaaacattcattgaacacctaatgtgcccagaagtcttgaatgtatagttgaatctgactacactgaaatttccaaagcattttaatggtttacagatacaaaatcaggcaagtctagaatatatgataggaatacatgtgaattggatatcacccaggctgctgaaaacagttcttcattatgatcctttcaccaagccaagttaagcaagaacttatcatcaagagacacaaagatatctccaaattcactcatctgcactttttttaactataaaaatgttcatgttcatatgccaaaccaggactgcagttgaaaaatacatttctttaatcactctgaaaccattttctgagttagggagttctgttttcttctcaaacattcatttgtttattgcttagaaaaaacttgaagaataaaagtcacaggattactgagtgaccaagatttgaatagtcattcaatcattgcagtgtttccatcatttacagtcacacaaataatgtgccaccctccctgtgttccagctaagtctcctattctccctatgagtattgtgaagttagctaatattttataatctgtattattaagatggtagaagaaattgtttatagcaaattcaagtctcaacctataagatgatgatggaattagatgtcagtttgaatccatctttctcacatacctgttacgtaaccttaggaaaattgtttgtcactgagccttatcttcaggaatacatagtaactacctcttaaggataccttgaaaatcacacagaataatgtgaatgaatttccacatgaaggacctggcacacagcagtccaacagcaaatgtccttttcattcttagcagctctttgctttttggtttgtgtttttgtttttacttaattcatgttgtcctttaatccttccctaatagctttaaatgtcaaatgcctaactggcattatttcggtgatccttgagtattggattgtcatttcggtacttcaggagcagtggcagtgtcctaaaatgtcatttctacttaattttggtcacagtaaaagtattctgaagccctgaagggctgagaagtatgcagagattctggaagatgcaactggaaaccacacccaccatatcggactggttttgtcaatagcgcaagtcttggagcaatgtatccagtcctttcaagaaccaagttgggtcaccttagtaactcctgcatcccttcctgactcaaggcccatcaggagacaagaaagcgctgattagccaggcacactggctcacacctgaatcccagcactctgagaggccaaggtgggaagatcatgtgagcccaggagttcaagaccagcctgggcaacatagtgagaacttgtctctacagaaagacaaaattagccaggtgtggtggcacatacctgcagtcccagctacttgggaggctgagatgggaggattgcttgagctcaggaggtcaaggcttcaatcagccgagattgtgccactgcactttagcctgggcaacagagcaagactgaggaaagaaagacagagggagagagggagagagagggagtgagagagggagagagggagagagagggagagaggcggggtgcgggggagagagagggagggagggaaggagggaaggaaggaaggaaggagagaaagagagaaagagtgagaaagagagagaacaagagagagaagagaaagaaagggaaagaaagaaaagggaggagaaagagggagagaaagaaggaggaggagagaaggaaggaaggagagagagagaagcagagaaagagaagaaaagaaaagaaaggtcccagactcctttttgctccaagagacctcaggctcaagtccacgttatacctctaaggaagagagggttttccacttgcctcctagagaaacatttcttgttggatgtgaggtagtgggtttgccaaaagcggttggaagactgaacaaattctgttccacagctctcagtatgaaacagggaccagaataaatgcatggtctacccttttagagcaggttggagagaaaattaattaatacaaaatatataaacaaatagggagaaaaagaagagaaatgttggaagtatgcatcttagaatttcacccctatgtgaaatcagctaagctgttagtgacaatggccatttttcctcaggtctacctatccagtcttaataatcccagcttggaagacactttcacatcagtagggagagaaacttttcacaggcttctttttcattttcagttggaacaggaggtttgacagatttggaagaaggcccaaaggaacaagaatagaaccctttttttttcttttcttcttagagaattattcaagtagagaaaatatcccttctctcttaatgtatttcttaaatcttcagaccttaggatgcaatttaaaagtatcatggtaactgtgatggttaattttaagtgtcaacttgactggtgttccatagggagcaggtctatgcaagcctacctccaaaggccaagggagctgagaggccaaagaaacagtctgacaaagccagtttctcagaagaaaaaaaaaacaaattgaatagggacttaccaacagaagttgcgtctctggtatctacaagatgagatggtggattcctttacctcctcagacccagggcctatataccatagagaaagggtctacatgcttcagaagcaagttaccctagagcagaatttgcagtaaacagtagataaggtggaaaacttagtggcattctgcaactgggttattcagaagccagcatggtgcattagcatccaagaaggaggtgctttagcccctacacctagaaatctgtaaagcattactttgaggtgggtctgtgaggctgtttccagagaacattagcatgtgggtctgagtggatgaggtggggaagagctaccctcaatgtgggaaggcattatcctgtctgctaggggctgcagagaacaaaaacagagaaaaggtggtagtgtctatctatctactagagatgagatatactgttttggggcaactccaggctccctagcctttgggctccagaacttataccagattctcatgcttttgagcttgggctaagagttacaccattggcttcttttgttctgaggcctttggacttggacggagccacaccactggtaccccagggtctccaccatgtagaggacgtatcatgggacttctcagcctccacaattacatgagccaattcccctaagaaatcccctctcgtatgtctatatctatatagtctgttgattatgtccctctagagagaaccctaataccataacgcatgaaaataatctgattaaaagcttaaaaaataaagagagaaggaagagccaaaaagtcagaaaatatttatggatgaaaatccataagtggacagaagtccacaaatatgtatggaaaaagaaaataattttgacttaattcagaaaagtcaaagctgcagagatagctgccaagtttaagtggctttgttatagaattttgtggtggtaaaataacattccccctagcctgaggttctctttggggtcccagatatttgagaaaacctggccaattaactttcttagagaaagagatttaaaaattcagtgcagaaaaagcaagtcctccgtaaactgttctaaatctaatacaggacaaagtgttcggatttggctttggttgtaggataaataacttttgtttcaagtgtgtgcccttttttttttttttttttttttttttttttttttgagacggagtctcgcactgtcacccaggctggagttcagtggcacaaactcggctcactgcaagctccaactcccgggttcacgccattctcctgcctcagcctcccgagtagctgggactacaggcgcctgccaccacaccaggctaaatttttgtatttttagtagagacggggtttcaccatgttggccaggatggtctcgatctcctgacctcgtgatccgcccgcctcagcctcccaaagtgctgggattacaggcgtgagccaccgcgcctggccaagtgtgtgcccttttctaatccccaccagtgtggggacacagctgaattttttttcctgagtgttttatttgtatatgttgttgagtgtttttatttcctgttcttcagcaatgatcagaactctaaataatgtgaagttcacagaaataacactctttatcttttcccacatattagctccatgacttgagctgaaactctatacatttcttttcttttcttttgtgagccaaaaaggaactggtctgataaattgtcctgagggttttgcttttagattgctcacatgtttggctgccctgcaagcaggtccattcaccaacgtccacgctgcccttgagtactccatcacgtctatgggccatgaagacctgcctctgacatgcaatttcttcactccacaaccatttgcgcgcttatcatttccaacaggcagctctggccttagcaactgggctcattccaggcattccttggctacaggaaatttactttcttaaataatcaagcctgagactataatgctatagcctacccattttatagatcaacctggctttgaactcactcacatatttttacctctattaattccaactggttacaagagtgtttgatttagataaataggcattttatatttttctgtttaaaaccaaatcctgagaaaacaaattatgaagagccagctgctctctctgagccatccttttcttggcattttaaatgtattaccttcattttctcaagaggactgggcacaggatatagtgaaatgtttaacttgactaacaatactttctagctactcttccaagggatatgtttactaaatataaggtggcttttacagtattcaagttctataaggcaaagactctcaattaaattaaattattggcagtacaatttaacattctacattctgtgtgaacgaagtaatttcaagcagtttgatcattaataataattttattccttcctatacactgagcacaagtttagtgaaatacgggaacatgtacagagagcctgctgtgggggaagcagtggattgccagcaaggaaggacaggatgaataagactaggctgggaatgcaatggaggggatagaaccaactgcagcatgcagggaaacaagccagaaggccgagtgagagacccccatggatacccacgctgaaggttctactgggagggctgcctgattcaaagtcttgtccaaggacagcatggcagatagtggtgggttgcacctaattctgagggcgtaatttgggttaagggagaagactctttggaaaacatatatcattaaagcctaaagtctaaagacaaaagttttaaagcatctcaatttttttaaaattgtctttgaaataatacaattgatatttacaagaaatacttatttgctttttttttttttttttttttttgagacaggctttgagctttgttgccctagctggagcgcagtggtgcaatgatggctcactgcatcctcgacctcctgggctcaagtgatcctcccaccttggcccccagagtagctgggactataggcatgtgctaccataccctgctaagtttttaattttttgtagaaacagggtctcactgtgttgcccaggctggtctcaaactcctggcatcagggtatgctcccacctcagcctcccaaagagctgggattacagtcatgagccaccatgcccagcctacttatttgcttttaatattacaaaattgaattgctttagacattaatagtggacaaaatattttaggagttagattagcttaactatttttcaaattatattccaccagccaaaaatatttcatgaggctttgccttctttaatttctaatatgaaaacagtagggaattttttccatttttcaaaaagttattctaataattaatatgattttctcaaaatacacgtctccttgcagttttttcccttactcccacctccagataattttatatgaacctagtggacaccttccccttgagtatttctgccttaaagataactttaaagatacaacttcaaagatagatcaacaaattgatatgtaaaccaggcacggtggctcatgcctgttaattccagcattttgggaggctgaggcaggattgcttgagcccaagagtttgagaccagcttgggttacacagtgagaccccatctctataaaaaaaataaatatctaaaaataaattgacatgtaaataagtttatctttgctttttgttaaaagaggtcttctaaaaacttgcttttatcaactttaacattactaaattttattttagtattctgaagtttagaccttaactaatgcaaatttgcttactttagactagtacaaatgacttatgatttacctgtgccagtagccaatctcactttctgtgcttctccctagggagttgggtcaagtatagcttacagagaaataccaaattctagcccttatgtgaatcatttctcagcaatcctcaaaggcaccaaaatgtcctttcacatcttctatttctttccatcctggatttatgaccagaaacacagacaacactattctaaactaattttgtttaaagaaaggggaaatttgtactttttgagtttatcccaattaaagagggaatcttatattatatagaacagtggaacaagagtaacttgaattccaatttcaacattattaaaaaccaaagtgaacaatcctaactaggcattctgtttctttataaattgcactaattatataaaattcattattcacaaggctgtgaggatcaaatgagctgatggatgtgaaagtgctttgaaaagcattaatgttataaaatgcaaattattattaagtttattaatcattgagtcactgaaagcctctttagtgagaatcctgcaaaatgtaaaccattatctttcaagagctgctaggaaatcctagacagaacttttctatctgtgttgttagtgttgccataaccaacagcaaaacttttccctctcaattgttgacattagtgctcgcccgtctctctgtacagcactgaaatgcgttatccagaagctccgtgctcacaacaatccagcaagactttagacctcagagttatactagttcatgacaggcagtactgtattcatagtcagccaacccttgaatgcatggccctgattaaattcctgtctctgtcatggaattggcatgagtcatttggcctggaacatcattaaagcagcaaacacacttgagattaaataagaatggattctaaaacatcctcttgaggttgttattgagatcgttagcaaatcatgttggttccttgagtatcttatagagtttcaagaaataaaaagcaactgctacattgtagaaagtacatctaaaattttcctcttatcccaagtgattgacagtctctctgcatcctctgccccgttaccaaggatgataactcctgttcagatgaatgagtccagatttttctcaggtctaagccaaatgtaacccaaatatttgaacaagtccattgctagtcactttttagttttcagagatgaataaagctataagtaaaatgctttctaaagctttactattgaagtaatttgatttaaatcccttttaaataggtctattttagcctgttgacttttatatttccttaacaaatgtctcttataaaggaatcttgtaaattcagttaaaaatataaattaagtcatgtaagtcaaattaaagcagtagatcaagttataaattgaaacaagtttataatccctctcctctattaactaagttaaaatgttatcttctgtggcctcatacaacaacctcctgaatcataaaccacctgaggttatgacaaacacttaataacttcttttaaaatatcaaggactattccaaaagacttttatttctgttactataatgaatttatgattactcagactttcagcttttgcgctaacattcaaatgtcattgggttacttattccaacacttcttctattactatagatggttaaaagttcaggaggccccttttgtcacaaaatcaaagtatgtcgtggttgaaaggactatttcattcattcatattcaactgatattttattaaacatttcctgttatgccaggcactgaactaagtgtgttcacatagtttaccttatttaatcatcacaacaacattcaggcattgatatgatcacctttatttacaaaatgaagaaacagagacttctagaggttaagtttatcatccaaaatcacattgctagtaaatggcagattgagattggaatcctaggtccctgactccaagcctagtgttttttccaccatatacactagaatgatgtcctctttataacacactcactggatcagatccaagttgtgttcatggagagcccgggaccacatgaggcagccctcttcctatttgagcatttcagacaactggaaagatttccctcatcctgaaccatcatctctattaaagatggagaatgtctccatgaagaaacagtgggtgtctggctctgggttcaaattcctgtgcctgtaagaactcagaaacacctatgcaccttcaaaatccccaactctgtggagataaggaagagcacctggcctaagtttgacacaaaaggggtatttaatagctgattcattccttactcttctgtttcctttaccaaagtctcaatggcccttaaaactaatatgctgacacacggtcagtggtccaatttgctatggctattctcccaatgccccaggaggccttgaaagatattggccttgcttgttgtccaatgtagaatggtaaattaatgagatccttggataccagataacacagcttgccctgtgtgtcctctttctatcttatcaccctgatgactcagggcaggcctaagtcctaaaagttctgaagaagtttcccttctttctttgccgttctttctgaggccctctctgtgcggttgagcaaggaaacatacacacacacacacacacacacacacacacacacacacaaacagagccaggtgtgagctggacctgtcggtttctaacaataagtcttagataacaagataattctttgtgtttcttagggtgccacccacacaccgtatccatgcttttgtgttaatagcagagacttctctttctgaatatatgaggagaggaataaaacaagggatgtgaccaaataaattcttctgacatgagagaccactttagattgccttattacaaagaagctgatttgcagggtaaacacaggccatgccctgtaagttttcttattgatgaaattcatgctttgaattactgattgatggttgctgaaggatggcaatttctctgttccagtctggagactgcgctacgtaaaacgagcttctgatgatggaaattctaaaatccaaacaaaacatggaaacaattttttaaaactcgacatctatttctatgaggagctaggagggtggatgcaattggtcagctccagctgtttccttgcttttattgcacagttgttacaaagaggaattcagtgtacaactatgagcttccggccgctcaagctactgcattacactacatggccatactctgatcccaacatgagctttttttcctctagccaaaggataatgtaaaaattatgacacaaataaaatatttatcctctaggcatgagtaaaggaattcacaaatcagaacatagcttgcaagcatacaagagtatgcttgagcagtcccctctttttaataaaaatcaaccatatgaataaaaagctgccctgccccaacttcaccccctacccatcacagaccacaccaccaccccaccatccccgcatacatgcgtgcacacacatgcacacacacacacacaaagccacccactaccattgcagcagggaatcactgatttttttaaattaaacttttagagaacccatgagtttagatggaaaaaatcgtgggagagtaggaatagtttaaggaatgtgcttggagaccagccactcttcacccaaaatgatttcctttgaaattcctgacttgttccctttctgtcctgtgacctattgttctattaggccattctattctattacagcatcatttgaatcagtaggagtgggtctgggaggatggtaataccatctctttaatacctcaatgtggacggaattgaaatggccaagtccttacccagaagagctgtcctgaagaaggagcattgagtttgaagggaggagccaggtgtaatttaggagtggggaagacattggacaagctttgaggagatagttaagatgacttccatgaaaacagagagctgaagcctgttagtaacagactggaaggaagaaagatactcctttctttgctgatcttgcctaaagccagcaggtctgcactggcaaaaagagaggaaactgtctttctctcccctctggcagtttctcttctactaagatccagaatccaagctaatggcattagtgctataatttggtttcactactaaataatctttagttattgatccatgttagaattttgtactattggaaaatgtattctgagttcctaaaatcaatttatattattataatgtatgtaccgtactatcattatgtacatagtattagcatatatagcatttcattcccttgaaaccacttggtcttcatacccatcacttaaaaatactgcttcatattattccacccagtgggtttaccaaaatttatttaacctaaatatttcacaatagggaaatggcaatttcaatttctgttcttaaaattgtttccaatttttttattgtaaataatactgcagtaaatgatttttgcaagtggcatttcaatattttacattatttattgaggatggattgccagatatggagaggtagagttagaggatgtaaaatgcttaggcttttcacgtacaaagctagtaagattttctaaacacagtgccaaagtacatgcagtatacactgagaatgccttgttctctgaacactaccagcaatgtttttcttttttttatttttatgaagataataagctaaaatggtaacctatttgcctttacttcctccaaaatccctagaaaaggatttcaaaatttttttgaaggtaagagtcaatctaaacaaagaggacaggagaggacagcaacatttagaaagacggcaagcaaatggaggaataacacacttagtagacaaagggaggccaacccctaagctggttgagggagaagctcaagagcaggcaattataaaagggcagttccttttataaggaaccgactcctgcaattactgccttaactcattcatgaaggtggaaccctctgggtcaggctctggtgagggccctcttctgggtggcagaagctcaagggcatggctcctcttctctttgcccttctgccatgggatgatacaacaagagggctctcacaagacgacatcccctcgatcttgaactttccagtctccagaaccacagccaagacatttctgttcattgtaaattatctgcggtattctattatagcagcacaaaatggactgagacaggctgctatagcggactgccatagcagtctctgttgcactagaaggctcagaaatgggtagcccctggcacctcagaaagatagacttaaaaacggaaggatcagctaaaaatttctatatgaagacaatcttctcctcactcttgcagctgggtaactgccccagagccaaataaggcagaagacccaagatttagtgtctggaggggcttcttttatctcttgaagatttggaagattgtgttttccaaggacggctgccacaaaagctctcctgacacctgtgcttccagagccaagtgactgctccatcaagacgtgatatctagttttcctctccaagaatctggacagccttgggacttgcttaagccaacagaatgtggcagaaattatgctgcctgacttccaaagctaggttatagagccaaggtgacacgtgccttggggactgggccatgcacattggagtactgattgcccaggaaagcagtcaactgccctgaggccaccatgctcaaggaactgcactaggttacgtggatcggacacatgaaaaagctttgagatgacctaaggaggtagagagaggccaaatttctgattcacagaaaccattagagataatgaaataattgttgttgttttaaaccagcaagtttggggagcaatctgttaggtagcaataaggactggaacagagaagatgaataatagttttttggttttccaaaagaacttactctccaagtattatctttgtttttgctaaatcctttgtattagtctaggctcttagagcgacagaatcaagaggagatatgtacctatatctgtatctctatatatgaaaggagatttatttggggaattggcacatgcaattatggcagaagtcccacaatcggccgtctgcaacctggagaaccagggaagccagcagcatggctcagtccaagtcttaaggccacagaactagggaagccgatggtgtagctctcagtgggaggctggagccctcagacaccgggcggccactggtacaagttctgtagtacaaatactggagaacccagagttctgatgccaagggcaggagatgtcccagccctaggggaaagacagagagagagagagagagagagagagagcaaaaaaagaaaaatagaagaaaaaacatgcattcaaatcattttgtaactcctaattattaggacgataataaaagaagattccagattccagacctagagagcaaccagtacagactgaacaaggaagatgaagagctccatggggactatctttgtctttagtctctttgggctgtgctaaggattgaatgtgtcccccaaaaagcatgcactagaaatgtaatcttcaatgcagaagtgttgggaggtgaggcctaatgggagatgtttaggtcgtgaggactccaccctcatgaatggattaatgctgtaattgcaggagtcaattccttataaaagaacaagtctggtccccttttgtgcactcttgctctctctctctctctctccctctcctctttcctctgtcttctccctctctctgtgtcctcttctctttgtccttctgccatgggatgttcaacaagaaggctctcacaagatgccatcctcttgatcttgagcttcccagctagcttccagaaccatagtcatatatttctgttcattatacattatctgcagtattctgtgatagcagcgccaaatagactgggacaggttgctatagcatactgccatagactgggtggcttccaaaacaaacattgatttctcacatttctagaggctggcagtctgagatcagtgttccagcatggtcaggtgctggtgagggccctcttctggattgcaggctgctgacttactgttgtttcttcatatggcagaaggagagttcagagagctctctgggtctcttttataaggggactaaacccattcacaggggctccaccctcatgtcttaatcactttccaaggcctcacctcctcctaccatcaagttaggggttaggatttcaacatgtgagttttgatgggagacaaaaacatctggtccataacagtcaagaaaaatataaaacagtttacttctgtttccttccagtggtgagataagggatgagttagtgatgagtgtgcagaaaacaaggcaaatgaagaaacaaaagattgcactggaatgtaaatgcaagtgttttacaacatatatgatcaagaacaatgcaagcttgttacttagaaatatgaagttgatgccaaaaataagatggcttctgaggagtgggaagtggggaggtggagtggagacttccgttaatgtgtttcagggcttacagaagcacttgagtcctttcttaaaaatgtgtaaatttatggcgtacaagggtaattttgttgcatgcatggattacatagtggtgaagtcagagcttctaaggtctccatcactcaaacaaaatacattaaataaactctcgtcatccacccctacacccttctgagtctccacactctatgtccatgtggacccattgtttagctcgcacttataaatgagaatatgcagtatttgtctgtctcggtctgacttgtttaacttaaagtccttagactatgtatgtcacaacattcataaaaactgatcaacttaaataccacattaaaatgattacagaaaaacgcaagcaaaaatataataaagtaattttttcccctccctcaaagccaactgataacgaaaagaaagaaatggatgaccaaaaaaaaaaacaaaaaacaaaaaaactctccatgcagtgagccgagatcacgccattgcactccagcctgggctacaagagcaaaactccgtctcaaaaaataaaaaacctccaataaaatatggcaatgctcattgccacaaaccacaaattaggaaggatacgtgacacatgccaactactttgaaatttgcatcagaatgagagaggaggcagttaattcatgttttcttaacttcactcaaagttcagcaattcctttagctctatttcagtttcttcatcctattgctttcttatgaaatatgactttatttttttcctataaaagtagcagaaatgattgaaagttctttgcattttttggcggtgtttgaatttttaataagggccacatgtgtctttctaaaaattaacctattctctttttaaaaattaacaaataaaaacttgttctctttttaaaaattaacttatttgttctctttttaaaaaatgaagatttttttcctcaaaatgaatatacttttgaggtaagaggattttcacctagtattctaaaatcacaaaaacaagtttattatttttattttattgcaaatatttttcctacatggttattttcagatcaaataataggattttggaaataccagcctgaccatactgcacagattgagaggttaggtactaaattataggcttttagagggaggtaaagatattagagtccatctccactccactccccacagataagggccaaggccaacctagccattaggtggggtggacacaacccacgttttgaggggcccacacatatatgttaaaatttctttagaaatcagaagaatacaaatgaacttcggggtcaaagaaaatattttaatatttaacattaatacattttctcttgaggccaacattgtcatgaaatacacattttcataatttttttttgtggaagaaagggaccacaagggcaagtgtgcctggggcccatgaaagtcataatgtggccctgatgaggattctgggacctaaaaagattcctgtaattggtggtggcagagtctggaccaaagctcagggcctctaactcctcctctatggtgctttctgccatgctgttctctggcttgggtattccacacactccatggtccagcccacactccttatctgaccttacctctggccatcagtcatagttcatcttctgctccagttaggtaggcccagcctcatttcctgtaattcatcacaaacactctccatcccagctccatggagcctcccattgttcctagtccactgctgttcattcccagcactggctctcactcctcccactctccccatgtggagaatccttcccgtttccttctgcttgttcaagaggatcctcatctctggagactttgtcttaacactgcctttttttttttttaactgaaacagggtcttgctctgtcgcccaggctgcagtgcagtggcgcaatcagggccaactgcagccttgacttcctgggctcagatgatcctcctgcctcagcctctcaagcagctgggattacaggtgcatgccaccatgcctggctagtgtgtgtgtgtgtgtgtgtgtgtgtgtacatatttttttttgtagagacggggtttcaccatatggcccaggctggtctcaaagttctgggttcaagcaatccacctgctttggtccccaaagtgttgagattacaggcatgacccaacactcctggcctctttcaagtacctttaaagactcctccagccttgagtgatctaccctatgtataaaagcatttgccatttagtaacaaattatcttttcttattcatatttgtcttatatgtcttagttttctttccccaattatcttgtcaggtccttaagctcagaagcgatattagtcaaggttccccagagaaaaagaaccagtaggataagtataatatagataagagggaatttattattggaagtgacttatgcaattatggaggccaagacagtctatgatatgccatctgtgagctggaggcccaggaaagcccatggtgtaattcagtctgagtctgaaggcctgggaacagggagccagtgtgtaacctccagtccaagacgagaggcctaagaactgaaggaagtggggtgggcggagtcccagggcatgagaagaaggatgtcccagctcaagaaaaaaaagagacaacttacccttccttcacctttttgttccatctggcccctcaatggattggatggtgcccacccttattggtgagggcagatctactatactcagcctactggattgaatactaatttatggcaacaccctcacagacacaccccaaaattatgttttaccagttatctgggcacccttagcccagtcaagatgacacatgatattaaccatcacagaagccatgtctcatatactcactgagcatatatatgatcagcactcagtcaacacccaaatgattgtcagaaatctctcacaactccccctacaataatagggtcaagtgctacctcttctgggtgtcagaaataggcttggctttcctttctctttcttgtatttgtaccctctgtgatgaaagtcacgctgtctgattgcacattccttctgggcaagggctgatgtcttctcattatgtattgtcagtctccagcacagtctgtgctacaaagtaggtgtttggtaagtatttgatgaatgagcattttctagaaccaacttttaaattgaatttcttggtcctggagatgtttatttttcatgtgagttttccatctctgaaaaaaataggaaaagaaaagacaaggaaatgagaaagcaacttgaaaacaggaaaatattggtgaaagttattttcacagaagtcttagttgacctttctctgtagcattaaattccttccctgtagtattaaattcacaacctaagctatagctagctttccaaactagacaagcatcccacttaagcacaattgatctcatttcagtttgtgtctttgggcaatgaaataccgcaaagactttttctacctatgctttgatgctttttaaaaagtattttctaaatatttttaaaatgtttgaaatacacaatgataggataactccaaagctgtcatatttgtcaaataattcaagtcagaatttaatatatcctataactgagactcttttataaaattgagacaggcacctgaagaccatttttatttctgtattttcttggtgtcccaagcaaccccctttagagaaatcactaatatttcctgagcaattgaaccacaataaagaccgtggaaagaaaaaaaatgggtctgctcagacattcagagcacgcatccttacaaatgcattctactgacctgcaaaatgttagtgggaatttataaatgcctacaaaaagaatatccaagtcaacatttgacctgtcaaatctaatcagtttggttttgatcattgtaccgggttgctattcgcaaacactaattgaaagcaaaaacacaaacagcatttttaaagagtttctaggagaatatcccatttgcacacacgtcagattaattttccccagagttgagcaatttcaggatcaattgattactgatcccaaggaacaatcaaaaaagaaattccctgaaaaatttttttgactgtcaagactcagcatgggaaactatgccatgaaaatgcagtttgaatagcttgtcttttaatcccaagtgaaataaatcaatcatctattagacttttctagttccttgtgtagtcagggatagaagagttcgctgcagcaggattcggaggaactggggggatctgggtccaggaactcgtctgatcactagaatggggcagggagtgagcagaggagtttgcagcacacagtagaggaagctggtaggcacagaatagtaactggcaggcttacagctgggaccagaggggtccagcaatgataacagctcccggcactttctaagtgtattaattaactcatttattcacacaagaatccaataagggagatagttttaatagacccattttactaacatgaaaactgaggcattgataaattaagtagcttgctcaaagtgacccatctctttggcagagcaaggatttgaacatagacaattttgctctaacacctgtgcccttaaccactgacttgtaactgttccagggagaagatgagcctcttttgggcagcagggcagtggacagccactgaaaatgtgagagctggcaatattcaaagaggcacattgagatccttccaggaaagtctaactgcttgcaccagggtccaggctcaagggagggattcagggagcagcccctagaagtaagtgctttcacttgctaggcagtgcttccctgactcttaggctgcaaatttctaaaaggaaaaaaaacaatgttaaacacgagtgccagtttatatacctttatatattcagttatacattttgtaaatatattacagaattaatgtacatcataaaatacacacaaagggaaaaaaatcattcctttacatcaacaacctactataaatttacttcaaatagcattcatcagtactagcactagaaatgtgtgtccctgacgaaaaatatgtttttacataatttagatcttttattttgaaatttatcagaaatttcttgattagaacccagttttcctagaattattccctacttgttagattatttatccacatatagatgattccgtgaaaaaatgcaaagcaagacccttgatatattgtgtaatcctgaaactatatattaaaaacaaaatagtcttttagaaagcctgcagcagtaccccaaaataaaggtcacccaagaagaaaaattctccctagaataatgcctttaaatcccggaaacgaaagctcaagtgtttacccgttctttttaacattttcagagcaatacaacagagtcaatgtatgaaataaggcattggagttcagtgtaagctaccaccaatgacagaacatgtccattcagggcaaagatttatttttctgattataccaatgacccacacatacacaaagaaaaattaaattgaattaaaagaaagcatttcagcaatcttgacaggcttgagccctctgacagctcctagaattctatcagccgatcatcatcgtgttgctaaagccagctgcctcttgaaaccaaatttaatggaaagaggaggagctcaacaaagcagcttaaacatctcaccttcaaagctcattgaaaactaggcttcctatcagtcatgtgtcaaaggttcccctcatcctacaccatacagattagttcttcaagttccatttgtgtggtcatcctttgagtttccttgaagctctaaaaaggctaaaaggttatttccatctggagccactggagccttaatccatgtatcttttccctgcgcgaatctcaacatggcggaactggaaagtgagactcccaacttccatgtgaagggaacgatgtcaggcaggctgagaagcctgagggtggctggttccaaagggactgacccaagcctgtagcgagcaaggaggctgcctgctacccagagccaccaccccccatggcagcagatcacagcccctgttctttctcttttgaagcttcaggttagggatgggcaattcatagcaatttgtctttgaggtgataggtttggcaaaggggcatgatccaagaagtaagaaatgtgtgagaagtttcataaaggttgatggcgattgtgaccatgtgacctgtgcaatctttaactcatcgagtatctaatgtagattcttaactgccttgagtgcttttaagggactccttctgtgggggcttcatggggatttttcctaatggttaagctatgtaaatgtcttccacagctcctgtaaaatctcccatgctgaaataactacatccctgctctacagctatgaggattgtgaccgtatgtgtcccagcaagtggtagccaccatcataagctttggaggacactgtgttcttctagatactccctgggccatcttttcagatgtgccctttcagaagtggtcgccctttcagatatgtccttgtcttagcagttggttaaagcttcataggatatttgtattcaaggtgctagttcaaaaacatgaccttgaattcatagctgcgaagctcaactgagagaaaacatatttaggaggatggaatccacgcattgccgtagaaaactccttctcaccctggtggatacaacttttgaaaaatattgatacctgggccccatctagaaattagtctcatgtgggtgctcagagaacatagggaggtcattggggatggagtagaatgagcaaagaagagaagaaaatagggtgagagaaacaatggggtgtggaatggggagaagaggtgcagattagggagggcatggcaggccatggtaagggcttggcttttgcccagagggaggtggagttcatagagggttttgagcaaaggagtaacatgatatgacatatattataaaatgatcactctggctaaattaattccttttgccattgcatccttaaaataaacctaaaaatgcagaaaaactgaaaacaggaaatgattttccaagctgctactcaaatgtctaataacaagaagtgactagaatcctaaatcccagaatggtccacgtattatctccccagattcctgatagagatatgtagaaggcacatttcaagcaggcttatattgttttattctaagagggctgaactgggaatgtgaggtttcaagtccttctttgcttaggtgtatccagaggtaatacccagaaactcaaatttagtggtttgagatagactgtagacatcctgttgttaaaatgattccaatgcccatgtcgaaaacacgtctccaaaggctggaaaaatcaactgacattgacaaatgcttttagttttcctttcttggactctatatagctgtactgtctatacagtaaccacaagctacatgtggaggttgggcacttgaaacggggctagttcaaattgagattgtgctataagcataaaacactcagtagattttaaagacttagcatgaaacaataggtttatgtgttagtcaaggttctccaaagaaattgaaccagtaggatagagagagatacataagagggggtttcttaatggaaattggctcatgttattatagaggccaagaagtcccatcatatcccatctgcaagctggagaaccaggaaagccactggtataattcagtctgagcccaaaggcttcagaaccagggggacaactggtgtgagtcctggagtccaaaggctggagagctagaagcaccaacatctgagggcagaagaagacggatgtcccagcacaagagagggtgaattccccttcttctgcctttttattctttccaggtgctcaatggattgggtgatgcccactgacaattatgatcctctctattcagtcgactgactgagatgctaatctcctccaggaatgccctcatagacacactcagaaatcatgttttatcagccatgtgggcatctctcaggccagccacattgacacacgaaattaaccatcacaatgtaaaatgtctcaataatttttacatagattacatgttgataaaatattagatatactaaattaaatacaacatattattaaaattcatttcacttttttactttttaaatgtggctacaaaagaattaaaattacaaatgtgggtcccattacacttcttttctttctttctctctctttttttttttttaaagacctctgtctcccaggctagagtgcagtggcacaatcatggctcactggagcttcgaactcctgggctcaagcaatcctcccttcctagcctcctgagtagcagggattacaggcatgcaccaccaggcctggctttcacattatatttctactggacaggactgatgtagagcttttcaaagactcctcttacataggaatcatagccctctatgataaccttcaaaatacacctacgatgctaccattctccgcagtaatttttttaaagaaaaatgctaaattgcttttttagatctttcttgtaggcaagatataaatagaaggctttgaaaggcaatacaacatagtagttaatagtaagaacttggtagatgtgtgactgcaggcaggttgtttaccttctctgaatctccattccctcgcctgtagaatttgaataatatgtaccccatggtgttgtgagactaaataacatagtccttaatgctccataaatggtagagcctttgtaattggtgctgaaatttaaagacaatgtggagttatcttggattcaggtgatgagattcaacataagaagcaatgcctcaagtccttgcaccaacagaggtgcagaaattcatcatctccctaatgaatcttgagttttctttatacttctgtcatttgattagaaacaaactctcagcatgtcagatttatattcaaatctcagaataaaaataattacagaagcaaaatgtcatttggaaagggtgtgtttggtggtcagaattgtggttgccacgtgccttcgctaaatatcatgactaaaagggaaagacatgcagatctttgctaggaaggcaagagaaagaagaggtgaataaaaggcttgaagctcttgctactctaatcaaattgttttatttgtgagagttcgctttagcttgctctttatgtttgaacctaagtcttttcacctgtgacctcatcaccatttttctaatattgctcagctcattagccttgaaatttataatttagtttttacaccattttatcctatttcttcccattgccaagcacaaacatttactttgtaaaaaaacgtgactgaatttattaaaccagtttgtcttcaaaagtttcccttttttatagacatgggaagactcaaatagttggtttccctaattctcaggagacaaaccagtgaagctgaagccagttttgtatgcaactaaactttgtgccccgtcctttgggtctccaattagaataaaatcagggatgggcaggcagcgtgcattttaaatcaccatccatggtcactattatttccaaactcaaaggcaccattagaacagggaaacatttgcaggcatttcattacaccttgaactattaaaaaaaataagacattagaaagaagtgattactttaaaactttcacacactatggaacaaaagaaatggcaatacacagggagatattatagtaaacaaattgacgcacacggttgttgttagtgaaggacagtattacaagcagatgaggcaaatgaatgagttgggaagagagtcaatctcacttcctgaagcaggggcccttgagaagcctgtgccttttaggctgtttctttgtaggattggcctgggtgctgaaaatagcatagagccttttgcagaatcctttatttcaaggagttgcggtatttcatatgtggcacggcccctcccttcaatggcctctctcctgccactggaaggtgtttttacagttccccttgtgacaaaggacaggtcagagagcaaacctgtgagcaaatcaggcttggcacgcacatcactaagcaacagatgctttctggaaaaccatttgggagtgtttcagatagtagtatgtgtgtgtatatacaaacatatacataatttctggggaaaaaatacatacatacatgtgtacatccatactttctgaaaatcacacacacgcattttccagaaactcatttgaggttgattttatgtgtacggagacagagaaagccatccatccatatagaaagccttttgcaagtatttttaatttatttcatagaagcctgaatttatttcacacaacaatgaataaatccattcttttgccacagacgtggtgcaaaaagaggggtgtgcttgaagcatctacaaaggggaaaaagctgctgatacagggaaaaaatattaaagtaaaattttagttgtcagctttgtaattgaagctgtctcctcacttgaaaatattgtttccactgaagtagaagacaaagggggatctggcaaatgcccccacgatgttcatttccccagataaattacacacatcgtgtgtgcatgaagatgaccagaggctctcactgtgctggggatacagtccaatcattcattcaaggctctgtgtagtcatacaacaaacgcgtggcctaaatccattctttttcttctttttcctttctcttctcattttttcttttttcctccttcttctgccaaaagacagataaagtataataactttgatgacaacctcattttcaggatctctcgataaatcataatccttcagttgtattttccaaaacctgcagttagccaattacttcttggtttccttgaggtgaatctttgctttttaattatattttatcttcttcaaagaaaccactattgaaaaattatagctaatggtagaaatacatcactaagatgtcttggattttcttttggggaggagaggtgggggaataaaatgaaaaaaatatgtatatggccaaattggtctgtgataccattaattcatgttcattaattcaaacagtgtacattgcatacctactatgtgctaggagttgggttgtactccagaaataaaaagtcaaataaaacgtgtttccctcaaggaaactatgttctccagcatctgcacatgtaaactaccaattccagtttagtatgacaaactctttggaagtattatattttgaatgtatttcatcgagaaatgaatgtgggccaggcaaggtggctcacatctgtaatcccagcacttagggaggctgaggtgggtggatcacctgaggtcaggagttccagaccagcctggccaacaaggtgaaattctgtctctactaaaaatacaaaaattagctggaggtgttggcctgagcctgtaatcccagcttctcaggaggctgaagcacaagaatcgcttgaacccggtaggcagaggttgcagtgagccaaggtcgtgtactccagcctgggtggcccagcgagagtacatctcaaaaaaaagaaaaagaaagaaaagaaaaggaaaaaagaatttctaagtctggttttcatagaaacaagtgcaaaacaagccagaggggtcattgccaaactagaaagaagcccagggccagaatatgcagggttagtggagaagcccagtgctcctgggcctgaccacctcttggactcggtataccatcataaacagcattcagtaaacatcttttttgaagaggcatagtaaagaactacctgctaagagtccagaaaccctgtgaggcctcagataactttagtaggaaataaccaagctcttgagttgcttgaagtagaatcccattagcttctaatgcttcctgtatttgcgccccattcaaggaagcaactctagagaatttctttgaatcctgttacttccatttgatgagtgagactcagctgtgatagtctatctgctttaagactgccgatacgatgtggcatgttctctaaagaaggcagaaggcttgaggacggtttgtgttgattgaagaacatttcagtgatgagttggaatatttagacaaatttcaaggcttaattaatatatgaaataaagtagttgcagagataacgaggaaaaccaaagttataatctatagttcatttaccttccttggtcagggcaaatattacaaaagatatgtactgcttttacaataatcagcaaatgggaatgactttgaatttcagaacacatatgggaatgtcatcaacttcgactttgaaatgtggctttttaaaattaaaatataaatcattctattgttaacaaaagtttatcaaaagtaatagggcttttgtagatttttggtttttcttttctattaagatctttactggtagagaaaaataaaattttattaattcaaagattccattgtgtttttatgtttgtgagtaataatcagtggttcctggtatctcatttcgtttttaattcccaaagcaggagctaataagcaaatcgctttgtgggtttctgtgaaaacagctagagtttgcacaatcgtcgcctagacagagggaggagtgtgggctctgaagttcagcagatttgcatttgactcttgactctgtgattagctgggtgtccttgagtaaactactcctgtaagcctcagttacctcatctgtaaaatagggatgatgacatctgctcaaagcgttgctgttgagtaattaggttaaatgagataaaaagtgcccattggcacctattggaactcagtaggagctcatgtcttcatggtgtgtaaatatgtacctggctcccatccacaagagtcctcgctgaatcaacaaactcacaagtgcctcttttcactagactgagactaaaaccgcgaattaaaatggtgtttgtcctcaagaaccactagggtcaagaattctacatggctcaggcagatcagctgagcacgtgagaaaataaggaatatgcagtctaagtacagagctcagatgaagcaacttgctgcctatcaacagaaagggtggaaacaccctggtgtgtgcaacaggcacaaatcatgtaattcagtaagtctacaaatatgtagttaaagaaacaatataatttctaaaagcagtctcctcgcagcaaactgtgaagttagcagcacagaagcaaactgaggcagagtcactggattggagacaagctgatttgtgaaagctgcttgagtaattgaccaacctctgcacaactatgttgcagtttactaaaccagtataaaggagaaaaaaagcagtagaaattaagagcattcgttaagctgtaagtcctttcattcttttggatatattattctaaatgcatcttataacattttcattaataaactgctgttttaattaatgatgaggtctcagtcaactgaatgacatttctttcaagaagcccacttcatacgcacacaaaagaaccctgaaatttttcactaaaggaaaggccaatgtgatccaactagttgaagaatatactattgcaattaaaaaatcatttaattccattcggctcaactcaatgaacatttattgaatatctgctggaggccaggggctagctgggattagacacagttcttcctttcagaaactcacagtctagagagaagcctggtgcatgaataaggcattcacctttaacctccttatccctgttctgttccttcccttctcttcctggtaaggcacgcttatttgcaaaagactttctacatgaaaaaaatatatatatgcatataggcatatacacacacatgtataaatattcatatataccctcaaagtagtttcccaaaattacttgtgtgtatacaaatattcatgttcatatatatatttttttatagaaatgggactatggtgttgtattaatgttggtttcctgactccaacttgctctcacatggttcaggaattacatataatatatattataatatatttaatatactagatatgtaacattaaaaattattttaattatatataatataatgttaaatataaatatatttaaatttttaatatttatatttaaattttgactaccatttgtattatatctaaatataacatatttaatatgagagagaaaacaaatatagtgaaatgttaaaagttagggaatccagatatggatgatataggagttattcatactatttttacaacttttcaaaattatttcaaggtatattggtcttgtaaaaaattttaaaataagggattcaagaccttcctggcctcaatcctgcctttcttcagcagcacctgcagccgtacatcaccccacatttaataccaagttatgtccaacatcctcccgctgtcgttcctgacgctgactgcacattagactaatctgagaaaatgctgaaatatgccaataggcaggcctctccccagacaatcagatcaggactcctgggagtttgctccagccatggttttttccaaaaacatagcctaggttgggaagcctggaggcctgtttcccaaacaccatgctgctgcattcctcatgccttggtgcctgctgtttccagtacttggagggtccttgtccacctcttcagtactgtagattcctattattttgtcaggatccaactcagatgtcgccttccttagtgaaaccatccaggcatcccacgccccacccacaggtagatcccatccttcccgcctcctgctatttatttctacacactctccttctacaggtttcccacactgttgtaatgctgtgtttgctctgtctcccaacccaccgcaaactccgtttgggaaaagtatatatcatgtttgcttttgtcatcagcatgagcctcacatatagtaggagtctaagaaatgtttactaaattaaatgcaaacaaggttatacttgttggaataaagttataacaaggagctatgggacacttgaggatgtgcactcttacagtgcaggcggcacttgcggaaggagatggagctcacgcagaatcgaagagtgaataaatagctaagtagtcgggcaggagagggaaatgggaacagcccgcctcttaggctggctggagccacgtggagtacgcgaaggagaatggccgctgaggccaagaagggagccagtccagacgatgaaggggaccaagagcgttagtcactctggaagcagagtgagcacctcgcactgcgctggcacacagatgcctctcagtcaagcattttagagaaataatgagtgaattcttttttgctctttttctttacatttggcaggggagtcatgggaccggattgaaactaactttcttcccagaagaatgtatttgcacatactttcccgaaaatgtcagaagatttacaggttttctgaaatgtattcagtgacacttcccccaaaatgatatgccacattctaagaagagggatatattttaggtttaagaaggacatggttagactaggatgtaaggcgggtcactgaaagtctgtgaaggacagattataggaggtaagatgcccattggaggacaccctttaagaagtcatcacagcgtggtggctcacgcttgtaatcccagcactttgggaggccgaggcgggcggatcacgaggtcaggagatcgagaccacggtgaaaccccgtctctactaaaaatacaaaaaaaaattagccgggtgtggtggcgggggcctgtagtcccagctactcagagaggctgaggcaggagaatggcgtgaacccgggaggcggagcttgcagtgagccaagattacgccactgcgctccagcctgggcgacagagcgagactccgtgtcaaaaaaaaaaaaaaaagaggtcatcacaggtgccaaagtgaaacccaagtgcctgaaccagaggcatgacagagctgtgcccaagagagaacagatgcaaaaggttacgaggcaatgcaaacagagagcttagggtgtctctaggctttctgcctttgagtgaccatgcagatgcagtgtcattggtcaaactagaaaattcggggagaggatcagatttgtgggaaaggatgaattccattgtgtgaagcttgagtttgggtttcccatgaaagaacaaggcggagtttccctacagaaagttgcaggttgggagtgatggagatgaggctctcctgatgagtgagtatagagtgtgatggaagaggagcactggagggaaaacctcagtgccccaacattttcaggatacacggaggaaaaagagccaatgccttacagagaagctgaaagaggggaaaggaaaaccaaagagagtttccaaaggctccaagagttgagtaaatcaaataagggcagaagtggtctgttcactttggtaactacgaagttcatgaacacctcagtgacagcaacttcacttcagtgaatggagttcaggccaaaatcaatgattaggaagtgaaaatgaggagatgagaaggtttctagaatttccccagttagattgggaaaatctaactggacctctgaacagcattctaacctattggtcagctcctctttcttgaaaaaccctttttccttggcctcattcagacctcgtgttcaaggggtccccggggtgccctaattacttcctctctgttcttcctttgcaagctcatttccctgtcccagtttgaaaagggtgacttctcagggccctcctgtcttctctcttcacacacttctcccagggaattctatccatgcttgcattgtaaataccatcataaaaatgattttaaaatgaatatttcagcccagacttttttggctctttgacttctatgcttccctgacacaaaggcacctcaaacttgacctgttcaaagctgaactttgttgttgttgaaacagcatctcactctgttgccccagctggagtgcaatggtgccatgatgggtccttgcagccccgacctcctgcactcaaatgatcctcccgcctcagtagctgggactacaggcttgtgccaccacaccggctatttttttcttttcttccttttttttttttttttttagcgacagggtccccctatgttgtccaggccagtcttaaactccagggctcaagcgaccctcctgccttggccttccaaagtgctgggattaccgtgtgagccacagcacccagccaaagctgaactcttgatacctgccatatccccaaccccaccaagattgcctgcctctgtgttcccataatcagaaattgtcaccaccatctatccaaaaatccgagtctgtcttaacactctttccttcacctttttaattcctaaacatcatcagattctgtccactctactactccaaaccatcattatatttattctgtcccattgcatagcctattcaatggtctacctatattccctcttttctctttccaatgcattcaccaaaatgcagccagaatgagctttcaaaactgaaatcagattatgtcacctttgcttaaaacctttcaggagttacccgttgctttctgtgtaaaaaccaaaatcctcagaataccacgacctttctatctagcctcacttcctactatggtctcccctgagggtttgtcatcttggcctccactacgttcatcctcgacattctcttcttcctcagagcctttgcacatgctcttttctcttcctagaatactttccctacccccgttaccagcaaaatctcactggccttcaattattaacttaaatgtaatttacgacctgctaaatctctgtcagctcatagttcacagatggcagttattacatatttgaaagaatggattaaaaagactgagtgctagccagaggaaaatagaggttcagggtaggggggcctttaagatgagaatgatttaaagcccacagcaatgaaatgatttgcctggccaaggtcaaaaagcgagttggtggcaaagccagggctgcaatccacgacttttgattcttggcctccccatgtcccacactaatcctttattatatgtcttagatgaagttagctgtagtgaagccctcatctcatttgctgtccccaaaacattctaacctgttgaccaccatgcacaacaggaatacgtattaacacagtttcaggagcatgacccaggaaattctataatagatgcaaactatcttcctgtttaagaccctagtagagttgttcagtggtgctgctcttaaattccaatccaagaaggccacccggctcccacacagtcaagccatagctgattgatgtgtttacagtaatatacttcacacttgtgtcttgtgggccacacgtgccactcaggataaacttagagatttttctttggcattttttctccattgtacagattcagacacttaaagcttattacatagaaactgacctagaagtgaccgggcctttggagagaatggcaggaaattggttacaatagatatggacccacctggggaaacagaactagcagaggtgaacgttaacccatcccaggtccaatgttgttagtccaaaaagattacagtaagttgaagaaaacatcaaacaaacagaataaaaaattcagcaaggaaattcagagtggtacacttggggagaaaaagcagattttgccaatgtaagaccaggagaaaaactggttgtgtttcagcattgcagtatcttgggagaataacaaaacaagtttaagcagagttgtgccatgcagattgcctggaaggaaccaggcctgcctgatgcagaatcatgatgcatgcagaggatgatgtccaaggtccccgggagcagaactccataaaattcacttaactcttttactaggtgactaattaaaaagcagttaatgagagtgatcattctgggcaatggaattcagccatgaaagtggttaatgacctgaggctgcagctcagttctatgcctcctctagcatggttctggctcccaggagagcctcctagactttagcagaagctgcacagagcttcaagaatccaggatatctgggaagaggtaggagagcgcattgggcgacagaaaggagtaagcaaatattaaagggtttatttacagcagaaggtaaaaagaaagaagctcaccacaatgggagctcaataaatgtggtttgcttgagcgactaccttgctgactgaaggagtggatagagcacgtgcatgaggcagcttgcacagtctgggagacctcgcttctcagctccttatttaatgacatcatgttggtagcttgaagtcggacaaggtggcagtattgacatcatgggaaataggcaaaaactataaatcagaatttttccctccccctcaagccagttgcttaacatctaccaacttaccattgggtcacttcgttgaaatccctgtgggagcagagttccctggggttcttaccttaagaataaacctgaaggcgttttggttttgctttcctattttaattactaatatacagtggcactcttcagtaatcttttattacacaaccagagtggctcagcatttgtgaagtctcctggcaaactcaccatcatttaaaacattgtttctgtggggaagttttccaagttgcaagttactgagtctaaaataaatttttggaaaagagcccatttgcaagttgggagctttcaattctgagtcctgataggaaagttagaaaacaaaaagaatcatgccaattttaaaaatataggttgcaaaatataggttgcaaaatcctaagtgaaaaggcaaaaggaatagaattatttaacttggagaagagaaagatgaagagcaattgaataataggagtgagtgccagctgttgtttgcttttggtttctgttttttgtgggtttttttttttctcccactgtaagcctcggggatttggttaaacaaggagataaatatctttatgttattattctggaatgaataattggtggattttatgtcaaacatctgcaaacttcttttcctcaatcagggataatttacatataacctgtgatgaggaccaagaaatagttaagacaaggttatttgtctacttgaaggttaactgtcaactttgtgaccctgagtccacagatggcataatgtatttcaaaactttgagaaacatgatataattaagcaaatcctttttatatcatagaatatctaaatacagaatttattatttttctatcaaaaatgattataaaacttagactattagcattatctatagtagtattatattgtctatatctgttagtattgtctattactagtatctatattactagtacaaaaccttaaaccaagcattctaaatcaatactttttgataattttacgagggaaatgatgctattttgggcttgttaatttagagttattttcagttattcattcagaagagatgagagaattgctttcttttagaatatcttttagatattgcagtaccctgatttggcattttcttaaagagatgtgaaacaatgaaatggcagctgtaaatctgccacttggagccttagagggcttacatcactcccaggctttgctttaacagttggtttatgatgtggtttcagaataacacttttgaacatggtatatcccttcctgcaaaactgacataaatccataaagcttttaatgatgtctctaaaatacagccaaagtagtctctgaggcatatttttggattgtttatctgaaatctctagattgctgaatctcccttcatgatctgccttggaatggctgtctccagggcagctgataaacgcatcatgtctcacccaggcggggaccactcagcttcgtgccccatcaggtacactaccctgcctcagctttcaccccaagcatctcacacccttgtgcgcataagtatcacctggggacctgcgaaaaatgctgcttctccagaacccctgagctaaattctgggactaggcctggggaccagcattttaacaggctcccaggaaagtggtcacagaaatgatgtgagagtctcagctctacatgctctctgactccagttctggcttcgggatggagtaactggagagaggctgacaggtggaagctgaggttcttgccggtgacacgctgcacctgtcactcaggtgctggggtctctgctgcccagacccttccctccctaggccaggttctgtgctcctcagtcttgaatttcaagcgcctggtatgcgtgtcttctcttgcacatcatcctgcctgccccactgtgattcatttgaatgccccagcctccatctctagcctgcctcccaccctccctccaagtcccaggtccacctcttctcacccccgccagagcctgttctcaggtaatgaccccccacattctctagcagaacctctctctgtggcaaactgaactgctcagtgtgttttctccaggcggcccgccctgcctgcccttcctgactcctcctccctcccctgtcctctgttagacacatttacagaagcctgtcctaggagtgtccatctgccccatcagactctgaactactgagggcaggggtcacctgtgccttgctcacgggatccccaacacccagctgaaatgtggtgggagcctcgggggtctcaagtgaatgactgattcttaaaaagaagcacgtgaagtttgtccaggcggcatgatgcctcagacttcagaccctctcactgccaatacactgtgccttcagctagaaagctagtcttcatctccgccacctacctgtacttggctacccacctctggccctccaggtcccagcttagatgtcttttcccacagcaagtcttccaccacccctgtgttccagggggccctgtgtctacctgatcctgcacttacccctctgcattctaataatctgtttacctgaatcctcctccaggtccggagctccttcagagcaagagttgtcagcacccagcatcgtgcccagggtgcagtcagtgctcaatagatgtttgctgaaagctaactcagcacatttaggtagtgagatggggttctcatcacatagctgctaaataaaccgccataacattcactgtattgtactcacactgttgatgcgtctcctcccacaaccactgctagatggaaatcttctcatgggaagtgattgtattttgttcatcttcacacttcagtaagtcaggcagcaatgagcatggattaagtagctgttcaatcctatgttttccaagaaggatagttttggcatgtggagcaggagaattctttttttatttttatgtatttatttatttttgagatggagtctctctctgcggccaggctggaatgcagtggcggatctcggctcagtacaacctccgcctcccaggttcaagtgattctcctgcctcagcctcccgagtagctaggactacaggcacctaccaccacgcctggctaatttttgtatttttagtagagacggggtttcaccgtgttggccagaatggtctcagtctcctggcctcgtgatccgccagcctcgacctaccaaagtgctgggattacaggcgagagccaccgcgccccgcccaggagaattcttaattgcataagacagccccacacattgcaggacatgctgctgtccttgcccgtgcccactaaatttcattggtatcccaatcattttgacaactaccccacctacacacacagttacaaaagttttgggggtaagaggaccaggaggaaaattgcactgcacatagttgaaaagctatagttaagtcttttccttacaacttggtgagaagcaatggactccgtaacagtgccatggtggattatatgtgtcaacataattaacagaaagaggatctctgaaatataagatatttatctggaaataaagcattgcaatgggaatatgcatgccatagttaactacatgcatattcagggaggtgaagacaaaagtttttaaaggaaaaaaggaggaggattacataattgttttaaaataattatccttggctacaaagatcaataacaagggtgacaccagtccaagtttggacaggcaaattcagggcagttgttcttgtagaaccgtttttttgtgtaaggttgcaatggtgtttgggcaatgttgtgctttttgcagagtctctgtgatagttcttttgatcaggcatttattcatggccttccccagctccatttctcagggctttcttttttttttttttttaacattagtgacttcattttgattctgacaactttcacacatgtgtgtggtgatgtgaggtgggggccaggacatgtcaccctcaatatacaacggtaacctgtctttgtaataatagttcactaatctttcctgagcacttatatattccgggcactaagctgtgtattatatagtttacttaatcctcacaaccacctatgaggtcccattttttagggacgaaattgaggctgagaaagtttcaagacattgacccaagttaacacggctgctacagacaagggcaagatacacccccaggcgtcggacttcgctgctctgtgccgacctctttaacaagaacaaacatcaaaattcccagttggaagactcctattaaaaactgtcctctcccattaattataacgtagagcagttttgcacaatatattctgcatagtgttaatttagtgggatgtcaagtgttgtgagattaacggttgcatgggcgatggagtgtgggaaatgctttcagcaaggcccttgtagaaggccgtgaaacagaaaccgtgaagaccacaggatccctaaggtggcacagcccttcacagtgagtcggagtgatttagaacattgctgagcaaacagcagggagaccggcaacaggagcttgctggccatgaagtgcctaatatccagtaagcactgctcaggctctaggaaaaggctgatgcaggaagggtttctttcttctaatttctcaataataataaaaatagatactatttatggagtactaattactctccacttcatagatgaaataccaaggcctagaaaaatgtgttaagtaacttctcctaaggtcacacagctatttagtggcagagccaaatttgaacccagttctctctaacttcaagacatgtgattgtaaaccctatacacaaagtctctaaggacgtagggcttataaaggctttcctgtatgaatatccaagcaaattcagtctcaaagaggatgcccctatgggttccctgtaccagggatttatttttggcatatctcttcaacctgacaattcgttccttggtctgagtacatgaaatttttttcagggtatgtgaatttttttcttggtatgtgaaatttttttctggtataatgtaagtttcttaaattttactatttttttaattttatagatttctatatgatatggtttggctctgtccccaccctaatttcaaattgtagttcccataatcccctcatgttgtggaagggacctggttggaagtaatttaatcacaggaggaggtctttcttgtgctgttcttatgataatgaataagtctcacaagagctgatggttttataaatgggagttcccctgcacatgtgctctctcttgcctgccgccatgtaagacatgactttgctcctcctttgccttccaccattattgtgaggcctccccagccatatggagctgtgagtccactaaacttctttctctttataaatcacccagtctctggtatgtctttattagcagcgtgggaacagactaatacatcataccctgttacatgctttttttttttttgataagagtatttgtgttgatgcaatagcatctttctccatagaacttactcagatgcccttcctggagccagtgcctgcactccatgaactgctggagaggtcattgtagggtatcggcatcagacctctcctcatttttcaattctctctctcctttataacagatgttggtgcattttttgaagaagggatgtggctacgatataactttcaggcaccagcaacaaatgccagagactccagcagcagagtagacaacgctcccgaccagcagaactcccacccggacctggcacaggaggagatccgcttcagcttcagcaccaccaaggcgccctgcattctcctctacatcagctccttcaccacagacttcttggcagtcctcgtcaaacccactggtaaggacaaggatacccagcctctgccatttaacatttgggcagacagaatgttctagcaagagtctatagattgttcttggtttgttatttattccccataggcttttttaagcaagtcacataacttctttgaaccccatttctctccatgaatatcaggaaaacaacttgccagctgggtgtgttagagcaaggtgttagagtaataatgttggtgaggcatgttgcgttctttacaagaatgctgttgcatgaataagagatatgtttgcatgtgtaatgattattttttctccctactaaataaacacatttggctggacactgtggctcacgcctgtaatcccagcactttgggaggccaaggtgggcggatcacttgagctcaagaatttgagaccagcctggccaatatggcgaaaccccatctctacaaaaaatacaaaaattagctgggtgtgatggcacatgcctgtagtcccagctactcaggaggccaagatgggaggatcacttgagcccaagatgtcaaggcttatagtgagccatgatcgtgccactgcactccaggctgggcaacagagtgagaccctgtctcaaaagaaaaaaaagactaataagaaagactaataaaacataaatacattcactaaatgtgctaaacagagatgggctttgaatgagtaaaattaattttacataaattaattttatcctgatttatgatagtataccagtaggttgttacagaacatctgaactttcaataggagtagaaaatcagaaatgtcttcattcccaatcctctcagaactttaaattcacaaagtgtatccctgtcataaaggttgcttaaagcaggagtttattttaattttttttgaaacagggtcttgctttgttgcccaggcttgagtacagtagcaggatcacagctcacttcagccctaacctctcaggctcaagcgatcctcccacctcagcctcccaagtagccgggatcacaggcacataccaccactcccagctaatttttttaattatttgtagagttgggggtctcacgatgttgccaggcctggtcttgaactcctggactcaagcgatcctcctgccttggccaaagtgctgggatgacaggcatgagccaccatgcccggcccaggggtgtatttttacttgtaatatcctgggccatcttggtcgtcaaacacacattaagccagagaggatctgagtgcacctaaaattggcatcctgaggagaatatgcaaatgggcttgtgacccttcagcagtgacctctgagagacatctaagaagccctggagtgtacaaacttgctgaacttgagaagtccacttcctctctgaaaatgaactcatataccttagaattctaagatcactcttttttttttttttttttttttttggagatggagtctcgctccatcaccaggctggagtgcagtggcgcaatctcggctcactgcaacctccgcccctcgagttcaagcaattctcctgccttaacctcctgagtagctgtgattacaggcctgcaccaccacgcctggctaatttttgtatttttagtagagacagggtttcacatgttggccaagacaatctcaatctcttgacctcgtgatccacctgccttggcctcccaaagtgctgggattactggtgtgaaccactgcgtcagccctaagatcacttttttaatgaataaaaatattttaagagcatgcaggaacaaatctctctaactcacttcccattggagccgaaaatatggagactctctctcccactgcccattgtttcctgcccttcagtgattattccactgttatggcatcttaaagagcaagaattttggctgggcactgtggctcatgcctgtaatcccagcactatggaaggctgaggcaggaggattgcttgagaccagtagttcaagattagcctaggcgacatagcaagacaccatttctaccaaaaataatttaaaaattaactgggcatgaaggtgcacacttgtggtctcagctgctcaaaaggctgaggcaggatgattgcttgaggccagtagttcaagactagcctgggcaacatagcaagactccatctctaccaaaaataattttaaaattaactgggcatggtgaggcacacctgtggtcctagctactagaaggctgaggggggaggatcgctggagcccagaagttgctggagcccagaagtgcaaggctgcagtgagctatgatcacgccactgtactccagcctgtataacagagcaagaccctgtctctaaaataaaataatttaaaaaaaaagaaaaaaggagatcaagatttttcccatgggagctagaactgttattactaacttaattcagcttgagttttaaaaaaacagtaaattaaactccctctctaggaaatgcactgttgcttaaaaagatggaggaaaaagtatgttccctagtattttccccttctgaaattattcctaaagaaataagccaaaagtcaaagattcatcatgaagatgttcatcataatgtttcgttttgttttttgagacggagtctcgctctgtcgcccaggccggagtgcagtggcatgatctcggctcactgcaagctctgccttccaggttcacaccattctcctgcctcagcctcccgagtagctgggactacaggcgcctgccacaacgcccggctaattttttgtaattttagtagagatggggtttcaccgtgttagccaggatgatctcaatctcctgacctcgtgatccgcccgcctcggccttccaaagtgctgggattacaggcgtgagccatcgtgcctggccaacatcataatgttaactatgaaaataaaaattgaaaagaatctgaaagttcaacttttagtaaaatagtaaaagagggagttgccattttatggaatattatgtatctattaaaatatttatgaatcgtgattaatgatatggggaaattttatgtatgttaaaccaaaaaaacatgaacaagatccagccttgaatgtgaaatattagctccataaaaaatatagggatagaaaaaaaaaagcaataatgtgaacacaaaagtgtttggttggattgtggatgatttttttttctcctgagcagtacttttgtatgcatgtcaaatgctttaatcagaaagatgaaaacagtaagtaaaatcagaaagtgaggatgaaagagagagaagtatggagcccctggtcttcaggagttcatcagtttatttctcctggatcagggtcaataggtttttttgacccactgatgttcactacccacatggaccagcctcccactgggcagataagaaccttgggtttcttctcaggtccctccccaggaggagggctctcacccagagactgtcaagaagttggtgaacacattcccacacatacttttattgtctgctcctcgagtcactgccacactagatttggtcctcaactgtattcgctacctcacatgcccactgctacacacccaccgctgctgtgccttcatcacctgccactgctgtgccctcatgcctgtgtgaggactttcattgtcttcaagggcgttgatcaatggattctgtattaatggccaccatttaatgaagctcactttgtgcccaaagccatcctgaatggtgccatgcattaattcccatgagctgcacaactctatgaagtagatactattattatttcctttctactgatggcaacacatgagtgcatggaggttgagtgccttgcacactcagaggatgttgggccaggctggggtttctcagcctgggtgtccgattccagacccaaagctccccaccggctgtactctccagggcaggcatctctggaactctcagtgttcttggaaggcaaagctgggtgggttctgtctcactgttacaagactatcctcaaactgctggtgaaaattcagctttttcagacttcaaatacaacatgtttttattatttgaagtttaaagttagaaaaaaaaggaaatcattaggaaaaaacatcagtaaggtctacgccaaagtatcaggaaaaagctactagaaagtctccactaaacaccctggcatcactcacatttcacatatcgaaagctctgctcactgtcctccagaaccagctgcccccagcaccaccactgcccatcagacacttgtgttcccaaggtcagtgtcactcaccagtgctccgttcttccctgcttttgtgggtcacccaggcaaacaagtcctgtgaattgaactcatggtgtccttttcctccccaccactactctctgaggcaaatatcttttaattcccagtagtgtttacgtcatggtgtccatagaaaattattatatttgaatggtaccagggtaaatggatgaggtcatgttttggaggccacctgcccagtgactccagctgccatccccttcttcatgtctgccacggtgtgaggggagccttgctcctggtaccccatcacccatctgtaggacagccgtgggcttcagcttgttggctgggaaattctctcccaatccatctctctgcttccagattctccccctcaccctttttcaccacagccagcaccgcctgcctttatagggtgtcttattttctgttgcttgtaacagaatacgtgaaactgggtaatttataaagaaaaggaatttatttcttatagttatggaggctaagaagtctgaggccaaagggccaaacctggtgagggccttattactggtgggaactctctgcagttctgagacagtgcagggcatgacatggcgaggttaagctgccagctcaggcctctcttcctcttcttatagacagtcccactcccatgagaacctgttaatccattaacccattaatccatgaatctatgaatggatcattccatgaatcgatgaatggatcattccatgaatcgatgaatggatcattccatgaatctatgaatggatcattccattcatgaggacagagtcctcatgatccaatcacctcttaaagggctcacctctcaatatacccatattagggattaagtttcaacctgagttttggaggggatattcacaccatagcatagggatattgcttaaaagggatcttgtataatgtctttattaaacactcagtggtgccccactccagcaaaaccaggagagactcctcagtgccacaaacttttaagtttgagacccaccaagctcatgggtgagatggtggcctgtagagctggaccgtctgggtttgaggtcggctttgccttttgtcagttgtcttgggcaatcagttggcagctccatgcctctgtttgctcatccataaaatagtgtctccctcacaggagtgttgtgaaactcaaatgacaatatgcatgtgtcaacagttattatttcccaggtccacggattcaatctacattctaacgcatattcagcaacccctactcttcgttttgagaaactcattacccctcaagcactctgtggtcatatgtgcacctgactttatgcctgcaatactcccttacctagaaatgccccaacttcctctctagccagacacctgcctttcattctaggctgagatcaagtcccacctccttttgatgacttctccttgctttaaactcctattccacttactttcaatgtcatttgtttggcatttaatgtactgtattgttatctgtctctgtgataaatatgccctgtcttcccagagagatgaaaagctcccagcactacatctcctgcctacgatcagtaccctgtaagtgtgtgctgatgataatgatgatgaccaggagagaataaatctgttaagcatgttatttgctgcatccaataaaagagaagtcccttataactgctttaattcacttgggagatgaacatgagacacagaagtgaagcacctcagcatttgaataatgttttattttaatggacaaatactagcattcttcctaccatcatttagcggtcctcttctgctgttatctgaaaggaataaatacatcatttaaattggattattcaagaatatcaccattactgtttatagatagtcactatatataaatttaaagttccaactcatctttctttctcaaagccaataatttctgctgccattaagtgaagcagttataggaatttaaaatcatatttacaaagtccaagaaggacagaaaagaaaaaaaagagaaaacaatgctgattttaatagagctgaggaacataaaggggccagtgacaaagtgacagcagagaggaaaatgtccagcgttttgcataattgccggttcctccgacctctaggcctctgtgtgtttgtatcctcagagccacacacatattgcctgacccatgccaggggatgggcatggctgtatgtgttataagtggactctacacttgtaaccaggcagaaagcctattttcagacctttaaaaaaaaaaagctgtgctttgcacaggaactaaatatatgtgttctgaagaaatgaataagagatgaatcaaggcagctgtatatttaagaaaactggctgggatgatatgatgtcagagcaccagaaataaggcagagagtaaaaacctaagacaatcaacgtgttttttctgcgtgttgccaaacaactgcctgatcatctccgtcattcccaaacaatggactattttaatgctattgggtaaaggaaaaaccgagtaaacactgaggggtggagagagaagcagctcaagaagtaggagcagcatattcaaaggccctgaggtaggaggagatcgtattttctagggaataagagaagttcgtggtagtttgaatgtaaaaagtgacagtgagtggtatgacttgaaaataaagtagcaggaggaatgcacatcagacagggcattgcaaccgctatttggaaagtacatctttattctgtaaagaattggaaggctttgaaggattttaaatgacccaataaaataatcagttacacattttgaaaacatggggaagaagacggtacagaagcagggagactgtattcatctgttctcacgctgctatgaagaaatacctgagactgggcaatttataaacgaaagattttcattgactcgcagttccgcatggctggggaggcctcaggaaacttacagtaatggtggaaggggaagcaagcacgtccttcttcacatggcggcaggagggagaagtgcagagcaaaggagggaaaggccccttataaaaccatccgatctcatcacaactcagtcactatcatgagaacagcacagaggtaaccaccctcatgattcagttacctcccactgggtccctcccatggcacatggggattatgggaactacaatttaagatgacatttggatagggacacagccaaaccatatcagagaccattcagtcatttattcaacaaatatttattccactcctactgtgcatcaggcactattctagacattgggaatagtcataaagaatagaaacaaaaattcttgctctcatggagcttatctttgaataggagaagacagacaataaacaaattggtacaatctatagtatgttgtgtgctaagaactgttatggggaaaatatgaggcagaaaagggagggcctggccaaggggaaggagagggtaaattccacttttaatgaggaagtcacagaaatgatcactgagaagaggacatgagagcaaagacctgaaggagtgagggcatagccatgcagagacctggggaatgagcatcctgaacagaagaaccggtgactgcaaaggcccttgggtaggaacaggaagccaatgtggatggtgaggagtgagcaaggaggagagtaacaggaggttaggtcagcaataatgaggagatcatatggggcctggtgagccattgcaagaagtttgatttttactctgagacggggagttactgggattttgagcagaggatcactctgaccaccgtgtggtgaggacactgtgtatctcagggtcagaggcccagtgggatcagggaaggttggagaaaggacaaaagctagtataatcccagcaaaagacactggtggcttggtccagggggtagagatggagatggcgacaagtggtaagattcagggcatattttgaagatcaagccaagaagacttggtgtcagatgacacatgtcatataggagaaagaggacagtcaaggcttttggcaagaataactggaaggatgaattggcaattcactgaaatgtggaaaactgcaatggaatacttttggggagagaagatggatgttctgttgcatatgttatgtttggggttgccagtaagatatctgagggaaaatatcaagtagacagtttgtgaaagagtctcctcaatgccactgtgtctcctcaaatgaatgtgctgaaaagttatttaactcactcttagtaagaaactactcctagaatttattcattaattttcaaatgataatttcacacttcttgactggaatatcattttgaagattgctgataagtacaggtgtttctgtagcttattaataaaaatatgctattattaaaaaaaaagagtctggagttcaagagagaagtctgactagggtatgaatgtggtgtctgatgggcatacaccttattcaaaggtcctacataggataggattgttggagtaggtaggtagacacacgagcagggcagaagagggtgccccctcccaccaaccaccaagaatgtcagacaaccatcaggtgatggtcaggcagttgctaaactgtctctctctaaaatgataattggctgcagctggcaccaaggaacgaccgtctcccaatagatagaaaacatctggagctggtgatcagcagcttcccaatcagatctcaggagttgggcaagcgggcccaagcatgcacactaagaggcaaaatgatggagtttaacgggtatatgaccttcctctaggaacactcaactggaaaggggaaaaaaaatgcctcaaatgagcatgcgcactacttcagtaaacacctgtgcatgcagcccctcccacgtgctcgcaggccactgcgcatgcagacagcccgccccaagggaagaatcaggggagaagaaaccaaaccccagaactatgccaatgtataaaaccccaaatcaagggccaaacagggcacttggatctctcaagtcgcccgcttggccctcttccaagtgcacttcctttctaaaactttttaataaactttcactcctgctctactaaaacttgccgcagtctctccctctgccttaaacctacttctgcccctcaagccgcattctttcctctgaggaggcaaggatcaagtttgctgcagaccctttgggattttccttcagtaacaggatcaccatggaaacaggcctgaatacaaaagagaatatgcttcagggctggtctttggggactgcaagagtaaggtgccccaaaacgaggggaaaaacaggtagagaaggaaaaccgaaagagtgtgtgctggaagccaagtgttcccgggaggtgaatgaattctgtgccgagtgaagatgaggcctgagagggacaattgcctctacttccccaagggtcacgggcccagcaagagaccgtggagcagggaagacagaagtgagacagagggctcatgctaaaatagggacgggtttggaggcagcaagtgtacccatctcttttcatggggttcggagcaaagaaaagcaaaggataagaggcctcacttgagagtgaaatgaggtcaagagcagtaatttttaaagaggaggctgactaagacccaccatcttctgcaatccaggcagaagatggtgcaggtaaagcacaggtgaggatgaaccaggagctctgtgtggagctgcctcagccagggagcaggctccctctggaattcacacaaggacactgtgggtgccaacagaaagcctgtggttaccgaagtggaaaagagtgagggaatttagatagatttaggagacgaaaatccaatccacggtgcttagttgaaatgccaggggcaaaggagtctaggatgacattctaaggtaaaactcagaaatagtgaaggtttgttgaatttcgtttagaaaacaaatataggaaatgtaattagctcttgattattctaacaaatgttcctttgaaatccaggaacatggcaagtgtaatgttaggatgcctaaataaggaagagcacagcgtgtgtgtgtgtgtgtgtgtgtgtgtgtgtgtgtgtgtgtgtgtgtgtgtgaaagtctggaaggagctactcccaagatgtttagaaaaattatctttgggtggtgggatttcaggtgactttcttttattttttttctgtttactttctatgttttaattagcatgttttattttgtaacttaaaatcagaatatcagttttgttcccctaaaaaggaaatgaaaggtgacaaataatccattaggtgatttgcagttggtcaaattcttgctagattgctggctccatttttaagctctgagatatcaacatgaaaattccaatttgagtaacaaatgagataaaatattgatgtctttaaaactcataactaagatataatatttatgcttgcagattaactaaaagcaggatctacattgtcatattagttattttcaatattgttttttattgttgggacgaagcaaggaggaaaaaaagaatatactgttgaggcaaagtgaactatcattgagggcaaaaagggactcaggggaccagggaaagccatctttcctgttgatttgcatttgattagtctgtaagctaaaataaaatttattacttggtctcaatgaggccacccaaaatctcatctttaagaactatgtttggccaggagcgtcggctcacgcctgtaatcccagcactttgggaggctgaggctggcagatgacgaggtccggagatcgagatcatcctggctaatacggtgaaaccccgtctctactaaaaataccaaaaaaaaaattagcccagcgtggtagcgtgcgcctgtagtcccagctactggggatgctgagacaggagaatggcgtgaacccgggaggcggagcttacagtgagccgagatcgcgccactgcactccagcctgggcgacagagcgagactctgtttcaaaaaaaaaaaaaaaactatgtttatttttaatattgtatgctcatgattcttttatatgcccaatgtcacactttgctgacggggtgagaacatccctgcactctgcatttatttttttatttcacatagtgtttcgtgggacctgcagatgtctcctccctgcagtcctatattgtatatgctctcattctttgtgtccaggcataatcccaacttggatcatttaaactatttgcatcttcaactttgagacgacagtcactgaagttcactgtgggcagattgtaaatatgtgcgagcctggtgctgtcagccgatatgggtcagtaggcctctgagctcgtgaatccaaattcaaatattgaatgttatctgtggacatcaagggagggagtaaagtttaacagaaattggatgggcatggtggctcacgcctgtaatcccagcactttgggaggctgaggcgaacggatagcctgaggtcagaatttcgagaccagcctggccagcatggtgaaacccccatcactactgaaaatacaaaaattagccaggcgtggtggcaggtgcctgtaatgccagctactcaggaagctgaggcaggagaatcgcttgaacctgggaggcagaggttgcagtgagccaagatcgcaccattgcactccagcctgggcaagagcaagactccgtcaaaaaaaagaaagaaaagaaaagaaaggaagaaagaaagaatctaagagcaggaattgaggggatgtgacattaaaatgaaatttagggcaaacaaattactgagctttcttttttcttctataggaagcttacagattcgatacaacctgggtggcacccgagagccatacaatattgacgtagaccacaggaacatggccaatggacagccccacagtgtcaacatcacccgccacgagaagaccatctttctcaaggtatacatacatgtacatataaattacatataatatcgcattatagtccctgtccctataatgcttggccattggttttgttttgaggggatagaagtagaagagatgctttttacactttctcctacaagtgcataactagtgaagtagaaatatatataattctgacaaggaaagacaatgatgaagttgaagacatcttttagggggaaatagaataaatgtttattccgtatagtctttctggttttcccagttctagatccacatatctatcaatttactgcttttatccattgcaccatctttcttcgccaagctctcagacatctgaaacttaccgtgtttcccagcaaaggttattttggtttctccgacctacttctttcactgctccaacacaatacaaagagctgtatttttctctctctctctgcagagcctttgtcttaaaaatcctcaaaacagtctttccccagaatctcagactctgactgtgggctttcggcacacaaagggatggttttattatgacactcaaattttacttcaggttcattgacgaccccggccctcaccactgatttttacagtgaagaaaccagcttgggaaacaccatgaataaaacataatgtgaggaggtctccctgggagctaggccaagacatcaaggatgggaactgtcactgcattctctagaaggagttcaaaatagatgcctgtcaggagaaagaacagcaggaggatgctgttttgtcagtaaagtggagtgtcatttggcaggggttcagcagcctctcagacctcattctgattcggctggatgctgtgggaagttcaggttgcaaagaaaaggcacaagccctatctcttttgagcactggtggatgtcagattcataacttgatatggagtttgcgcgtggcctttagcagtaaatgctagagggcattttaaggagaggcctttcctaggaaactgacatgcactgtttcagcttactgcgccatcaatcaaaggtggcataataaggttctctcatcatggtcgacagagtcccagagcccagcacagtacctggcacacattaggggtgacaaattctttatggagtaaaccaagcccatctttaaccaagttttagtcagaaaagccagcaagtccaggagacagatcgttttacatcatttcatcaacattgtctccctcggcttttgattagagactttttccattttaagccacccaatttgtcacctcttttaaagaaagtgacttatcttgccattttaccattgcgaaataatactaaaacttaaaaagacctaaacaatggcttttcagacagtataacagcagagacccaccacagccatagaatcgtatacagtttaccctcactctctgccacagtgaattagagaaagacttgaggaaggggagaggagtggatgatttttaagacttggggctttggaggcacagaaagccagagatatagacagtggagcagccagagacctgcagagaatccaggggatgaatgggtttgggggagggtctggttctattgcccaagactattttggttgcaaatgatagaaaagcaattcagaagtaatttgttggggaaaattcctagggtaggtcatagaattatagaatttgaaaaagataaaaccaaactttgggaagagaatctagggagcctggagaattaaaactgtggactagaataccactaggtttctctctcccttccttccttccctccctctttttcattctcatctctgcctctctctgaagactggattaattacctcttactgcatgctccatctttcacatatcctaggccatagtcacaggagtactgggctcatgtcttcccaattttgttaccggaagaaggggtcctagtttcttgacactcattttaaaatcccagggaatctctgataggcctggtttgagtcacgtgctcaccttgttgggtggaagggggaacaaagacccatagtccctaatcacatctcttgattagagtggggaacttgggaaactccctcaaaagaacagaatgcagttccagaaaaaggaaggagataggacgacaggagtgaaaattttggatgcacgattctgaggtaggagaggagaaaaacctgggaagtgcttcctcgattccgccctaggttctgcacctggaagtgttgggagatccagctctccctccttctctgtcatgtaatgtaactgactgcagtaagatttctgaatgtcccaacccacgtgagggcaactaggaaagatgtcacggcctggggagctccaatctctcagcccagcctgtcccatctaccctgggacctgcccaccactgagggcaaaaagaaagtaaagatagaggtggtggaggaagacaagatgtagttcctccttatggaaaagcagatcccagggcttctcactcccatgccccactttctttcatgcagggaggccttgcagacgtggaagtaattcggaaagtgctttgcaacaccaaataacactgcaattttttcttaaaacaatctaaaaatccatcttgagaacttctacagcctcaactgtgtgtggaaagagatataataaaatgttcacagtgatcatctgtgtgtgaagggattatcaatggtttgatttcctctagagttttctatttccccattttctattataagcacatgctgcatttttataatcaaacagaaatatgaaacagccatatattctcaacctattctggtagtccccagttataataacatatgataacaaaggcatttcaataatttcaaattaatatttatttatttatagtcaaagaacaaaaataaggctaatgcaaagatgaatggtagatcacagtgctgtggaatgatgtctttggaattaaggtgaatgttgatgcatttatacatgctcaaacatataatttagatgatcctcatcagtgtttatggtgtctttaaaagcaggtttactttcgtagctgggtttggctaaagctaacattaaattaatctgcattccctcagcacacaccctgtgaaacagcactgagcacttgagggaaactgaccttggatgaaacatttgctgccaaaagacaaagtacccagtctccacatagataacagggaactgactgtagtagttatcagacaccagcgtgaaccagaacccatggcatacctccagtggcatcatttgtgaaaactcacagtcgcatcagggagaatagcttaaggcttaatgccagtcaaaatataaacaaacaaggtgcagccagagagcacctgaaaaagtctggcatgcagtgaaaaattatgtcaattagcatgaatccaaaagcgaaacattctaatcaacaattccaaagccttgtgcaactaaccctttcttcttcctttccttccttccgtcttgccatccatgtttcttttccttcctattttttcctttctctcttcccaaccacattgcacaagggatctaagggggtttacagggagaatattaaatgaaatagagagttaatggaagtcacaaaaagtaagtccccaagatcgagaaaatagaacatgattatcaggtcacaaggtcttaccacttggataaatttgactgtgaacttctcggcagccagaagtatgcaacccataaggatgaactaagccagttcctcttgagaattgaaccttttgttattatatcatttttattttatttaattccatggattgtatttactgacatagaaaatgcccatagcatactccacttatacaacatcacatacacgataacagctcacatgtattggtgcttactgtgtccaaggcaacgtgctaagcactttagacacattttctcatttagtcatcacaaaaactttatgaagtatgtgccatcattattcccatctgatgtgttttggaatgtgtccctgtccaaatctcatgtcaaattataatccccaatgttgaaggaggagcttggtgggaggtgattggaccatgggggtggatttccccctagatgttcttgtgatagtgagtgagttctcatgaggtctggttgtttaaaagtgtgtagcacctcctgctttgccctcttcctccttctcaggccatgtaagacatgcctgctacccctttgtcttctactatgattgtaagtttcctgaggtctccccagccatgcttcctgtacagcctgtagaactgtgagtcaattaaacctcttttctttataaattacccagtctcaggtagttctttatagcagtgcaagaatggactaatataccatcttagagatgtggaaattaaagttcataaagtaagatgcaacctgcccaaagttagaaagcggtaaatggccacagcatagtcgaacccaggtccgtcatacttcaaagtgtacacaggctcttaaccttgcttaatagacagatgtctggaaggatgttcacaaaattttagaagcagatacctctggctggtaagaaattaagtgatgttactgttattaccataagatagttcaaaatatgcaaaaacacagagaataataaaccatatgctatgtacccaccattgaaacattacaaatttcgacattttgccctatttcttcagatttttttaaacacagcaacaattaagagtctgttgtcctcctggttacatagtgggccccaataaaagtcagagtcaatgccctcagcagcatttctgcaaatgtatttgttacaaggctgttagatgctgaagctccttgggaaagtaaagcttcccattttgaattcagcccaaacaagtctgtagagagtgaggtagagcaggatgatggacagatgaagaggccaaaggctgagatgatgcagctttctgaaattttgaactgatcctaggataaaactagctggaaaatgataatgaataaactacatgttctttgaataattatccatgacaatcacacatttttgggtttagatgtgagttagacaatagagagttcagggatatattctctggcacagatactcggaatccatattctctacaaatcaaatgaacagatggtaaggatgtatcattttggctttcatctaactagagggccatcttatctttgccaagaagaagctaacagattttctgcaagcaaaataaggcctttcttagaaaataattctaggtcctcaggaacaaatgatgattagatccccaagttcttacaccaaaaagaggatgactttgattattttcactgggaattttcaaaacaaatgttcaaaaatatcactgaattctgttctttaaaataatataagcacggtaatttcttacctgctactaatctgaatttcaaccaaattgtataaaaacaattgcatcaattgttaattgaactaggtcctgtatataaatcttaagaactgtcagagaagtgtcaaaaacattagcaacatgtagtgtgctaggtgctagaagtagaagaaaggatacaaatattaggatgatgccagttgctatacaaattagccctcaaatgtccatgttttaacccaataaaagtctgtcttacatcagatatattttcagaaaaggaaagttctctggtctccagcagtgatgaaattgtgctgggcaggcactctgaggacctgccactgccaccaacttccctgcttccccaaccctggattaggccaaattattgtccattattcttgaagccctcctgggctccatcctctgggaggctcttccttgtgtgtgttcagccatggcctcccctgaattatgtgccggataatgtgctccttacagctgtgcagcaattatttttttttttttttttttgagacggagtcttgctctgtcaccaggctggagtgcagcggcacgatcttggctcattgcaacttccacctcccgggttcaagtgaatctcctgtgtcagtctcccaagtagctgggagtacaggcgtgtgccaccacgcccagctaattttttgtaattttagtagagacagggtttcactgtgttagccaggatggtctcgatctcctgacctcgtgatccaccctccttggcctcccaaagtgctggaattacaggtgtgagccaccgcgcctggctacagctgtgcagctttaaggcccatttcctgcaggttcaaattacactaagggttttttacactcataagccttttgtggactagatctgtgctttcttttccaatacaattccctcaaaacccaaggtggcttctgatcaatttgcttctggtaagtttcatgtgctggtaaatgcaccctaagctcttccctagacatcaatcttagacttactcaatcatttgcctccaggcgcccatgcctctctctctcaaggtaatggcagctactttggggccagtggacacaaaaggcttgggtgggaagtaaagacccttaatttaaatgttacccgtgaggctaagtcagtttgctaaacagaaatcttactgccccattgttggtcaaagcggtttgcagtgttatttcttactctctagtgtaaggctctaaatatctagacttttttctattcttttcattgattattgggaactggtcaattctttcctgaactcatctgctccatgacatgaggagcaaaaagcaactgacacacacgaccattctgtctcttttgaagaactttccttaaagctacttaggcatttagtctgccttccaggttatgtgaggtgacagttttacaaaatattttattgcatactatattagtctgtcttgcactgctataaagaaatacctgagactgagtaattcataaagaaaaaaaaggtttagttggctcacagttctgcaggctgtacaagacgcatagcagcttctgcttctggggagacctcaggaagcttagatggcagacagcaaagggaaagtaggcttgtcttacatggcaggagcaggactgagagagagtgaaggtgctacgcactttcaaacaaccagatctcatgagaactcacatattatcaggagaacagcaccaagagggtggtgctaaaccgttcatagagctctgcttccatgatcccatcaactcccaccatgacctcattttggacactgggaattacaactcaacatgagatttgagcagggacacatatccaaaccatatcacataccattcttcctctgtctttcaagtccctaatattcattcctgcaccacctgccaccttaccacaaagccaatgctacatgtgttaggtttctgttatagcagcaccctgccttaagataccaatgtatgtattcgttagggttgtattcgctgctataacaaaaaatcagaggcttaatacaaataactttctttcccacataatagtaaaatgatttctagttggaaatcgtaagcaatatataaataggctgataaaaaaggtgtttgtactaatgtccaaaaataatagagtaaaagacattgtggttctatgctataactataaggctttgaaggaaggataagatgttaacctgtgaatggggggcaagagaggacatggaagaatatttattatggaagagggagaaggagagggaagatgtgtgttccaaaagagaacatgatgttaaacaaagatgctagcagagtgactatttcatagatttcatcctgtctctatctcatgaatagaaaagaccactggagaagactcagtaaaaagtcttacctggagaaattctcactctgaaatatgtaacatcaaatggtctgaagtcatttatgaatattgaatgctgtaaagtcagtagtctgaggcacatgcagagtggtgtcaaaaattgttggaagaattttatcagcagcaaaatgagagtaattcaattatggactcctagggcagcaccaaatgttaattgacgtgaaacattggtggccgggggagccctagttcaccactttctatatgtggaaaagtgtacaattgtaaggactttcacataacctcctcaagcccagagaaaaatctctgtagacttgagagggccttaatgatcatgttaggtagtgctcaaagccctttcttacatatcgaaatgcttgcccacattgccattctcagccttatgaactggaaatagctggtgctattagtcccattatatacatgagaaaacagagattaagaagtcccaggccaggcgcggtggctcacgcctgtaatcccagcacttcgggaggccgaggcgggtggatcatgatgtcaagagatcgagaccatcctgaccaacatggtgaaaccccatctctactaaaaatacaaaaattagctggacatgggggtgcacgcctgtagtcccagctactcagggggctgagacaggagaatcgcttgaacccgggaggcagaggttgcagtgagctgagatcgtgccactgcactccagcctggtgacagagcgaaactccatctcaaaaaaaaagaagtcccaatgatgaataaggtcccagtgctcacaagagacatgatcttctctagaacccagctaaccagaccccgtttccccacttagtttgctctttgttgtctttgcaagtgggcaagagaagcaagctcactcctgttcatttgccttataaacttttgaaattttttaaaaatgtttacgcaaaattaagtcttttgaggatttgtgttttctttggagtcactaaaagcaatgactttatagcgtttcgtagggggtcataaaaccctaatttttataatcaaagagaactacaaggtccaacgttaaggctagtgtttttacagcacacagtatcatacacccataaaaattccatctcattctttaagtaaatatgaacataacctcttgtctgtccattttaggatccttcttttctgtagaaacatggagcccagactgaaattagatactgaagctcaaataaattatttaaaaatgtgtgcctttattacccttgaactttctgccaataaagaacaatactaacaagcatatggatgtaaacactcctaaaaattttactatcagaagttgttcatgcctttattaaggaaaataacacagtttggaagcactaaattttttagggatgtcagaacaaataaagaaagttgacctagctagcctagggcactgctcttgaaattacatttactgtaactccttccctttggctaatttagtttttatctactctggatgataaactcacagcctgggttgtgcaatacaagcatgcttgacagaaggcaggcaattgcaagaataatgatgagccatttgaacactctggcttcttcccttccagaagaacttttacctattatagcactggctctctattgggattcttagcaagtgtattagcacttaactttccactttaatgaacgactgacatgtataattctatggagagcataggccaatattttattagtttctgatagtattacaatggtttgagtctattgaactgatatagaagatctatgggaagagaagagagagggctacatatattgggaagttgcccattaatttggtctgtatatgagtcagaattcattttttcttctatatttctatgtatccagagaagcctgttcatgattgagagacacatcaaaaacctcatgacctcattagcttttgtaatgtcgcctctggttttgggttgagctatggctcctcggcccctgagaaagtatttgagcacgttttcattatttggttcagaaagtagcagtatttgacaaaatgtttctgaaaagaggaaacaagatgcccaactaccagagcctcagattcctctccctcccagtaccttcaaaccagcttgaagttttaaactcaggccacctccacactgagaggtctggccagcccgtatgcaaggacatggttcctaggagtgtggtggaggcgtgtggtgaagatcctgctgaagaagacagaaggttctcaagatgtccaggactcttctgttatcaatgtacttctcttctacttaaagccacatggggtccctaagaatttaacatgatgatatctaattgacattctctcttacccctgcctaccactaaacccaccacatggtgagaaagttccaaacagcaatcgtttctgaagcctgatttggataaaaccagatggtcaccaaaaccattccattaggccatttactgatgtggaatgcaattaaaattgattccactttaatcaaaataactttgaggagaacaaatatgtgctgagtatctacaatataaaagaaatttggatagataatgatgagttggtggaacagtaggtgactcatacagggatgaataaaatgtatcttttacaactcaaggagtttatattctgggaggggagaaaagatgtgtccagtcactaggcattttgtcagataatagaaacctgttccacctacttctcctctagaagacagtttgacaagtctccttatcaacatgtaaataataaaaagggtatccagcaaaagagaatattagcagtttggggtggtgataaggacacagcacgtaacgagatttccccttgaggacaatgtcagtgtaaacagagaccccacggattacaaactgttgaattcagaggttattattaagacataaatttaaaagggtctttattgataggctaccttactatattagggctctctagcaggacagaactaataggatagatgcatatataaaggggagtgtattaaggaatattgactcacacgatcacaagctgagatcccacagtagaccgtctacaagctgaggaccaaggaagccagtcagattcctaaaacctcaaaagtagggaagccaacagtacagccttcagtctgtggtcgaaggtccaagagtaccaaagctgacgaatttggagtccaatgtttgagggcaggaagcatcccagcatgggagaaagatgaaggccagaagatgcagccagtccagtccttccacgttcccctacctgcttttatcctagctgcactggcagctgattagatggtgcccacccagattgagggtgggtctgcctttcccagtctactgactcaaatggtaatctcctctggcaacaccctcacagacacacccaggaacaatactttgcatccttcaattcaaccaagttgacagtcagtattaaccatcacacttacttaatagctctgtgttctctagcaagttaatgaaatctctgttgacttaatttctaaaattggagtaagtccatcttttctaatgcagtttgtgtatgttaaatggaaatacaaaaaaaaatctagcatagtctatgacccaataaaacggtagttttcttccttcattcccaattcccttctctttcttaaaagcaaaaaataaaatagcagatgtcaggatcagtaccaacaggctctttgggactatggtttctttccattgatttgtagttcaacccattaagcatattctcagcacctagtatattcccagcatgcagcatggctgttgcctccatgagcccagtccagtagaagaaagaccatcagtcatacagatatgaaccaagtgcccattgaagtataagcttgtgctgtgggagcacagaaaagtaggggaatgaataatcctgaggaggaaagagtggatcagagcagtctcacaaaggcatttgagctgttccttcaaggtttccatggtggaggggggaggatcacattagcttatttattttttactacagagattcaacatttgcccttcataaaaattatacagaaaatatgttaagaaaataagttctaagccatcaagcccatctgatctgaaacagaaaaagactcataatgaatatgtcaacacttccacatttttcatttgttttctaaagcaatttcatctgcaaatgaattatgcactccagggctagacagtacctccattcctacactccagaaaaatgtgtttacttcgttttacatttcatgcagctcagtgggaaggcagttgcaatgcaatttctgatccagtttagggtttgagatgtcagtcctctctttctttctccagaatacggctaaagcttgtaagaccaaggttgggagttcacttttttttcctccaagtgcattaaatacataaatcacctctcaagaaagaacataaggttcctggatttctattttgtctggcatgaaaactaaagtccaatctgcaaagcatcatactgttatatccatctgcagtgcactaaaatcactctcaaagattgtaactcttggagcaaatttttagcacaatgggcagagcgggttgtttcttgcccaggtaactgaagcaggttcttatctcacctaaattcatcttctgtctgaaaagtaagtgtatctcaacatgcggtttgaggttctgaagggttccacgctgcccttccactcaggcagggagaagtcagtcctgggattgagtctgaagattttgatggacatggtcctggagcgagttcggagctagtgttaaaatgccctctagtggtcattagctgtaaccagtgagcgtagggaagggaaaatcttgtgaaactggcttgggtgtggttttctataaacaccgaccaaaaccagagtcctaggttatagcgcgggttacttgcatctgtcgcggataccgcgatggcggtaggacttggtattacttatagaaatggaagcttgccgttgcattcaaagggtacaatccagggatttttcttacgctttcacatctcactgctctgtccctgagccctgggcacacacgagagtttcaagaagtgttgactgagtgactgaatacgtgaaggaatccagtttatgaatcatggattctgtgcacattcaatgagcttggctatttgaaagtgcacaaattcttcctgctttctgaagtattaaatatatttgatttgcatcctttccccagtggtcgcttggtgagctaataattgcctttcctcttatatctttgagctgaggaaatataatcaaaatgttaaggagaggggcaacaaaccccccctttgtgggtagaagagaaggtctgggctggcagctcaagagaaaagatgaagaaaggacatccaaaaagaagtggaagtcagagaatgaataaaacacatgagcgaatggctgccatcctatccgagcatccttcctgatattgtcacccagggccaccagcagaggttacatggtgagaacagacagtagaaatcagcccactccaccgatctgactcctggtctcctggggaaatggcattaggatctaggttaccaacatcatagcttctgccagggcttgtgtgcttaaccccaacagtggaacaccacaaatgcacaggggcagtagcctccaacatcctgaccatctctgagaacctgtcctgctagcagaggggacagaggctgtacaaatcagaaagttgacgtattagtccattttcacgctgctgataaagacgtacctgagactgcgtaatttacaaaagaaaagggtttaatggaaaagtcacggttccacatggctggggaagtctcacaatcatggtggaaggcaaggaggagcaagtcacatcttacgtggatggaggcaggcaagagagagagcgcttgtggaggggaatgcctctttttaaacccgtcagatctcgtgagacttattcactatcacaagaacagcatgagaaagactggcccccatgattcgattacttcccaccaggtctctcccacaacacttgggaattcaaaatgagatttgggtagagacacagccaaaccatatcaatggataaaaggaaatgtaatgtcaactaaagacaaaaaaaaaagaaaaaagaaaaaaaaaacttttgaagaattaaagttggttttatttagaagtcttattggggactgtagactgaggcctacaacccacaagcagtcttttacagaggttttatgagactgcgccagcacagtattttagcccactgtgtatatataggtgctaggggtttagcatgtgcaaagttatatgaaacttgtttagacattatattaaagtagaactacgttaaggtttgggtgtaagggtatatctggttctagattatagaagtgtcatcactaatctccccagatgttattttatgcgtaggagaaggtaaggactaggttcatttgtcttttaaggaatatagtgacttaggtaggagagatgggggccaggtgttctgttttattttgtcgttttggagagctgtatgtcatcacagagttggggctttgtgaaattatgttggcacagagacaagcaaacttagctgcttatgtatgtgattttgtctcacaagttctctctttaggtcacaaattaactctggccatatttataaaaacaatattgattgtgttatgtagctgagaaggctgttttttaggaaggttggtaatctttagttgtagttgtaaggaatgagtattgagcccagtgtgtatatttatttattcattggaaaatatgttttggattatatttatgttttaattactaggatttgttagggtttttgatgttgcctttttgggggttttgtgtgtgtgtgttttgggtttttttttttttcaatacagggtttcactctgtcccccaggctggagtgtagtggcatgatctcagctcactgcagcctccgcctcctgggctcaagcgatcctcctgcctcagcctcccgagtagctgggaccacaggcatgagccaccacacccggctaatttttgtattttttgtagagatggggtttcaccatgttgcctaggctggtctcaaactcctgagctcaggcaatctgcccacctcagcttcccaaagtgcaggggttacaggcatgagccaccatgccaggctgttgcctttttttttaatctaatataacattttaataggacattataaggatattatagattacatatagtagtctatatttaatagtaatatgatttatagattttgaaaaaataaaaccaataaaatcagaatatgcatttgtatttttttactaattgtaccttttgtatttatatttactagtattttttatgaaaagcaattttggactggagttgattgagaatacttttagagaagaatttggaataacaactgggttgtcttgtgcatttcctgtgggcatgatgccagccttgctcttctatggcaaaggatacaggttggcacatggaggagcttggcctctgcaagcccacagacctctgggctagctactcagcaactatgtgtcctctagacacagtaacttaatctctgtgcctcagtttcctcaactgtaacatggggcgaataagagtatgtgccgacagagttgtgtgcaattaaaaaaataatatgtgtaaagtacttatggtgggatcccacctgcagttcgcctccaggaaatgttagatgctgatgtggaggaggatgaaggggaggaccagatgtttttcctgctgctggcatattctgcgcgctgctcttccttctcccaaatcctttcagcagcattttctttcttcccgagattgccaagggaacccaggcagaatgccaggaactaaacctctctggaagattgacggaagaagagctgggatttgagcaagatagagcgggctcagggtcaccatgaggttcaaggtctgcagactcccccaagctttctctcgagtagatttgaacacacaatccaagtccaaatccaaatttaataggcttctgtactgagaattcagctcagccaattgtgttagagccttaatgcacatgggtacacacacacacacactcagtgcacacaatgagcactcgtacagggccgggtcacaaaagaagcgaatgtccatcatctcccttcacttcccctggtcttttctagtctccattcctcaccatttctactgaattctcccatccctctccaccttctacttctggaacgagctccaaacatagcattaaaaagcttcagtgtttccagggaacagagcattgctgctttccataaactggcagaactggtcgttaaatggaactttcaggcattcccccacattctgaagtcactctctatgtaatgatcttcctgatacacctttctgctctttcacctggaaaagaatttgaaggatgtggttatcagtcctctgatgatgccaatgtttcgactccatcctgaatattgttattgctgccaaaacctactggtaaagtaatatcaatagagccaccgtactaaaaaggatgtgtctgctacgttgttttctttaatatcaaggactttaactatattacagttaaaatcaatagaaatgtaaccttttcaaccacataaaatgagttcatttttattattattctttttctgctgttacagtgctgtgattgcaaaagcaaccgggtcaacttaagctttattgaaagaccattaaagaaacaaactcaaactcatttaaatactgaagctggtgcattaaaaagatcaataaagtaaaagcaactggggttgctttacttaaacaccccacatacgagaatcattccacaatcacaatttgagcaaacctataaaactaggagaccagccaataaagaagaaaacgctgtttcattactaggtttagacccataaagcccttaactttagtctgattagacatactgcatttaaattttctctcagtattttaaaacatcatccagcaaagacttattgatcaatgaatgtcatttacttaggaaagccattagctccctgagttaggggaatgactcagtggtagaaagtgcagtttcatttatttaaaaataaacacaagattaggctacagtgaagggaagttctagactcacagggagtcaggaaattttctttctatccttgctgagcgtggtatcttgaacatagttatttgtattcaattgaatgtttactaccaattctgtggccatggattagacacaaacctctttgtgtgtgcctcagtttccccagaggtagaacgcattaatatccttttctccctctttctctggataagaaaacaaaaatgattgacacaaacctcttcaagttcttccttaaaaactataatacaaactataaaccttagtggtaatatgtacttagaataattttagaatcagattggtccttattggccatgagtccaacccttgaccagtctctgcttatattactagttatggaaaacatgctatttttcttcttaaaataccatttattgtgtttttctaattatacatttaaatatatttattatagaaagtacagaagagaacacagaggaaaatcaggtttgcttgtgagtcccatttaaaatcagccctcgacccttctccaccaaacccgtcttgcttactccagggcattgctgagcagttctctgtcttcgttctctactgactcattcccatcagcaaataagcatgcagatatttctcttactttaaaacaaaaatttctcctgagaccactttccccacatctttgtttttctttgcaataaaacgcccggcaatagttatctatgcttgctgtttcgggtcagcttctcccattctctctctctctctctctctctctctctctatttatttatttatttatttatttatttatttatttatttttttggagatagagtcccactctgtcgcccaggctggagtgtagttgtgcaatctcagctcactgctacctccacctcccaggttcaagcgattctcctgcctcagcctccccagtagctggaattacaggtgtgtgccaccacgcctggctaatttttgtatttttagtagagatgaagtttcatcatgctggccaggctggtctcggacccctgacctcaagcaatctgcccacctcagcctcccaaagtgctgggattacaggtgtgaaccaccatgctcagcctctttcttcagtcaactttactgaaatgtaaattgcatgcaatgaaatttacacactttaaatgtacagactgatgagttttgacagacgtgcacacccatgtagccaccaccacactcaaaatttggaatatttctaatatcccagaaggttcccctgggcccctttcccacccaccattgcccccaagcatttactgatcaaatttctatttctataaagtcacagattagttttacctgttctataatttttttttttttgagacagagtcccgccctgtcatctaggctggagtgcaatggcacagtctcagttcactgcaacctccacctcccagattcaaatgattctcctgcctcagcctcccaagtagctgggactacaggcacatggcactacacccggctaatttttgtatttttagtagagatgaggtttcactatgttgaccaggctggtcttgaactcctgacctcatgatctgcctgcctcggccttccaaagtgctgggattacaggcgtgagctaccacgcccggcctacttgttctataattttaaacaaatgtccagctcctttcattctgcataatgattctgaggttccttcttcttgtcgtgtgtatctgtggttgtttttttaattgctgggtggtaatacacttatgaatatacccccatgcatttattcattcacctcttgatggatatgtggatcattttggggatattatgactacacctgttaggaacatttgcatacacatgtatagagcagacttttttttatttctttcaagtaaatatctaggaatgaaatcaatgagtttatggtaagtgtatctttaactgttttttgatgtaatattccctctaggaagacagcagaattccagtgactccacgtagtcactagcacttgatattgtcagtctttttaattatagccattcaactggtgtgtggtagtatctcattttgggtttaattttcatttccctgatgactgatgatgtttagcgacttttcaagtgcttattgaccactggtaaatcttctttcgtgaagtgtctgttcaagcctttggcccctttttaaaattggattgtttgccttattattatgttataaggattctttacgtattctggatacaactcctttgccagatgcatgtactgtgaatattttatcctcattttttcttattcccaatcccagctgggctgctgtccaccactgcttaaagctactcttatggatactatcaatgaccttctcaccaccaaacccactggctacttcacagttctcctgctgctccacttaaaggcagcatctgaaaccagggagcccttggcttttagggaacactgctcctgtcctccttctccctcatgggccccttttgctctgtctccttcactgtttctctccttcctgacctccttcagtgggcgtgcttccagtgctttaccatttgtattcactcctgtgatgatctcatccaatgtcgtgctcttaaattttatctctgtgcctcaaactccaaattattatctcaacccaaacctcgccatgaactgccgactcacacaccaaactgactcccagatatctaactgattcttgatgtctgataaacactccgaacacaatatctccaaatctgacctcctgatctgccccttcccacaacctgccctgcttatagcctttccaatttcagctgatggcaactccatccttccagctggtcaggattaaaaccttggaatatcactagaacatcactcactggttctcacagctcacatccggtttttcagaacctcatgctggttctaccctgaaaacatccaaattctgaccagcctcccaccttgcacatctgctgctcgggctccagactccatcctgttctgcagaggcctcctgacgggtctccaagcttcctcccttgcccttgcaggagcgtctctgacatcactaccccatctgtttaaagtacgagttctctgctcaacacccactgacagtcctcgtttctctgaggacaagccaaagtctttccagtgacctgcaggactccacaggaactagccccgtgaccctccccttttcatgctacttgagcctcactggcttcatgccgggaattctcccgccttggctgctctctctgcctgagtgttctttccctgggtttctgcagggctaacccctcgaatccctcaagtcttcattgaatctccttttctcagtgaggctaccctgaccgccttatttagggttgcagtctgacttttacaccaggcctcttattgggctctaatttgagggaaaagacttcgaatttatcccctcctaccatattacatcatttactttttctctgtgtctctctatactaggaaggaagcgatatgagggttaggatttggggctttttgttcactgatgtatcctaagtacctagaacagtcagttcaaggcaccttatgggcacttgacaaacgtttcttgaatgaataaacggacctgtgatgtgactacagattccttcccacacgatgcactcggaggcccctttcttcccacccagccagtgccaggcattctgcagcaacactgctccatcatcctcttttctctgcccctgcagattgacatcttcagctccctggccaccagattatggttgggttcagctagcagaacactgcaggaaaacacagggggaggcacgagagatcggggtctgtcctgtcctcacctctatcctgcttcttcccaaagtgctgggattacaggagtgaaccaccgtacccggcctcattttacttattatagccacaggttcaaatctattcatatttttgttttgctttgttttttctgctctgtttagagtcggagtctcactctgtcatgcagactggagtgcagtcacacaatcacagctcactgcaatcttgaactcctaggctcaagcaatcctcctgcctcagcctcccaaagtgctgagatgacaggtgtgcaccaccatgctcagcccatatttattttttaacccttgttctattattacctcactctctgcaaagacttctagaaccaactacttggagttaggccaaactttacagctccaagggcacagtcctccacaagactggtctcacgtcaaaccccagctgcaagcccaggggtctccaggtgaccctcatttacaagcagctggctacaaattcagaggttcccactactccctcaggtcaataatttgctagaatgatttgcagaactcgggaaagcactatacttatgatcaagttttactataaaggatacaatccagaccggccaaagggagagatgcaggtggcaagatttgtcccaaatgcaaagcttctttgtcctaaggacacactaccctccctgcacatcagtgtgtgacaatgcccagagtattacaaaccagggacatttactgagcttcggtgtccaaagttttttttagaggtttcattacacaggcttggttgattgaatcattggccacaaaggtgaactcaatctccagtccctctgccttatctggggtttgggctcaatgctcccaactctaattgcatgtttgatgaaaagaagggagaaggaaaacataaaaaccctcctccttacatgaatgcccttctctcctcagttctcatcactgctcttctagctagctttctcttggcccaaagtacacaaatggtggctccagcaggttccctattcctggacattttcaattctaagcagcagcctcaggcattggtgatcctattggatgatccagtcacatgttcttcctaaatgccaagggtatgattatgctacattgcttggaggagtgtgcagccttgcctcattctgcagaagttcccagccatgctgtagccccagttccatatacgtaccacagccaccaacacaggagcctgtagggcacagtcagaatccatcttctttacctcttgggttcagataaccaagcaaagttctcctccaggccattttcatgttctctctgtcttcaatacacattctcctatacatgcctcatagtcctgattaggttagcaggccctgtggttgagcagacttccaatttgggaattgaatgtcagtttcttcctacatttaggcccagaatcaccctactcttgcccaatgtctttgaactgtttcttcatccagatcttttcatcccttaatacattctttctctcaagaagaatatcagtttctcaaggagagagatcctggggtctctccagacacaccgacatgtgcttgagtcccaacgtagctacacatgaactaattcgtcagccccttagggtcttgatcaggtcaccttgagccacaattttcaccaacctttcctctctgatggaaatctgaagtcctccctgggatttccaagggttctttctgcttccaggtgctttcttctgtgggtgatctctctgatccagagaatatccacccagaatgaagctcagcacttcctttggttcacaaacacacaaccgcccaaagcattcactgagcagtagcctctattgactatttcagggtcggggagaggggtacacagcacattaacaaatcactgcaagtcatagagtagatattcatgccctcaatagttcctttacccatccttctatagaggcttctcatagcccttcacgccaggcagtgccagtctttctgctttcaccccaggcagtgccaggattttgatttctcctgattcatgctccctggctccccacctgcttcctcactcatctccaggtctcccccactattatatacaataacaagctgactcttcccaaaacagggtccaagcttgctggcccagagtagtcaggtgctcaacagatgcaaaaacttggatttgaccccctttaaaggagttgtggttacaaataacaacaacaatgagaatttgggggtgatcctatgccagaataacagagatagatagatacatagatagatagatagatagatagatagatagatagatagacagatgatagatagatagatagatattgattgatagatgaaaaactgtaaccccagttttgtatagatcaatccaaactttgcatcctagcattcaaagcccttcacaacgtatcttccatttaccttctattgtcttctaccattcttttccaaaacacatcctaaggaccagcatggctggtgtcgtctaccattttttttccaaaacacatcctaaagatcaatgaggctagtgacctcaacacccttagagaaatttggtttattattcctccttcaaaacgcctccactctgccaatctactgtaccatgatgacacttattctccatattacatattttagaattaggggtaacattttacatttaattttagtagattgtcttagaatattattccttcattgtttcatgtcatgttttccaaacaagaatctaaagcgccttgagcccagctgggaacatctgcacgtcatcagctggactccagtcccagtgctcaaggtggctggaccacaaaaccacatggaagcccttgcataatgttaggaggtgtcagcaagatgatttgagtcttacgccgaggcctctctcttcccacagggggtctgcaccacccccagcagccaagttaccctgtgacagtcattcatctgtgctctgggtggcccatgggatgagtgtactactgggcaggtgtaacttcaggggcacacacagcagacatccccagctgacatgacaacctactggcttctcaagatttgactaatcatatatagtcatcccacaatatcctcggggtatcggtttcaggacccccaagtacatcaaacctcatgcatactcaaatcttgtggtcagctctgaggaacctgcatctagcaagggccgactttgcatatacgcaggtcctgcatcccaagaatactgtatttttgatccgcatttggttgaaaaaaaaatccacttgtaagcagtgcagttcaagcccatgttgtttaagggtgaactacatttctgtgaggggatcatcttcaaataaagtccttgtttctgtaccagttacagcaaaggccctgctttgagaatttaacagtcagagtagccacccacttcaaaactgaccagtcccatccgtggcaagcagacgatgtgacatcaacggctcttaccgcaccaggctaatacagttatcctggtcgtagtttcattttactgaaggccttattaaagcgcccccacacaactcagccaggaattcaccaggaaccaaatttaaacaaatcaaaccccgaaaacgtgctcaacaattcaagattacagaagggaataaagacgaaaataagaaaagcctcaatcatatttgtcatatctccatcgtttctcataataattctcaaagttctttattcctttcatttatttaattaaaaacttaggccatgcacgttggctcatacctataatcccagcactttgggaggccgaggtgggcaaatcacgaggtcaggagatcgagaccatcctggctaacacggtgaaaccccgtctcaactaaaaatacaaaaaattagccaggcttggtggcgggcacctgtagtcccagctactcaggaggctgaggcaggagaatcgcttgaacccaggaggcggaagttgcagtgagtcaagatcgtgccactgcacttcagcctgggcaacagagcaagactccatctcaaaaaaaaaaaaaaaaaaaacttaaccataacattatacaatttaagcagcatcatatttgttaatatctattttcaaaagcgactcttcctaattttattgttttcttcctcccttttccacgcatttgtttgtttttcttcctcctagaaagtcatgttctaagttatcaaaatgtgtttttcctcgagctcttcagggaaaaaatgccatataaaattaattcatgattattttatgtaaattattatctaaagtactcactatgtgtaacggttaaagttgattgttactaaagtgattctaaatatgaaagtgtataaaaccatgaactattctcacactacatctcaaagaaatttgaaatttctagtaaatttcaaatttactagaagactagttcagatattgtttttaatgatttacaatcatcttctgaattttcatttgcaagtcaaagtcacaaaactaaaagtgctacatgttttctgaccagattctctgaaataattatatagtgcttgagccattgtgctataaatatctttgaaatcaatgctattaaagaaatgctatatcagctgtgaaatgagaatttctcctcctgtccgttgacatttacaaaaattatacgaacttattgatagaaaatccgtttgcttggtttctttttaaacatcttatgctttaaataatattcagtgtttttccagtaggtggagtattagtctagataaagtaaatcactgtgtgaaagctaattttttcttcctactattttgagaaatttttgatataaaacataaatcacctaatagtttcactaattcttttaattgcatcaatatggtatgatttcaattactctagaccttaagaggcagatatattttactgattacattaccataataacaatggcataatgacaatagcagtaagtacttattatacctctcattttaaaattgcttatcaagccattagagaaacctcctgacatctctgaaacagaaattacacaacaaagaaagatctgtctcttaaatcctttctctctcgagccttaagcatttctgggaaactgcgttccttgtgagttgaatattggttcaaggctgatgctaccacttccagtccaggaatctgagacgatcactacctctccctgggattctgcttccccttctaagtttgtgaaaagatggtgataaactacatctctgaggcccctccctacctgaaaatccccaaatgaacctgaaattgacaatcttatggctgaatgtcgggagccaagtctgccgagatgttttagtacatacggcaaagatggcacttgttatacggtctggatctcaaaatggaaagtgagagaatgatgcctttccagggcaggtggacgcttcctcccaccctccatccatcaccaaaaccggtcgaagttgaatagtgccctgaaaagacaccttcaagtggtaccctagagttgtatcttcacagatgattctgctcaaagcccccagagacatgggaaaatactattccttagggccatggtagcagaacatcttcaaagaaacctcacagaactggttcaacctcctcactttacaaatgaggaaactgaagtccaagaaggcttcctaacttgataaacatccatttaacacgtggcagagccagggcccatctcctggccccattctcatccccccaggccacctctcctctcttacactggaagtctagaagctggtttgcaaggggtccctgaatgaccttccatagaggacagtgccttaccgagaagaggaaacacatactgaaaccagccacttttctctttttgccttctcacagtcaggtgattcgggtttggagagagccccagctcccatgcgcaggggattttctgtcctagaaaggcttaggcacagtggattcacctggatctcttctagttttgcagccagtttttctttcttgctcttggaccggagagcccccagacccaggcgtaggcttaggtaaagggggctcaggagacaaatctgtctgctttggccctaggctaggccacctctggccttgccaacaattaattaatacattagttaattaattaattaagtcaaagtcctccaacgtggttgagcccagctggggactggtaataaagtgagtggtttagagaataattcccagaagaagcacaaattgattattgtatttggtgaaaggacagcagaagagcattctgggcaaaagatacagctggtctaaagccctgagcacacctgggagtgcacagtgcctccccaggtgtgagagtcaggtcacagcacaggggcaaggtctaggcgagggcactgcattctcgcctctccattctacgaagatgccccctacccctctgatctccccagggccatttaatctctcccaaagaggcaaaggctccctgacttatccatctgcagttacctgcaggattcggttaactttcccttcgtaaaggcatccgccgtgaaacacaccaggcacctccaggaccggcatgcatcgctaacccagtgacaaaagcatggctgttgctcgtttattccagagttctgttaggggagagtgtttcttggcctctttcttcttcttgagtatctctataagtcggcaggatttatgagtagctcaaccaaaaacaaattaaggtagacaacgtgacctctaaatgggtcagcctcccaaatggtgtcctctcatctgcacccatggctgttcttgggattggagggatggccgcagggcttggcaatgtaggttgggagggggctggcctgctgaccctcaccctgatgggcttgtggctctcagcaatgtggtcccaaaaacaagttgcactgaaatcaagactctcagagcagagcaggggcaagtgtctcttgcatgaaaattcggagtcccagattcacgatcagccagtctccccatcgatgtggtctgggaggatggagccaagctcactcactcaaactcgatgtcaataaaatgctatgagggcttcagtccactgagtcattcacagagattcctccctctacaaacagaagttctaatggaagtaaaagctaggaatccacaccttaaacacacacacacacacacacacacagacagatttacatacagatacatacacgaacatggctcagccagtgctgacccatttaacacatgttaaatgagcaccttgcatatcacaggcccttttcatgtggatcgtaaattaactggaaggtttattagataacactacagagaaagaaatagccgaaagtccagaggtgaggtgttagccacggagctctgacaaccaggtggatttccactgcacctgctgagcccactgatcagtgtttaacaagcgtgtgttatgccacgctcctggggcaggagtggtaactgaggcagcgtccttgaacccacagggttacggtctcaccaagggaggatcaggaacagagctgcaaccctggactagcaggagagtcacacctaatcctacttctttatctcccacacatctacatttgctccatgtcctctccattatcaggaacaaagtgattctagggttaggaaggggcagaaaacatttagatgaacgtatccttgatactggggtcaaggcctgcttgttcgtattttcaattgcaaatggccctaggcttgtgtatacccttcatagaatggagattccgatggggagaaagagatggtctccactcttcaaaccctctcttctttgaagtctgtgggaatttctagtttagaaggacgggtagacacagataaggggtgcgagttgagctgataattgtttctcctacctgaagtctatctgcatcagcctcttcttatcttcagccttgggcttcaacttggagtaaataaaacattcatcagatgatatgctctaggctgggcgtggtggcctacaatcccagcatgttgggaggttgaggtgggaggatcacttgagcccaggaatttgagacaagcctggacaacatagtgagaccccatctctcctaaaaataattttaaaaattagccaggcagccaggcacggtggctcacacctgtaatcccagcactttgggaggctgaggcaggcagatcacgaggtcaggagttcaagaccagcctggccaacatggtgaaaccccatctctactaaaaatacaaaaattagctgggcatggtggcatgtgcctgtaatcccagctacttgggagactgcagcagaactgcttgaaccagaacttgggaggcagaggttgcagtgagccaagatcacaccactgcacttcagcttgggcaacaaaagcaaaactccgtcttaaaaaaaaaaaaaaaaaaaaaaaaaaaaaagccaggcatggtggtatgcacctgtggtcccagctactcggtaggctaaggtggaaggatcacttgagcctgagaagtggagtctgcagtgagctgtgactgcgccactgcactctagcctggatgacagaataagaccctgcctcaaaaaaaaaaaaaagaaactccttagtcatacacctaaagccaatctctccataatcactttattgggaataaaatgatattttgaagaaaaaagatgatatattctaaattcaatatcgctgagctaattccaagtattccctaaaattaacgattaggaaaaacagcaagaaatcctaggcctttgtctaggccatggaaaaagcgggatctgccttgaaattgtgtccttcatctcaggagatggggcccggcccctccaccggtccaggagaacccacgccatttaggtatttcttctttagcttctccactgcatccccaaagcgtaaacggctgatgaaatcccttcaaactctgccaacgcaaactgtggcttaaaaatggaaatgaatggatattgcaaaataatacctgaatagacgttaaagctttaagctccacgtgtaagacacaaggtcctgcctaaatcagtatgcttctaatggcttcatggcaaatgttgaacaagttagtgttcactcaaggttgtcctggggtacatggagtcacagtctttaattttaatgagcctctattacacaatctcttatcgcctcttaactgccagtgaaatgaccaccagctaaatgtacagcaaaatacatttctacaaaagagctcacttggaccccaaagaaattaccttgaaattattacacttaaccgtggcaaatgcaccagggttcatttgaaaagaggtggccacctggcaatacgagtgaaatcatataatatgtcatttccttaggcttttcatgttaagcttttctcgctatatctgatttaaagtattttctcttttaaatgtaaatatttaaaatgtagctgatcctctccctctcctaattgaggtgactgggctagttcaagagactgtggcctgcagctcaccgttttgtctctggagtcagagtgccagccttggtacttactctgtgactggacactttataatatcaaagatacgagatcatacctatctaatatctattcaataagacaatacatattaaaagatcagcacaaagccttgtacacagcagttgctcaatatgtgcttcctcctttttcctactattgaatcccaccagccaagaccagaactatatctgcagttggacaaagttgggtttatcccttgttgcagtgagggcttagcagtttgagtcaaacgggagctggaaaccacagtcggttaaaatggggtgataaatagaagcattaactatggcaaacagcaactccaagatgtaaggaaatccgtgcagtttcctagtggccccctagggctgagggagcccatccagggacaacctcggtgggtgtctgaccgtaatggaggcaaagctgcccctgtctcctctgacagtctccagctgggcctgagagttaagttgacgtaggagagactaacagaggaaacgcaagccaatgtttacaggcatgtgagggccttcacaggacaccaagatccaaaagcagccaggcctaagtgcttatgcaacagggtgaacaaaaagtagtaattttgaaaaagtaactaactatatggagatactaaagacaagggttattttaacaagagctttttaactgtcaaaacactttttgtttgtaccgatttccctcggcctcaactccccgcctctggagagaagaatgttcttttcttcctggtagagagaagccatcttccatatgaaagtttcatctcctgctttcaggaagaaaaggggaggtcagagtgtcctttgtgcatctgttgtttttctttttttctttgagatggagtctcactctcacccaggctggagtgcagtggcaccatctcggctcactgcaacctctgcctcccgggttcaagcgagtctcctgcttcagcctctcaagtagctgggaccacaggcgtgcaccaccatgcccggctaatttttgtcttttagtagagatggggtttcaccatgttggccaggctggtctcgaactcctgaccacaggtgatccgcccactttgccccccaaagtgctgggattataggcgtgagccaccacgcccaacgcatctgttgtttttcaagtgcctttagctcaaaattgtccccatctcaagccagcatatctggaggtggcgtgttctgaagcccttcaggaccttgctggagaaggtgtgtctgcctggcagagagcagagacccctgcttagccaagctggagctggtccggaattgctgggggagcgacaggctggctgccctctggagtgcaggtgggggagcaggcaatagcaatggcggtgggggtgagagtgaggggctaccagggcggttcagacacacgtccagaggtctgtgggcaggttgccatggctgagacgctagggtcacagagggttctcttaaaaggcctgcgactcagacaggcttcacctcatgtcctcgcactctgggcagagcctctgctatccccctcctcgagcctgtgctggaaattgcagtaagccccttcctcttgcagtgtccctccagagcacgctactgagaaagcttgacattgtgctcaccttaaaagcaaaatctttaaggaattccattgtttatcatagagcttatattgaagggtgcattgggagccaggaagcaacgagttgattgataattgacgcaaagggacccatataccttagagaatgacggggtggctctaagagtcaggaagggcttattttaggaatcaggcttatggtggggagggttcaaggaagcaggtgtctctaatcaactgggtgctctcagaaaagcagggctaattcagttattgggcctcttaatgcatttcatctgggaggcaggaagaatggagaacactaacgttgttattgaagaaattgccgggagaaagagatgttttggttttgggttgtacaaggtctgttattttttaatttcttgtattagtttcccagtgttgctgtaacaaattgccacaaacttaaggacttaaaacaacatgcatttactatctcacagttccagaggccagaagtgcaaagtcagcgcaaacggctgaagtcaatcagaaaggctggtgccttccgcaggctctgagaggagaatctgtttccttgcctttctcagcttctaagagtctcctgcgttccttgggcccttcctcacgtcactctaacttctgcttccgttgtcacatcttctctccactgcgaccctcttgcctccctcctataaagaccctggtggggacctgagacccacccagggaatccaggagaattcccctattatcttaatcacatctgtaaagcccctcttgccaaggaaggtgacgcgctctcaggtcctgagaattaggatgttatctttgggaggcatgattccgcccaccatatctccatattcagacaaaattgcagaatggtctcgtgtcacatggtcaggtcctggagagccctgatccgatgctgctgttctgaattatgttcggcagggggacagcaccacctggtggtaacactcggcaaagcatccgccgtcagctgcagagctgcttttcctttggggtcctcttgctttaacccaccttccccacaatcccactcatcccttccggccacagcccgccttcttagacacaaggcaggcaggagtatgcgagagagaagacgtaaggacgccttgctcgtggtaagatcagagactgatcggagaacgctttcctccttccctcctttgagaatttcctcaggcactgcagcttcacctttgtgaatgttgaaggctttctggatatcctcgtcacttctcatattttcctaactgagcaggtaatttggattagaactgtacagcatgacccatttaggttcctgttcactgttttgaaattaatgacttcatcaatgagttaaggctaggagtgttcattatgttttttagaaaagtcaaaaccgagcaggatcaccgagaagcaagatgacacaatcaacaatcaaaaacctctgagtagaggctattactgtgtttcaaaacaaaatatataaaagtggccgggtgcggtggctcacgcctgtaatcccagcactttgggaggccgaggtgggcggaacacaaggtcaagagttcgagaccatcctggccaacatagtgaaaccccgtctctactaaaaatacaaaaattagccgggcgtggtggcgggcgcctggagtcccagctactagggaggctgaggcaggagaatggcgtgaacccgggaggcggagcttgcagtgaaccgagatggtgcctctgcactccagcctgggcgacagagcgagactcagtcccaaaaaaaaaaaaaagaaagaaagaaaagtttatataaataaatgtaaaatttagcatttttggttaaagccatcaaccacgcagacataggaagggaatacacttatagagatcaactaggaattttattttactgtagctcagcaaaaataatataaaatggctgccaaaaagccaaggccgtctagtctggatctgcagaaacaattcaggaaaaggaaggtacctccactgtgtgggtcatgccaaacctgaggacggatttcccttcggtgctcgcgactttaaaagttgcattaacaactgttaatgtcaattatcaagatcccaccatgtattgtattgggctgtattgggcctgaggacacagaaatgtaaaaacctaaacatggaaatttaatctttaaaactgtgtactatgtatccatagaacgaaatactagtcatccatgacaaatgatttttgttgtatatttattgagacagaagacattcataatatatcgtcaagttaaaaaatatacaaaacataatatgtgttagttgggttccatccctttttacttaaaaagttgaaagaatatacattaaaagttaacattgactatcagctggcagtttttttctgcaaatctatatcattttttctataacgaacgtatattacttgtatccatttttaaagctaagaaaatagaattttgttgtatttttatcgacacagagcgacattcataatatatcatcaagttaaaaaatatacaaaacaatgtgttacttgggttccatcccttttttatttaaaaagttgaaagaaaatacattagaaattaacatttattattagcaggcaactttttttccggcaaatctgtgtttttctataatgaacatatattatttgtatccatttttaaaattctttaagaaaatagaactttgttacaaatttagttttttgttttgttttttttgttctgagatggaatcttgctgtcaccaggctggagtgcagtggcgcgatctcggctcactggaacctccacctcccaggttcaagccattcccatgctacaatctcctgagtagctgggactataggggagtgccaccacacccagctactttttgtatttttagtagagacagggtttcatcatgttggccaggatggtctcgatctcttgatctcatgatccacccacctcggcctcccaaagtgttgggattacaggcgtaagccactgccctgatcacaaatttagtttttaaattgtaagaagtatgaggtggagattatcacctcctaaggcattgccaggtaggctattggttaacaatggcattttgcatttaaccatttaacaaaagagagtaagtaaacagaagtgcggtggcagttacccatgggtgtcattagatggcagcaaagcagctagctaatatttaagagcagaaactgaagagcttttgctccaaagaaacatatatatgagattttaaatatttaagattatctgaacggaataagtgtttttgtttgtttgtttgcttccagacagggtctcactctgtcacctaggctggagcacagtggcatgaccacagctcactgcaggcttgacctcctggcctcaagctatcctcccacctcagcctctcgagtagctgtgactaccggtgcacaccaccacacccagctactttttaaaatttttatagagataatggtctcactatattgcccaggctggtcttgtactcctggactcgagagatccacaagcttcagcctcccaaaatgctgggattacaggcatgagccaccacacctggtttgttttgttaatgatgcatttgacgttatagaaaacttttcaaaatgatagccaagcatgcaaatgtttactttaatagtttttgggggtggggtgcttttggatttttgtggcaatactactcatgcacaaaaacctactgtaccagttctgtgggtcaaaaatctaaaatgttcttgagatgtgaggaccctttgactcttaaccgtgactgtgcaatgatctctaagtttctaggaagcagtttcaagattctgctgcagacagtcattaataatgaatgactattcatcgtagtatgatgtggtgatgccatttgatcacttgcctgccctctttcttcactgccactctctccttcctcccaagagcacagctagcttccagcatctttgctcatctgaaggacagttttttgcctaatcaggcccagtttgagcaaggactctggatcgtatctgcttctgagtctgtgctgctgccttcaacaagttgctgcttgttctgtctccttcctctacacaattgacgtggcccccatgggaatgcccatgtcggaaagcaatgctgtgctttcttataacccgcacctctcgtcatgctgaccttagcacgtattaaactcacttcagaaaaatgaatgcttacaaaagaatgttttccaccggggtggggggcccaaaaaaggcccagaaagctctaagagctcacagttggagaaacacatctagactgtataggtggtaaaaagacagctgagaagataaggcaggaaaagccacacagggacacaaagggcaaggccagtgattctgacaccaccattggcactttgtccacgggcaacaggatcagaaacgtgcgtcgcttccgtggttactgtctgtgcaccgttcccaacagcttcatttctctccctctgctgccaactcgcccaaccacccctgcctgtggcaggagaaatcattctcattgggataaccgagaaaactacaactgtttaccccacttgaccctcagcatttgagtgtgtgtgtgtgtatgtgtgtgtgtgtgatcatgtcacaaaataaaatgtttccgcaaaacttcattgctgtagatgtggcatattccctatcagaggctgacactggagattggatcaagcagatgttactccattaaaaagaacatggatcttaatcctgtaggtaaatcatccacagaaaatgtacatcacctggagagccgttcataaaggatcttcacttaccatcctcagattttttcaaagaaccccagcaaaggaagacatgggtttccattttctcggggtggtgttttagagtcagtgctgatgaaataagatatcagaaaaccagggttcaaagagtgatgtcatccccacagggaagatttggttccacacagggtagagacgtgcttctaaaagtgtctcttgttttcctcctgcagctcgatcattatccttctgtgagttaccatctgccaagttcatccgacaccctcttcaattctcccaagtcgctctttctgggaaaagttataggtaagaatgtggttcgttaggtataaatgcgtgctacaaatacatttgggtaatgtgagtttggattttaaaactatcaggtaaatttctcttactggggccagtcacgaatatcttctctgtacaggaaagttacgtggttgttctcggtgttgcacaagcaaagcgtcaacaaattatctttgggggaaattgctcatgtaactcattctaaagctaattcgcctttgaaatacattgtgattaggctgggcatggtgggtcacgcctgtaatcccagcactttgggaggctaaggctggtggatcacttgaggtcaggagttcgagaccagcctggccaacatggcaaaaccccgtctctactaaaaatacaaaaattagccatgcatggtggcaggtgcctgtaatcccagctactcgggaggctgaggcaggagaattgcttgaaccccggaggtggaggttgcagtgagccaagatcgtgccaccacactccagcctgggtggcagagcgagactctgtctcaaaaaaaaaaaaaaaaaacaaccaaacaaacaaaaaacacattgtgattggtaatgggggcttctaagtcagcgatggtaatggaacaaacgttgtttggtgcgtggcataaactacaacccaagcgaaggcaaatctgctccaggcttctctatgtagaatttggtctattacagacctctacctactagcaatatgtaatttaacgtttcctttgtcaaagcatatcaacatgattctatcttcctctcactcgtaagaaagcaccttgatattatttgcagataagaaggccaataaggaatttgacagtgtgacagaacacccttccccatgtgcgactgtgaattccagagtctccttgtccctctcttcaccagaggagattagcactgtgcaaagctaaaaaatgtaccatgagccacagatatgtgaagattacaccctaaatttttaaaatatcgatatgattggtgaagtattttaaaatatttaatgtgaagccaatgaattttgttcatatgaggctgtgtactgtgaactgcaatgaaaacagtaagatggtggtgatgtacaggtgggagggaggtcactcggcggccagtgtgtagaagtgatcagaatagcattaatggtaaaaatgctcacttaaaaacatgcggcaggggtcacaaaatgaggagtgagtaggagactgaacctataataaaaataatagactgggcgtggcggctcatgtctgtaatcccagcactttgggaggctgaggcaggcagatcacgaggtcaggagatcaagaccatcctggctaacacggtgaaaccccgtctctacaaaaaaatttaaaaaaattagacgggcgtggtggtgggcgtctgtagtcccagctacttgggaggctgaggcaggagaatggcgtgaacccgggaggcggagcttacagtgagccgagatcacgccactgcaccccagcctgggcgacagagggagactctgtcttaataataataataataataataatgtgcacttatgtaagatttactgtaggccaggctccagtttaagcacttgacagatattagcccattcaatcttcgtcacaattgtatgaggtagttaagattatgatctccactttttagatgagaaaactgaaccatgaagagattaaataaccgggccacctggctaatcagtggcagaaccaaaatttgaactcaggcaatcagacaccaagggagctctttactgtgctgtaatccctgtggcagttaatctagaatgcaaagagaaagacagagaggaaagattgggcaggtgataaatgctgaggctgtccaggtaagggataaagcctatatcttgtgccaggaagtggtcaagaacaaaaaggattcctgggtttagaaccaggaacacaccagtccggctggagagggaggcatccagaagagagggggaaagcaggtgtgtgcatgaagcccaagaccacacacctggtgaacaagacagtggggagtggcaagtgataaatcaaagggtggaactggaaaacaaaagagggctaacatgtattgatcactgagccttagatattgtacgatatgaaagataattaaatagcttctgcttaatcctttgcatcctgaaaacagcactcaggcacagtctcaaatctagctttggattacctcaccctgatgtccttatctgaattttctccaacactttctatagttgatgtatttttacagatcttatcaccacttttatgttctgtgaacaagaagagactttgtgacatcacatgttacacgtgtaaatataagaaacaaacgtcacaacaatccaatgaaatgagatccctgattatgaacctcattttgcagatgagaaaactgaagcagaagaaggtcaatttgacaaaagttactcaactaatactggcaaagcagagtttggaagcgaggtctctctgaagacagtccagactcttaagtgggtcaaacaatcttgtcattcatggtgaagctccagaagagggatgtatttgaaagttgagcgatgccatcagttagcaacaaaaagtggctgtttagtggagtagggccttggcattcatgagtcatggatctgagactttggtgagtacccgctttctaccagaggtactcccacggttcagttgagaatactttaaaatgttaagtgctccttcagaaccatatgattccatcaaaacaaacgctacactatgatatggtgatgttcctaaagatactacactatgatattcgtaaagtaacatcaactataaacatacccgaaaataatagactttttattactttgtggaacctgcaaagtcaaattttgatgggaatgttggatgatttctaggttctgtcactatgagtaatattctctggttcctctgttttccaggtcatgtaactagttcacatttcagcacaattccaatatactgtatggcatggaccttcaaggtcgtgaacaaataacatcataaaggccacattttctacaactaagaatgtaccttgacatcaatctgtgcaaagctaaaagtgtaccatgagcctcagatacatgaaggttacaccctgtattttttgtacacccaagaaaaatgttgctgcatacacaaactaggtaactgtgcatgtggcagtgagttacagaaagtacacataaatacctgtaaggaggtccacaattccaagatggaaatggtgttatgcaggtgagagtagttagggctccagcaatgggtccttggtgcactgacttctagtggagattatctctcatccctacaagcctgtgacctccctgcagaccaagaaagcatctcatagttccaccatatactaacaaggagcaagtgctcaataaatatttgttgaattaataaagagtaaaaggggaaggaaacagaaagatatcattgtagacgtatactgcagggtgaaagggtatggatgatcatcctaacagaatcagtaagattcgcacagaggtgagagctgcaatcctcacatatctcacagcctaaaagtaggcatctgacgatcatgaagtagaaagaatgtggacttcggaatcaggcagagcttgttagactggaatccagttctacctctgttagcattgaaatcttgaccatgttgctttcttagttgaacctctcagagcctaggttctctcctttgcaaaatggggaacacaaatgcctacttgcaggttgttaactccctgagggcagaaggcagagactttttttgaaactaatctatttacagcaggctgatcagtgcctagtatacagaaagggctcaaaaaatacttgtggagtaaatgaactactcttttaatattaagctaataacgtcttaagacatacacaacacaatgcctaatacataaataattaccatttttgatgctagctacatgccggttattatgctatatgctgtaagtacaatactgtctgcgtttctcacaacaccacagaccattgttaccctcgttgtatagaataaggagctaaggctcaaaactattaagttttcttcttaaagtggggtttcccaacagcagaactattgacattttggatcagaaaattctttattatggggctgtcttgttcattgcagaatgtttagcattctccctggcctttacccactagatataagtagcaccccaagttgtgacaaccaaaaatgtcttctaacattgctaaatgttccccaggagggaaaaattaccaccccagttgaaaaccacaggcttcaagctactcagcgagtcagcggtgacgctgagatttgaaaagcgtgatttgtgacctaagacctatgctttgcttcctgatgacacctgcaccttccagaatggtgaggaagcaaggacgaggttcttgctactctgaagctaaaattctgttaataaaattgaaggagtctcagtgaagaccccaagaagacatgtaagtgcttgagaagctaatcactggccaccccttcaagccaatactcctttgatatttgatcatttcacaggggcaggaatatgcttaaatgtctctttgaaaacaacatatacttcagtgagagacaacccatttgcattccccagttgtgtaaaaatccatctgtacagacatacagtattgaacttgcaactgatatgtactccggccaggttttgaaaccccctggagtttcatgctccaaagttgttgctttacttttataggatcagtttctgctactcagaaactgattctataaaagaaagagaagaagatggctctaaatacctaaaatgacttcacactgagctctttgatgagcactcctcaaaaagggacacagaaaaaggatgaaagaaaggctacctaatcaaggacaagtgtgatctttataaaggggatggaggatatatattcaagaaatagtagtgtgatcactgccaaccaacagcaaacttttagaacggattcttacataattctgaatgcttctagaaggaattcagaatcactagcaatcagcaaaggttcacaaaggagaaatctcactagacatagttatgtccatctttcatccctcatatccatccatcttttaccagccgagtgatgtcatagactttatctttcagcaacaaatttaatggtctctcaagaaatcttcaaggaagagaaatataacttgaagccgaaagtggggtgttctgtttgctcatgtccttttcaacatctctattaatgccttggagaaagacacaagtagcatgtttattaagtttgcaaatgtcacgaagctgagagggatggtttaatatgatggattataaaaagcatttcaaaaccatcttgacaggctagaaagatgggataaaaataataagatgaaatgtaatagaaataaacttaattgcagcacttagataaaaaaaatatatacaatcacctaaatagaagatgggagacccccagcatcatgaaaaaacttaggaaattggtttgatggaaagtctggtacaagcaatgttacatggtgatggattcttaaatgaatgtgattctgagccacactagtatgagaatcatgtccagagcgagggtattagtcatctgaggagaaaaccagataaacacaagacccgtaaaggaaatgtcagaagacctgggaatgtctgatcagaaaaaaatatgatttgagagacgagagaatcaattttcagtctttggtaactgccacatgcagggtggattagacttagttgaggcttactcagcaagactgacatggaccaaaagcagaagatatgaagaggaaaatctcagctccatataagaaagaacttcctaacaattagagcttttcaaaagtgagtggtctctactttgaggtaatgaactctctattattgagaatattcaacaaaggctaaacggaaatgtgccctgtatattaaggagttgtctggattgagtaaaaccagattagatatagcctaaataaactttgaaactttaagatttgtggtgggagtaattttcttaattaaaaaggtgaaaatgcaatattatagtagagcagggtctcctgttccattggcaactagggggataacatttagggttccttgatataaaacactgttatgatgcatgatgatagatatgaatttagaagaatatcaatgtacagcgatcaccacatcactgtgagttgtgtaattacatacacgacctgtttccaaggtggcaatatgcattttaattttatttctgagccctctttaattaatcgtttttcaaattaactatttctgccatcgctgtaaatcagagtaatataaaaccgtaatgaagtagatctattctgaaataaaaagacggtagcttctctgtgtaaacttgagaagctgtgcttagaaagaagctgaatactaatgcagtgtcgttgttgcttggctgatcattgctgttgtcagtggcgatgtctggggtggtaaaaataaagcgaacttctatccatttgaactaactagagtttgtaagtcatattggtctcagatcctcatatttcccaaactaccattatccaaagcaattccaatagaagtggctagtagcccctatattatttctattataatctaaattgtgaatatcatgatcctacacgactttttattgattaaaaagtcttattctaaggctttctaaaactttctggagctttggcaaagcctcttcacacagaaggaactgacatacttagatcttcatttgttggtgaaatcatatactgtgataaccatgctgctcacagaatatttctggccagagttatgaatggaaaagatttgtgtgatttccaggctagaacatttaagtgctcatgcaagaccctctagagtccttttatccctttggcatggtgactgacaagcctaagacagtgattttttccgtaagcctgggtccctctgtgactacagtgaacagaaaactcttgacttgtgatgaacatatagcatgagataaaaaaaactccttgctttgttaagccaccgagactatagggctgtttgttactgtggcagagccttggcctgtcctgactgaggcataaggactgacttaagggcagactttgctctcgcacccttgggtttgatctctgatatagtttggatatttgtccccaccaaaatctcatgttgaaatgtaatccccagtgttggaggtggggcctggtgggaggtgtttggatcatggtggtggaagcctcatgaatggcttgggccatctccttggtgataagtgagctctcactctgagttcacacaaaacctggatgtttaagtatgtagcacctccccccaacactcttcctctggatcctgcttttgccatgtaccctgcctgctccaccttcaccttctgccataatcataagcttcctgaggcctccccagaagcagatgccagtgctgtgcctcctataaagcctgcagaactgtgagccaattaaacctctttccttataaattacccagtctcagatgtttctttatagcagtgcaagaacagcctaatacaatctcttactctaccatttgccgattgtatgactttgtcgggttacttaacattgtgtgtatctgttttgtcatgtgtaaaataggaatagtaatggtctctgtgtcacgggattcagcaaaataatacatgtttagcggttagcacagtctctgctgcatagtatgtgtgtaatacatattagttttttactttgcataatcagcaaatgtatactcatcatatgtcagatgccaggcattgtataagtccctggaacatcattagggtccaagacaggcacagtttctgcctttggaaactttatatattcaaatccagttctcagaggtttctcttgggagaacccaaagcaagataggggatcatacaatgtatcaatatgcactgggtcacatctttagagcttcagtttctggaaaagaaggtaatggaaagtcaattagaagtaaaaagacaagagggtgggataaatgaaaagaagtatagaattctttgggagcaagtagggagggcacttgagccagtccaggagtgagggaaggcatactagaggaagtaacacagaagctgggaccctaatgaagagttagaatgatctgggtaaagcaatgggctgaagtagaggccataagggcgggggaggtcagttctccattctgcacagcagtccacccaaaactgtgtggctcaaaacagtagtttattatttctggcaattctgtggattggcagggtggttgttctgcttcatgactccaggcagggtgtaagaatgactggatagcccgaaatagcctcattcatgtggctggcagcaagtgctggctgcccaggagctctttggggccacgagccaggggctgagttctcccccaagggttccaaatcatggctgcttgggctacctcatggcatggtggctgggctccaagaaggagctttccaaacagcaaatgtagaagctgaaggtctctaagagccaccattcttgccatatgctattgaccaaaatctgggttccagcccatgttccaagagagaggaagcagaccctacctcttggtggcatcgtagccaggtcacattgcaaagaaacatgccatgggagttacggttgtgacatctttggaaacacagtgtgctatgagagaaatttgaggaaccacaagttgcattcagaatggtggaaagtcggatgtgaagatgcaagtgataaaaatgctgcagcataagcagggttcagatcaaaggcggctttaccagcagggccacatgtcctgctttgcctgggacagacccaagctactcctgccaggacaagagtacattattagcagtgcccacttttactctaaaaataggactacgcagttgtatgatcacctatcttatttgggtgttcccaggagaaaccctgcagaattcgatttgaatataagaagtttacctgggagacaatcccataaaacaagcaggaaagtagagacatgaaacagggaaagggatggagcattatcaagccactcaccactgtgggcacctggaacataatcccaccaggacactctggaagacagtgcgagacatgcctccgagtgtcccaaccaaggcaggaggaagccagggcatctcgccacctcctcccatcctgcagtgatgagggctgcttcctgcggtactaactccccagcacttccagcttgtcccgtgtttacacccaacacactgctgaggccagaggaaagtgcagatgacagcgaatcgcagtcagtggttcctggagcaggactgaggtgaatgccgggcactgacagcatctgccatattacggatctatttataagccatgttaaggttttaatgttatcttaggggttaaaggaagtcaaggaaggatgttttttaatccatagaataacgtgatcagattgacactttagccagataataccatctgcagagtgcaaaatgcataacaggaagtgagaagctgcagggagaccaaattggaggttgccatggttatcacagaattgcacattgtaatgcacaaagcagctcacatatgtggagaaaatgcaatgtctttatctgtgtctgatgatgtcgtattccttctgggtagcaaaggcaaataagctaaacatccaggctggtttaaagctgattctgacttaatcatttcaaaattccttcctggttgtgctctgtccctcatgaataaaaatgttcagtttctcgaagagcctttcccgtcctctgcttctttctataaggtggggaccaggtgtacagaatataaaaggagacaggcagcaacatgtctagctttagcattctaatgataccgtgggcagggagagacctggatgcatgctggtccttgagtttgcatggccaggcatctgctggcctccagcccagtgtcctgtgtccctgagtgctcttctggccttggagcttaaatctgtggttgatgaacttagagtccctttctttgactcaggcagtgttcccagggagcacctgccatcctgccctttgcttacttgctgtgccctcaatctcccacttgagagacccctaagccctaagtctctttcgcatcctccgtctccccatggcaggttgtcgtcagctatcaagcagtgagggctttcatctaaggcttcatgctgcacgagaatgagatgatgcacgtgaggaccagagaccctgtcggcttactcttcttccctctctacatgaggcttggctgccccatgttagtacaggaccgccccccaccaccaccgaccccctacacagcaacctctccccagagccccagactgggaagcaaggcaagagccctaaacccttggtcccatccgtcatcctttagaaacccacttctgctctctgggccaaagcttagctctcgtctctcctgctgtatctcctccttttctcatagtcttctagggcattaagaaagaaaaaagaaaaaaagaaaaaaagctttgcttttacttcctacaaaaaaaaaaagcaccatctaacaaatagctccaaaactcaattgcttaaaacaacaattctatttttatcactaatctgcgggtcagctaagggccgaagtttctcttgtacacctctcgtcttcctcctgggaccagggagttagcatgggcatgtttttctctggcagagacacgagagaacaagccactcacacaagcactttccaggcctttggtcttgtcacatccactaacatctgattatctaaactaagtcatgtggccaaatccatagtcgaggagaagagaaacttgctttcccttcagtgaagaaaacagcaaagtcacatggcaaaggccacggatacagggaagggtaaagaattaggggccgccaatgccatcttccatacttaggaggtggatgcaggagaactctgtgacctcctcgatgtactaaaaagcctgagtaggcccggctcggtggctcacgcctgtaatcccagcactttggaaagccgaggcaggcagatcacgaggtcaggagattgtgaccatcctggctaacatggcgaaaccctgtcgctactaaaaaatacaaaaaaaaattagccgggcgtggtggtggtcacctgtagtcccagctactcgggaggctgaggcaggagaatggcgtgaacccaggaggtggagcttgcagtaagccgagatcgcgccactgcactccagcctgggcaacagagtgagactacatctcaaaaaaaaaaaaaaaaaaagcctgagcaaaggaacttggggaaatcattttattcactcaaaagtatgttcagtgctcacatgtaccaggtgctaggcacagaacaatggataaaacagaaatctcttatctttatgaaccatgtactctcatgagcatagacagaatgagaaaagagttgtgtaatataaatgttagcaataagtgctatgaagaaaagtaaaagaggcttagcaggaaagcatgttacaatggccaggaaagtcgtctttgagaaggcaatatttaagcagtggccttaacaaagtgagaaagctggctgtgtggacatctgctggaaaagccttccaggaagagagaatggcagtccaaaggctgtgaggtagggacacgcctggcttgttcaaggacaggaagaaaaccaacatggctggaatacagccatcaagggacagagtggcaggagacagatgaagtcagagggttagccagcagccaattgcacagatggagaccatcatggagagtctgcattttattctaaatgagatgagaaacagtagaaggttttgagcacataagtaacacaatccaatttacatattagaaaggtcattccagctgtgggatgctgtattaactgcagaaggggtgggctgatataggggcaggatggacactaagagaccatttcaaatacagttgtggagtccatgtgagagttagaggcacgtgcaccaacgcaacagcagtgatggtgatggagaaatctttggactaggaacacactgaagtcagagcccatagtatttggtgatcaaccggatgtggtgggtgagagaaagagaagtcaaagagcgtttcccaaggtattggcctgaatagctggcccagtggtggggctgcctactacaatgaggtaccctgggagagaagtagtttaggaactgtggaataaaaattaagacttccattctagccacattcaaggctattccatggatgcatagcactgaggtgcatatcagaaaccgaacaccacctgtaacacggccttttcctgtctttatctcccatctcctcctcaggcagatagatgtcttggcttgactaggacattgatcgttactgggaaaggcaaaaaagaaaaaagcctattgataaatgtcagaatatatctccattataaagtcattcaggtgttgcatatgaacgcaatgatgaagaagaacaaattactgatacacaaaacagcttggatgaatctctagagaatcgtgccaatggaaaaaaagccagtcccaaaaggttacatacccaatgatcccatttatgcaacatttttgaaatgacaaaattttacaattgaggacagattagtgagtgccaagggttagtgactaggacaggagggaaggggaaggaagagaggtgtggttagaaaaggaaaacaaggaggccgggcatggtggctgactcctgcaatctcagcactttgggaggctgaggcaggaagatcacttgaggtcaggagttcgagaccagcctggccaacatggtgaaatctgtctctactaaaaatataaaaattagccaggcatggtggcccatgcctgtagtcccagctactcgggaggctgaggcaggagaattgcttgagcccgggagacagagaagttgcagtgagccaagatcatgctactgtactgcatctaggtgacagagctagactccatctcaaaaatttaaaaataaaaaagagagattcttctgcagtgggaattattcattatcctgactatggtggtggatgcacagacctacacagatgataaaattgtgcagaatcacatttgcacacatacaagagtacaaaatctgaaataagatcattggatcatatcaatgttaatatcctgatggtgacactgtactcctgatttgcaaaatgtctccaatggggaaactgggcaaaatacacaggggatctctctgtacaatttcttacaactacatgtgattctacaatggactcaattaaagtttcaattagaaaaagcaataaaaagccgggcacggtggctcatgcttgtaatcccagcactttggaaggctgaggcaggtggatcgcctcaggtcaggagtttcagaccagcctagtcaacacggcaaaaccccgtctctactaaaaatacaaaaattagccaggcaagatggcgggagcctgtaatctcagctacttgggaggctgaggcaggagaatcgcttgaacctaggagacggaagttgcagtgagcagagatcacaccactggactccagcctgggcaacagagggagactccatctcaaaaaaaaaagaaaaaagaaaaggaaaagcaataaaagtaaaagaagaccaagtccaccttcttctgtggagccatttattcatgggatatttagtcagtgtctcctaggggctagtgccatccaccctgggggagcgtgagggacaggagagggacctgcagcgattaagccaccggttctacccattccctctttactttcctgcgctagccagtagagattaggaaatatgtgggaattattatttatttacagcttagaattttgtagttcttttagagtcattattgaagagaatgattaatataatacatttctttaaaaaggagctagagaaaatggggtagattaaactgcctgcaacttctctcaaggaaagtccccgatggcagcttatcgccttgtgatttatctctacctcctaagagtagaatgcagcaaaattgataaatgaacaaatggcaaatagttaattgaaatttctggtcagttgcctttgcgttttactataaggacagaagcagcaggaaagcactgatgagaaagctcattgaagtgataggtgagaaataatatttaaactgaagagaagaaattatgtcctgtttttcatatcctaaagaacatatagcgtagtcttaatgtccagaatcttctcaaggctgaaggaaatctattttaaaagaattcactcagggagttctagttcaaggctggcttctcattcttttttaattgcattgactttcattcttagacatttattgggctttattattattattgccttatagaatcataggaggccctaagaaataatttgttgaaactttgtcacattacagctgaggaaaatgaggcccagaaaggttaaatgaagccaaggtcacatagctggtacttcacaacgtttcctttttttttttttttttttgagacggagtctcactctgtcaccaggttggagtgcaatggcgtgatctcagctcactgcaacctccacctcccgggttcaagcaattctcctgtgagtagctgagactacaggctcacaccaccacacccggctaatttttgtatttttagtagagacagggttttaccacatgagccaggatggtctcgatctcctgacctcatgatccacccacctcggcctcctaaagttctgggattacagtcataagccaccacacccagccttcaacgatattttcaatataatatactgtcaatatcagaataatctttgcttatcacccaaatgtgtctttaacaaggacaataaataattaatacatcataacctgcaaacatactctcaatatctagataaaacagctgcaaaggcaaatcttgtcataagtgtaggctggaagaggatattttgaacattgagggtcaggctcaatacaggctctgtgtcagaacacctgcaattccagttgcctcacctgctcgaggagctttaacaggtttcttacaaatctcagcttcagttttcttaaccgtgaaatgagaatgatagtagtgccaatatcataagctttgttaggaagatgaaagatgctatcatgaatgtaaagggcttatcacacagcctggcacacagtgagtgtccagtacgtcttaggcagtatcattacatctaatctttgacttttagctaatacaaataaagaatggctgactccaatcctgggtcactcataaaaagaacactcaaacaatgaaaaactgaaaaaaacttttgattgaaaaccaattggtatcatcatctttccatggtttccaaaattaaattatttttaattaacaaaagcaacccccaccaaaaaaaatcatttattgttaaaatgtgatgagagatcagaagttctgttttaatcacatttttagtatttggttaaagaagattgtcaaaacacttatttctgtcccaaatcttcaactcacctgtctttgacacacaacatacttttgcatacccaattgttttgaaataaacaaacatttgaaagccaaaattctaggctgggctcggtagctcacacctgtaatcccagcactttgggaggccaaggcaggtggatcacctgaggtcaggagttcgagaccagcctggccaacatggtgaaatcccatctctactttaaaaaactacaaaaattagccaggtatggtggcaggcacctgtaagctcagctacttgggaggctgaggcaggagaattgcttaaacccaggaggtggagttgcagtgagccaccaagatcatgccattgcactccagcctgggcaacaaaagcaactctgtctcaaaaaaaaaaaaaaaaaaagaaagaaagaaagaaagaaagaaagaaagaaagaaagaaagaaagaaaggaaggaaggaaggaaagaaagaaagaattcttattattataacattccaaagtattccagaaggcatggaaaatttttgaatttcttatttatatacagttgatcattattattatacatttcatatttacaaattcacctactctctaaaatttatttagaacctcaaaagtagtattcttggtgcttttgtggttatttgcagacatgtgctgtgcagcaaacaatttgtcatcaatgtgtacattctcatttgaagtcaaacaaggtgatgcccttgccttctagtttcagctcttataccataaacaagtatcatttttgtagtctattcagtgccattttttttgcattcttgtgtttttattggtgattttactgtataaaatggcccctaagtggagtgctgaaatgctatctattgctcctaagcacaagacgctgcgatctgtcctgtggagaaaatacatctgttagatgagctgtctttaggcatgactgattgtgctggcagccatgagctcaatgttaataaatcaacaacatttatttcaaaactgaatattaaataagatacacacataaagcaaggtaatgtattggttggttgataaaatgttatgaccagatgcttgcaggaacctaaccctgtatttactttaggaacaatgttttagtattcactaattgagtgttagcagcaactgtatgaaacatagctactgcaaatagtgacaattgactgaattatttttaacctgcatcacatgaatatgatgatacattatgtttttatattattttgcagtttaaacagctcttccacagctattatcacacatgatgttcatggagcgttacagtttggctgtgtccccacccaaatctcatcttgaattgtagctcccataattcccacttgttgtgggagggacccgatgggagataattgaatcatgggggggtttcccccatactgttctcatggtagtgaagaagtctcatgagatctgatggttttataaggggtttccctttcagttggctctcattctctcttgcctgctgccatgtaagatgtgcctttcaccttctgccatgattatgaggcctccccagccatgtggaactgtgagtccattaaacctctttttctctgtaaattacccagtctcaggtacgtctttatcagcaaagtgaaaacagactaatacatggaggtaagaggagagtggttactgctcagcacactagattaacaagtccaactaaggctacccaggtagagcctggtcttctccttctggtttgtgaaatctcatggtgcttcctatagcataaagactggctgtcactcaacaccactgcatcttaaggtccgtggaaggggaacataacatgtttcgaagaaaaaggtctgggctacaaagaccctttatgtaatcttgctaacgacctggaatttaaactttggagagcttgaaggttaacaaattggaataaaaagaaatcaagtcactccttgtttgaatgctctgaagaacaaaacagaaaaacacaatgaaatggtaacagaagaagcagatttggcccaataagtctatgctttgaatgttcctccggcactaacatggccacatttgggaagactggcatccccacagacttttctgtagcactttgaaggaagaatagagcagttgtagaaaaacaaatgtttgcatgaaagaattattcacctcttaaaaatctatagggtgtgaataatcctgctataaaaagcattaaatgtttataacagatatttaatgggactgttatgttttttggcagcaagcatggctagattttgaatgtcacagctctgtgctctggtgataagacagactctgtggtctaagtaagaattattttcctgcttttaaatgtagctgttaaaaaacaataaagtgtatttatctaaggaagataatcttctaaaagaagtgtttaataatttttaattcacaatttatactacttctccaaggtaaattcattttccaactgttactccatctttattgactgggaggaattagcattcaaaatacaaactcagaggttaaagcaaagccatacacagaagtgagccttattccattgtcttttatcacgggtgccagatttatttaacagactgtctttcagtctcacttacagtaactagacaggtactatggaggacagtgtatgttgaatgccttccaagtgtgaaacacctgcctggcactacattatcactaattctaaccttgcaagtaagtgcctacttaaatctgcacttgacatgtgaggaaagaggctctgaagttttaaagtgacatgtgccaagtcatatagctagtaagtggtagaaccatgattccagggtgggtctttctgtgcttgttggtttatttactgtctgtgtttgttttatgaaagagaaaagaccctgagagataggcatagtacaggtgacccttgaacaacaggagaattaggggtgctgaccccctatgcagtcaaaattttgcatacaacttttggcttttcagaaacttactgccaatagcttactgttgaccagaagccttactgataacatgaacagttgataaagacatattttgtatatgtattatatactgtattcttataataaattaagctagagaaaagaaaacattattaggaaaatcataggaaagataaaatacatttattattccttaaatggaagtggaacatcataaaggtcttcatcctcatcttcttcacattgagtaggctgaggaggaggaagaggggttagtcttactgtctcagggttggcagaggcaggagaaaatctacatataagtagactcatgcagtttaaaaccatattgttcaagggtcaactgtgtatttatttgatgcttcagaaaggggaccatgtcaattcctgataaggttctctcctctttccttttcctccatctctctgtgtcgatcctagtgctctcatcggcttttaaccagtagaggtctccaaactgtcttgtggcagcctgggctccctatacacagaaagacctggcttcaaaattctggttaatatgggaagtgcattaggaagtagaaaggaaagaaaagtcaaacaataaggaaaggattaatataaatcataaattaattttgtgggcctaattactattttttaaaacactgtaagttttagtagattttcttactctaagttatagaagtcaaaccctaaaacacgttaaaaaaaatctttttgttatttcttaactattacggttattttatcaaaattaattaatatcaaattaatgataatacaaaggaagtcacattattaattaaacaaagtgacttagccttgcaaataaaacactatcgtgtggattaatagtttgaaggtttaactttacagccttttcaattgactgtaatttagagcatttttaggttcacagaaaaatggagcaaaaagtacagagagtttccatatactccctcacccctccccacgttatacatagtttctcttcttattaacatctttctacgtcatgtttttggtgttacatacttgccacacatagtaccctaataatctcttgggccgtacattctctgggtttggacaaatgtgtaatgacacagatccaccattacagtatcatagagagtggttcccctgccctaaaagtcctctgtctccacctgttcatccctccctcccctctgctccttgcccggtccccaggcaactactgatctttttcctgcctctatagctttgccttttccagaatgtcatataattggaatcatacaatatgtacccttttcagattagcttctttcactttgtaaaatacatctaagtttccttcaggtcatggcttgatagatcatttcttttgattgataaataatatttcagccttatttttgtaaggaaaaaatcaaatcaagaaactaaagtttgaacagccactatagaaaaaaaggcaaaagtcaataaacaaaaacaattgttcagcttcgctcataattgtatacacctcccagctcttggactaggtaacatcagtggccagcaagatgccaccgattgagtgattgtttttatttcatgccatgtgacccattggccctccttttcctgacacatttataatcatcttaatcccaaagcaactgtttttaacaaatatgcatatatcctctgattttctgttgctataacagaatacccaagagtgggtaatttataaagaaaatgactttatttcattcatgcttctggaggctgggaagtccaaggtccaggggccacttctggtgaggactttcttgctgtgtcatggcatggtggagggcatcacatggtgagaaggcaagaccaggtcaactcaggtctctcttcctctttctttctttctttttttctttttttttttttgaattggagtttcactcttgttgcccaggctggagtgcaatggcatgatgttggctcactgcaacctccacctcccgggttcaattgattctcctacttcagcctccggagtagctgggattacaggcacgtgccaccacgcccagctaatttttgtatttttactagagatggggtttcaccatgttggccaggatggtctcaatctcttgacttcgtgatcggcccgccttggccccccaaagtgcggggattacaggcgtgagccaccgcgcccaacctttttttttttcttttcttttttttttttaaagacagtctcacactgtcgcccgggctggagtgcaatggcacaatcttggctcactgcaagctccgcctcccagcttcaagtgattctcctgcctcagcctcccaagtagctgggattacaggcgcccaccaccatgcccagctacttttttgtatttttagtagaggcggggtttcactatgttggccaagctggtctcaaactcctgacttcgtgatctgcccgcctcatcctcccaaagtgctgggattaaaggcatgagccaccgcgccccgcctctcttcctctttctttaaagccaccagccccatcatagggacccaccgcgatgaccttatctaattctaattacctcccaaaggccccacctccaaataccatcaacatatgaatttagagattaagtgtccaacacatgaaatttgggggacacattcaaaccatagcatcttctttaagataatgtaaaactattaaattaaataatagagtagaaatcacactaataatttgtgggtctattcagattatatattacctaataatttttacctattttttgaaaattgttccaatcattccccctgcttccttttcaaaagagtcaaacatagccagttaatttaaggtatctgcaaaacctttccaccaagacttttatggtacagagaagtgactcataagccacaattcaattaaatttagcaaatatttcttggacaacaactacatgcttgaggttggcatggggacctgtttttaaacctcctgttcattctactttgactttttaattacaacagattaaaatatcttattcagcaaaaaaaaaaaaaaaaaaaaaaaaagagagaaaaacccactttgtatattgaatttttgaatacacaagagaagtgcaactcagggtggtgggattcctacctagcaggcctgtctccctttgattaccccaatattccaaaggtgcaggttttgtgcaccaggcactctaataggaccctatcagctcagcgctctcagaaatttcagttgtctcccagcccctagaaagtcacaatagctccagggttgtgcttaacgggccatagtgggaggatttggaaaggagaaggtgaatcttttctgtgaaaagcaggtggaggaaactgaagagtggggagaagagaggtggatgctgacctgaattgtgttttcaggagcaggaagagtgtgctctctgcttaagagatgacctgaatggcaagactacatgtcactcggatggtacacagatactgtcttgatgggagttttcggaacagatttgtcctcccagggtgaaatagcagagagatttgaggcagccctcaactagagtatgaccaataaacaccaacttacttggtttttttcattcctttttccctgtgtccaagaagcaaaatgataatgtaaatgaatacacacacactcacactcacacacacacacacacacaccccatgttggggaggcgggtaaaggaacagaattgctctcagcaaacactggtggcatcaaaatagccaatcatgctgatggctgccacacagctcatggaagccttccacaggccagctctcttgctgttggctggctggacttcccagctcagtccctcacctctttacaggacaaggcacaccagaaaccaaggctgttgggggaggcagcaacagagaccagacgttccctctgcacacacatgatgtcatcaatagaaactctgctgatgatgaacccactttcacacaaaccttttaaagcctgagttattttttgcaatgacaaaaataacaaaccacatttttttaaatagcttccttaataataatggaaattcaggtgacattaatgaaaattgtagcacatgttcaaatcagaatctatgttcagtgttatatgcagaatataaagggatttcttttctcaattgatagaaaagggaagtcatatttaagtagtcacggtatcctagatttttaatatagcaacataattgaataatattttgatgtatctggttttagtatttaaggtgataaaatattaaatttaagcttaaaattaaaaatagaggaaaaagaaaaacaaattgaactgaagtgaaaatgtttcttgttttttaaaaaatcattgtacataacagttttcaccttcacttttagaaatcaaagcacaaccctctatcacatggtaaagagagtcagccatacggaaaaccaagctgattgttctattcctgtgcaaattctaaccctaaaatatttctctataatgctttaagaaagaaagtaaatctggaaaacattttttatcattttgaaagctgcctttgttttgattctcattgtgaaggtcaaggataggagaatttccagagatgggaatttatcttcactttatgctatcatttcagaatgaatagtgatcaggttctaaataatgcattccacaggtgtgagcaaccaccctatcactttctatcttcatgtggctggtgcctacaacactaaatttctgcggcagattcattaaggtagttgttcattccctgtcgtaattagacctcccatttcagccttttatgtcaaatccatcactcaccctggcactcaggctcacctctttacaaagcccttccctggtgctattctggctctaaacacaggtgataaatgtgtcagcatggggcacattcctgtccctgaggaccatcaatcgttaagtacagagagctttttccagcagccttctaagatttatacccatgaggatattatttttgtggctgcatgaaggagaattattacttgaaatgggttttgtgaaaggatggttttggtgttgctttggcaccattttaagcttcttttcacaaaattgaccggcgcaagtcagaatttatacttctatgaatgtagatcttcaccatctgatggtgctgagtcctacagagaagaggatttgagactttccagtttttagagatctctacgatgtgcaagaatctagatattcagaggccgtactgacttcaatcacatggtaaattagtatatgagagttcgcagtaataaaagaagtatgtaagtgatcagcatgtgttttagtcagggttctctagagggacagaactaatggaatatatatataatatatatatatataaaatatggaatttattattaagtaataactcacacgatcacaaggtcccacaatagaccatctgcaggctgaagagcaaggagagacagtccgagttccaaaactgaagaacttggagtccaatgttccagggcaggaagcatccagcacaagagaaagatgtaggctgggaggctaggccaagtctccctcttcacatttttctgcctgcttgtattctagccgtgctggcagctgattagatggtgcccacccagattaagggtaggtctgcctttcccagcccactgactcaaatggtaatctcctttggcaacaccctcacagatacacccaggaccaatactttgcatccttcagtccaatcaagttgacagttagtattaaccctcacagcatgggaggtaatgcgtatgttaaatagtttcatttagccatttcacaaggtatacagattccaaaacgtcatgttgtataccacaaatatatgaaatttctacttgtcaatttttgaaaaaaaatgtttaaaagaagtgtgtaaataacttcttactttagatataaaatcttaagggccaggaaaagggcaccaaaatccagcctttgacatctcagaagaagcgatgattaatttcatttcattctgttggtttccatggagtggtgctgggtggtgaggcaaacacagcagcaggaatgttaacatttcatattttagccctaggagtaaagaaaaaaaacatgtcccagatcagcactagctagaaccaggaaaccccaaaagcaaaggtttttttgttttgttttgttttgttctgttttttgtaaaagacaggttttcacaaaggaagttttccaaattctatgtataagagagttgagaaggaagatttttctctcttcttgcccaggaggacaaagggaagagtaccacattaagccattcaggtaaagtgaagcttattgaacgctgtggattaggataaaactaatagagttttcatttttaagccagttcagatattcagattaattatggacgtaatgtagaaaataccaatttctgcaagttctacatttcatgtgaaatcccaaagaggttaaagctgatgggttttaactgatgaaaacacgtgcctctgattaaaaatgtttgtagtgatgaaaacaaagcatgctagagttacagtgtgtagcatgctgaagccaccagcagagcttaggggacaaaaacaactgtttcctaagagaaaaagaggctgagtatcttaagcctggggaagggaaaagacagtagttagcaagctcaggttagccactggtattactctacctttcatgagactcttcactggggaggttggggagattcggtctcacctaaaggagagatggctcgtgaacccaaggatgctgcagggaccctggccaccacttgcagcccaaacactagaatgaggaccagagaacacaatctagctgcttcccatccatcccctccaccccaacatctggtctcagcaacttcctctgccctacactgggatgccctccttagttgatctgaaccatgcagcagatgaaacatgttggcctgacaagtagcagatggctataattgcctgagccatctacaccggcaaatttttcttctttatttgcatatgagtaaaatttttcccagtgttaaattatggtgtgagtagagattttttgagggagcacagcgcagttgtatagacatcgtgattgacaaaaaataaataaaataaaataaaataaatgaccaaaatctgctaaatgaatttgaattaaattgttctaatgctttctttttctttgtaactcttcaccaccacctcaatacatgcattcctggacattcacgcatacactcacacaaacacaagcatggtattttttgtgtgtgagacactgaaggtagcatgaaatagcaaccaaaaaatctgcagtattaaagttagatatgacttggtttgacttgcaaatcaactgcctcactagtaagatgacttctggtatatggatatgtctctcagttttacaggcttgttttcggattaatggtaatagatgtaaagaattgggcacggtaagtcaatagtcaaagctattcaacaaattgaggacaaacaaggaaatgggttaggaattggtctgtagccagtctcagaaatgttgtattaacctttgggatataatcccccaaaattaaagtatagtgattcatccaaaagtacaaagtgttactagcaagatggatgaggatttccatctaacatttttcatcttcttatccctgacacattattaaaacacctagattttggtaaaagaggagaagtcatgtcttggacaggattgaaggttgtgtcaacattccctatgctttcaagtttcagctttagaatccaaaacccccgggcacagtggctcacatctgtaatcccagcactttgggaggtcgaggcaggcacatcacttgaggtcaggagttcaagacaagcctagccaacatggtgaaacctcatttctactaaaaatatggaaattagccagtcatggtggcgcattactataatcgcagctactcgggaggctgaggcaggagaaccgcttgaacccgggaggcagaggctgcaataagccgagattgcattgcaccactgcattccagcctgggcagcagagcgaggctccatctcaaaaaaaaaaaaaaaaaaaaaaaaaaaagaatctaaaccctttggttcacagatggaaggaaaaagcaggcggtgtttcctattctatgtgtatgccatgcctcgagccctgaacaggctactcatctgtggccaatattatattataacctctccattctcagaaggcacgctggcacccatctctgcaagaaaggcatcaaattgtctgtaagtcacagaaatgttattgtattgtcctttattcattcattcagaatatactctctaagcatctatgtaattaaacattactaagcttacatataattaacctcgaaataataactaagcattgttagttttatgtacggctaacttaagaaataaactcactttctagttatcagttttggaaaacaaaagagctctataacaattttgaattaatcaaaaattggagaattctgtgcaaacctataatccttccctctttagggtgaaggagcaacgctttgtgttacttaaagacacactttgccattgtgattaactataataacttttaaaataatcaaaaaatcagtccactttcttgtctatttgtgtattgatcactaaaattattgtacctagtatgatcaactttgtatattactgtatttcattaaagcagctaacttctcttgtccagacataagagaacactagaagacaaaaaacaaaaaacttttatgaatctcttttccttacgaacactaattttataccattttaacatacttgaggtggcaaaaataaacatatatatattatatcatccaaaagtatttgcatattttattaatctattgccattctaagaattcagggtaagttaaaattgtgttaccaaccagcatttattttgcatctgtttcactcttgaaattgtctaggtttcaaagattattaactaattaacttcaccatttgtctaaggtcttaaagttagttaaggatcgagaaatcacaatttttgcaaacataatgaatcctgacacccagcacttaaaaattttacaaaacttaattcttttaaaaatccattaccttttcatttaattgactataattatatgtatgtatgtgtatacattttaaacaagttataaaatttgtgatgatccacttataaaaacaatgtaggaaatttaggaacttaaatgataagaaatttatcattggtctcgtacaaaccaaagtattattctgatattatttttatatgataaatgaaattgtaaagaccctaagtcgtgctcaaggctcttcttctatcttgaactaaggttttcttcttatcttgtaactatagtaacaagggctacaaaagaagcacagcttaatatttttccttttagacatttttgactactaatatggtacagatattcctaatgtgcactcataatgatagagtgaatattttaatcaattttttttttttttgagacggagtctcgctctgtcgcccaggcgggagtgctgtggcgcagtctcggctcactgcaagctccgcctcccgggttcaccccattctcctgcctcagcctcccgagtagctgggactaccggtgcccgccaccgcgcctggctaattttttgtatttttagtagagacagggtttcaccgtgttagccaggatggtctccatctcctgacctcgtgatccatccgcctcggcctcccaaagtgctgggattccagacatgagccaacgcgcccggcctcaattaatttttaaagcttcccaaaagaggataaaagaggaggaaaggaatagaaaaaaaagcagtgatagggacccaccttcagacacttaagacattatcgctgtaaaaagcaagggtcttccctctgcaagaagaggcactaaatgtttagattcaggaaaacccactgtgacatatatacatgcaaaagataactcttacagctggtataaacaattatttgggccttgaaattcttatcaagtaacatgtttaaaagccagactttattaatcctcaaagaacagaaatgtagaaaacagcatttacaatgagccaaaaactctctctttttagattgcaagacaggtatctcttcatgaagctttctccaatttttgttctcaggcaccactcaaatgaacaatcttgttcatgtcaaaaaggtccccaaaatagccactgcagttcaaaattatcctgtgaaattggctaggcatggtagctcacatctgtaatcctagcactgaggtgggcagattgcctgagatcaggagtttgagaccagcctgggcaacacagtgagaccccccccgcccaccatctctactaaaatacaaaaaattatccaggcatagtggcatacgcctgtagtcccagctactcgggaggctgaggcatgagaattgcttgcacccgggggtggagttcgcagtgagccaagatcacgctgctgcacttcagcctgggaaacagagcaagactctgtctcaaaaaaaaaaaaaaaaaaaaaaattatcccgtgaaattctgccagttaaagacacaagcatgtcagttaaggtgatgtgagaaagcaggtatttgtttcatagaaaatgcccagttttaggatggatcagacactatgagcactgcaatagatcctcccacacgatggtgcccgtgcagcctactttcgtcaggacttggccaaagcccattccagggtcagacaatcccttctgatttcaagaagcctaatctaaacaaagcagctctcaggaaaagaacaagaccgacgaaaaagttcttctaagggttcgaaatcatgacccaagtcaaagtttattcaaagaatgttgattgtaggagaacttctgaactcctaggcccctgagccagctcaagaactgacttacctggcttatgctcattgtctccctagagaccttttgttttagagataaagaacactcaagacactgtacaagcagacagtccataggaacatatatctgtagactggtaaacagtatcaccaaagaacaataaaaatcagatcagataaccaaaaagtcactggtaaccttattcctaggggaagaaaaaaaaagagagggagatagagaaaaggaaggaaggaaggaaggaaggaaggaaggaaggaaggaaaaacacctaaagtggaaggacctcagcagaatatggaagctcagttcagcatgaacttctcctagcacgggcagtgtggttacatcagacagctagagacacaaagggtctcaaataagcacactaaaattggtgagtggagggttcccatccaagactgtagggctcacagatgaatattgatggatcttcaaatgcagagattaattacagccactgaccactaggagcccacctgtagtagaacaaatgtgggattcttcactcattgcatcatgggagattgctcattatggagaaccatagaggcatctcagtaagaggatgctggaaagagggtgctagaaagtgctattcggttttcagtaggtgatttggggagagttaaaaaaagtaggggtttgttctagattggatactgtcaggaagcaggtaattctgtgattgaatatcttaatttttttttatcttgaagacagtagagaaaaacagctgtagttggtaaagaagtagaaatgatgtgtattaggctgagaaggggtatgttggatcattttcgtgttctggccagttttcttttttcagtgctgagacatgtctcatggagtgacctcttctttgcctttccccatgaaggtcacggaatgaccttgtctgatgttgagttctgtgaaatggatcaccccaaacagaagcacacatggcctggctgtgagttcccaaacagctccccacgctcaagagctgcttttctttctcattctcaattaaggattgaaggaggacacaaaaacacgatcaccaaaggaaaatgaaacaaatttaaagtaaataaaactcagcaaaaagaaaaactacaggaaaagaaaagtaactgtaggaaacaataatgacttagccctaaatggcatttacgtggtcttaatcatatgtgaccttaatcctataaaaaccaaattgtgatctaactccaagtccaacctgcctattttagaagggtagttggatggtgctagtggatggtggggaggagagtagaagctaactcatcatcatccgtattggtaagtgaatagataatgcctaaaaacatgtcatgaaattgcaatgtcaccacatcatttggagatacgtttttaagtcagcctaaagggttgaaaatgcttctaggctggggcaacgggagggcagagcatagaagatggtaatgattcctgaccatccttcaagaactatctttctaattttttccatcttctcctccctgctttattctagccacactggcagctgattagatggtgcccacccagattgagggtgggtctgcctctcccagcccactgactcaaatgctaatttcctttggcaacaccctcacagacacacccaggaacaatactttacatccaaccaagttccaaggattggaacaatacaatcaagttgacactgaatattaaccatcacacacagacatatatacatatatatatattttttagacagggtctcactctgtcacccaggctggagtcgagtggtacaatcatggcttactgcagcctgaagcctcaacctcctcagctcaggtgatcctcccacctcagcctcccaagtaactgggactacaggcacacaccactacaccttgctaatttttgtattttttgtaaagatggggtctcactaagttgtctatggctggtctcgaactcctgggctcaagtgatccacccactgtggtctcctaaagtaagtcatggcacctggccaactttttttttttttctttttttttgagatggagtcttgctctgtcgcctaggctggagtgcagtggcacgatctcagctcaccacaatctctgcctcccaggttcacgcctttctcccacctcagcctcctgagtagctgggactacaggcgcccacgaccacgcctggctaatgttttgtatttttagtagagacagggcttcaccgtgttagccagaatggtctcaatctcccgaccttgtgatgtgccctcctcagcctcccaaaatgctggtattacagatgtgagccaccacacccggccccaactttttaaaaatattttttaaagaatgagtagaagtagccaggtgaagaaaagaaaaggaaacagagctgggaaaaggtgtgttgcatcagaaactagaggagggcatttcgcctggaccagagaaagttctgatgagccaggaaggctgggcagagccagctcaggccaggcaggcgcgattctgcacaggacaggatgcacctccaatgaccacgtgtttctaggttgtttccaagggcacacagataacagtcaacgatttttttctgactagccactgtagtgatcgctgctgtgtgaccctccacactttgcttccctcgggcctcagctccgcctcattccactggcctaataattaactcagccttattttcccaacctaattgtttcacagaccaaaagaaatattggatgtaaggtacaatttgaaaagtgtaatgtgctctagaaatgcataaaatgatgattagtctttgcccagtaggctttttagcttaataagctcctgataatacagaaatcactgtgagcaactggcagagaaagatttttccatttctcttaactaagaaaagagatttaaagtcactttggagagctaacactaaataataataactgccaaaggaattgatttgatgctgaatataggcttgtgtaaggaggtaaaaaactgtccactaaagttaatgctcatagtaagaggcctctgtccttgaattcaccttgagagagttgaacagggataacggattttcaaggacacacatctacagagaaagggcgtatggaaatggaaaagggaaagctgctcctagtgtttttgctgaattgttctctttctctaacccagcaggagagatgctaaaggagattttgtcaaagaaaatccttgacattggattcttaaaagccttatggtttcatgataggccctttaccaaggattcttaagggacaaccttatgttagagagaaacaaagtcctgaatcatatttcctcctctctggaatatatgtagaaatacaagtgagaagataaatacatgtgtaaaaagaaaattcatactttcatactcgttatatgttatgattaaatgttgattgcatttggagagcatcagcatatgaactatattacagaaaggatagtcttttgtttcatggcttaaatcttcttttctcaataagattaaggggctagctaagattataatcataacaattttttttttttcactgagtttccaccctgtgaggaacactaggctaagcaggaaaaaaaaaaaaaaaagtcactaaaagaccctaggctatttgtacaccaatgttcatagcagcattattcacaatagcaaaaaggtggaaagaaccaagtgtccatagatggacagataaacaaaatgtggtctatacgtacaacatgggtgaaccttaacattgtgttaagggaaataagccagttacaaaaggacaaatactgtatgattccatttctatgagatacttagaggagttgaaatcatagacacagaaagtcagatggtgactgccaggggctgggaggagggacaatggggagttgttgtttaatgggtatagagtttcaattttgcaagacaaagaatttccagagatgggtggtggtgatggtgcacaacaatgtgaatacacttaatgccactgacttgtacatttaaaagtaggttaaaatgggccaggcatggtggctcacacctgtaatcccagcactttgggaggccgaggtgggtggatcacgaggtcaggagtttgagaccagcctgactaacatggtgaaaccgcgtctgtactaaaaatacaaaaattggctgggcatggtggcatgcgcctgtaatcccagctactcaggaggctgaggcaggagaatcactggaacccgggatgcggaggttgtagttagccaagatcatgccacttcacttcagcctgggtgacaaggcgagactccgtctaaaaaaaaaaaaaaatatatatatatatataggttaaaatgtccattttatgttaggtacattttactgcataaaaaaaaaaaagactatgggcaagccatttccttcctctgtgcctcagtgacattatctgtgaaataaatgtgtagaaacagatggactccaaggatgcattcaactctgcaagtctgtgtgtctaaacatcccctctgtcctcatggggtttagcagcaagttggagagatgaaatgcagtaataaaatgtaaaatacttctagttaatgttttaagtacccaattagtgattttttaaaaaggaatatgtattcccttgagaagggatagagcagaaatctggaggacagctttgtggagatagaactggaccatgcccacttcaagaagtatgtagctcggatgtggatctgtgccagtgggatggccttaacaaaggtgagcaggcttcaccacaccagggggtccgtagaacagcaagaagatgagcctgttggtggtagaaggcttctgcgtcaaagtgaagcattgaggaggacccatgggtgactttgagggactctgaatggaagagagtggatggacgagacacctggcctatccacaaactggccctatagccttgaataatcactgggacctcagttcctgctgtatgacaccaaggctagctcctttacaagacggaagcacagcctagctgatcttgctcttcctgctggaaaactccatgattctctttgccttccaggcaacagacacataagattcctgctgccaggtcactgctggatgctggactccagcagtgacaggccccgaacctgcccttgtgaaggccactttcttagtggtggtggctcatctagcaggctgaggaatgtacaaaggatgtgtaagaaaatctacctagcagtagggtatataatgagttaaagaactgagcttctactggcaatgagaccagccagggtaatgttgcaaaagtttagatgtacattaagacccagaagggctgaacttggttaggggagaggaacatgaaatgaaaagtctaatgcatgaaccctagaaccacatgaatattaaagctcacactgaagtatctgtgcctccttctcccttgccctgccctttttcagcctcccaaagctgcacccattcctcctgtgtccccaatatcccctatgccatgtgatgtggtttgactctgtgtccccacccaaatctcatctcgaactgtaatccccatgtgtcaaggggggacctggtgggagatggttggatcatgagggtggtttgccccgcgctgttctcaggatagtgagtgagttctcacaagatctgatggttttataaggggctcttctcccttagctttcgcttctctcgcctgcctacttccccttccccatgattgtaagtttcatgagacctccccagccatgtggaactgtgaatcaattaaacctctttcctttataaattactcagtctcgattattctttttttttttttttttttttttgagattgagtctctctctgtcacccaggctggagtgcagtggcaggatctcggctcactgcaacctctgcctcccaggttcaagcaattctcctgcctcagcttcctgagtagcttggattacaggcgcctactactgtgtctggctaatttttgtatttttagtagaggcagagtttcacatgttggccatagttgatcctgatctctcaggagatctgcccaccttggcctcccaaagcacttggattacaggcatgagccttgggtatttctttatagcagtgtgaaaatggactaatacaccatggtaactgggtcccatacatcctgaaaatactaatagaacaaatattcccactcctgaaatttaacttgatcctgaagacgaaggatttccttgagctcataaatggaagtggttcatcttccaggtagagaatgcaaggtagattggttttgttcacaggggtcatgcagagctaagcacatagaaggtgctcagtaagcacctgctgaacatactgaagtgacatagccaggcagagacgggtaggtggacagccaacacgccatgagagctggaagggcgcatcctctcttaggagcttgggccctggccagctgactcagcttcaagctctgctagtacataagtccctcggggcctataagcttggccgtgttgcagctgaaatttctgctgaataaggtcatacatactaagctgagaatgcaatagtgagaatggctccttctttttcgcatcccagaccccagaatagaaatatttaccatcacgtctggatgataatatcaataaattatcagacattgcacgtattaagaaaagctcattttctggaaattgtccttattgtcctaattgggaattatcttgaagccgtggatagaaaatgacctttcagattgctgggacaaagcccaagtctaaattggaaacgtgtttaatggctaagacagcccacttccagattaattatggatgcttttccatttcaagattacattaggaaggaaagttgtcactgggtggaatgtgagtctccactgcatccttttaagataaataagttgaagtttgaagaaaatttgagattacttttggttaagtgaataaaatctgtttagcgaactctttgaagttgtggattgcctgggaatctacaaatctgcaacctccctccctctagatacattcagagggtagaagagaagtcatttaaaaccttatgcttgacttcttgcttcctgccttggtttttaaccaaaactaaaaataaaaaagccaaaagagaggaaacttgataggttcaaaacaggaaattagattgtaagcaaagaaattgtccaaacatcgaaaaaaggaacacatcaaagaagggaggtgctttgtttttatactttgttatcgtcctggaaaaaaatgtctgctgcctctgataatacatattaacacttcttttttacttagcttttatttttatcaaagtaataaaatcatcttgtttaaagtgtcaaatagttctatatggcttattaggataaacaaccatccaattttcaagatttttttttcctttggcatttgtctttaattctctaaatatattcacctgctacttgaggggtcagcagacttttcctgtaaagagcaaaacaatgagtattttaggctttgagagccatagagtctctgttgcagttactcacctctgctgttgtagcacaaaagcagctgtgggcaatatgtaaatgagtgggtgtagctgggtgctgaaaaaactttatctacaaacacaggtggctgcacagtgggctgtcctttaccgtctcctaggctactccttgagtttctgtttttagtcagtcactgttaggtgactcctgactatggaagatgaggattaggctctttcacagccaacaactctcctccatggcctcctcccctccatgtttttcctttaccttcacccttccaataggatggtttactggctttggatagatccgtatgcagtgtttacatcatcatgcttttcataactgaaccatataatagagctgtgtttccagccaggcatggtggttcattcctataatcccagtgctttgggaggcacaggtgagggattgcttgaggccaggagttcaagatcaacctgggcaacatagtgtgagatcctgtctctacaaaaaaaaaaaaaaaagacattaacttggtattatggtgcacacctgtagtcccagctacttgggaggctgaagtgggaggatcacttgagcccaggaattggagactgcagcgagctatgatagcaacactgcactccagcctgggtgaaagaccaaggccctgtctcaaaaaaaaaaaaaaaaaaaaaaaaaaaaaagtttcctttcctacacactattttgttttccttaatcattatattgttttcttcatttgcttaattttttgtgaactaattatgaattgaaactcaagctctctctcaattttaaaatcttccctcaacatattgcagccaatataagaggaactcaccatttcattttcttggaaacttctaccccagagcattctggctggataggccttgggcatctgtattagtctgtcttccttctgctataaagaactacatgagactgggtaatttatgaagaaaagaggtttaattgactcgcagttctgcagggttaacaggaagtctggctaagacgcctcaggaaacttataatcacagcagaaggtgaaggggaagtaagcatgtcttacctctgcaaagcaggagaaagcgagtgagctgggatctgccacatacttttaaaccatcagatctcttgagaacccactcacactatcatgagaacagcaagggagaaatccgcccccatgatccaatcatctcccaccaggaccctcccctgacacatgggattacaattcaaggtgagatttgcgggggggacacagagccaagccgtatcaccatccttgcatctctcttctccatcatcatagataacctgggcctccggatggcatgagatccccctcctacccggcttccatgactttctctttgttgatctagtcccttttttaaaaatggagccatccttctgtagcttcctgagaaagaatgaacgggaatcacattttctgaaacattgcaagtctgaaaatgtctttattctccctcatgcttaattgaaatcagactgaatacagaattctcatttagaaattatttcccttcacaagtttgaaggaatttgtctattgtcaatagtattgctctcaagaaattcaatgccattttcattctcaattctttatttgaactcggtgtttttctctctggaagattttaggttcttattcttctttgttttctgaaatctcatgaatattatttgatgtgggtctattttgactctttctgttggaacacacatggggccttttaatctggaaagccgttcttgaactctaggaatagattttgggggacaatttcttctttcatttcctgttctctcttcccagaatttgttattcagctatcagaccccatggactgatctgttattttcttatattttctttcatttgttcaatttctttggctgttgtttcccctattctctgaacaatgttctcaaatttacatttcataaactctcattgagtttttcacttctttttttatgttctgaatttccaagagctctattttttgttctttgaatgttcctttttttaaatcatctgttctcatttcatgaaagcaatatgttatctctcagaaggtattaatgacggttttctcccaagtgtttcttttcctactcagcctctttttccttcaagtagctttctttggttggttggttggtgtgtgtgtgtgtgtgtgtatatgtgtattttcgtttgtttttcttttttcttctcctgtgtttgagacatgtcctcaaatgcctggttcccctttagctgacacccacatttaagattgaggcactacaaatatgactgaaagttctgtgcacacaaatggggcctgtcacccgtgggcttcagtggctgagttgtttcatcgggaagcccctgatgttgcatcactgagatttttgtcttgggctgattgaaagctccagagaagaattttctgccctgttgcctggagggtagacacctggctgtcactgttctcacagctaagaaggaagaggactgcgaggttcaagattcagtgtgtaaatgttgactgaagatccctgttttcagtacagagcccctgccgtcctatgcctagagtcctccaactgagagtctctgtgtccttcccagagaatacatcgttcctcttctgccagagtgaggggaggacagatgcctggggtagggatctggggatataaatgttcttcacgagcttccagtgagttcttctgtttttagcttcacataaacacacatatccagtggaaactcttgccatcaactgcacaaataatgggcggctttgcagtgccaaccgggctacttctcagcactctccacctcagtgcaagcatctgtccttggatatgctgccacttaagatggttctgctgtttttcagctctaaaaaggttgttatcatcccctgcctcatgatttgttcttacaccttcgtatatcttaacacttcattccccttttcacgggctttatgaagaagcagtggtaaatgtaggtgctcaatccaccatctttaatgggaatccttcagcacttctattttagaaaaaatgtgaagaatatacatagagactgggcatggtagcgcatgccggtaatcccagcaatttgggaggcggaggtgggcagatcacctgagttccggagtttgagatcagcctgggcaacatgacaaaacccacccatctctacaaaaaaaacacaaaaattgcccaggcatcgtggcacacacctgtagtcccagctaatggggatgctgaggcaggagaattgcttgagcctgggagatggaggttgcagtgagctgagatcacaccactgcactctaacctgtttgacagagtgagaccctgtctcaaaaaaaagaatatactaaacactcatttcacaatattcttgacttattaaagctggagtcatggcataatttccaatttgcttttcaaaagaattaattgatcagctaagaaatttacaagtaatttttttcaaatagtgaggtcccttagtattaaaatgaatttcatgttttaatactaggtttttcctcccacgcagtgaattttcttcttgctttaagaagaaatgctctggagagaatataaaattatatatagttgtgtatgaattatatgtcataggattacatataattatatgtaaatataattacaattataacattaatacatgttcactgcagaaaacttggaaaaaaacaaagagtttaagagaaacttcataatcaactgtattctcaacaactacagaaagcttaaccaatgatttgtccgtatccatggctaagaacgaatgtacctacacatctgtgccatttttaaattggcattttttaaaaagtagatccaattttagaagtttgaaatctagtttaaaagcctagattttatttttttccattttaacctatttatgtatttatttatttatttatttatttatttatttatttattatactttaagttctggggtacatgtacggaacgtgcagttttgttacataggtatacacgtgccatggtggtttgctgtacccatcaacctgtcatctacattaggtatttctcctaatgctatccctcccctagccctcccaccccccaataggccccggtgtgtgatgtccccctccctatgtccatgtgttctcattgttcagctcccacctgtgagtgagaacatgcagtgtttggttttctgttcttgggttagtttgctgagaatgatggtttccagcttcatccaagtccctgcaaaggacgtgaactcatccttttttatggctgcatagtgttccatggtgtatatgtgccacattttctttatccattctatcattgatgggcatttgggttggttccaactctttgctattgtgaatagtgccgcaataaacatacatgtgcatgtgtctttatagtagaatgacttataatcctttgggtatatagccagtaatgggattgctgggtcaaatggtatttctggttctagattcttgaggaatctccacaaagcctagattttctagaggaattcttctctatacagggaaacattgcagtaatgagtttaagtgcattgattctttaagcacatttgtttgttgaatgataagactattgtatgtagttcacatccagccccctacacaactgtcacacacaatgaccttcacagtgattcatgcctgaacaacattgtttcctttgcctttaggcttgcaattgggaactcattttatttgaaccaaagccttcagtcgagatgaaaattttcactcacgtctgtgtgaagagaccaccaaacaggctttgtgtgagcaacaaggctgtttatttcacctgggtgcaggcgggctgagtccaaaaagagagtcagcaaagggagatggggtggggccattttataagattcgggtaagtaaaggaaaattacagtcaaaggggggttattcgctggtggcaggagtgggggtcacagggtgctcagtaggggagcttttgagccaggatgagccaggagaaggaatttcacacgataatgtcatcagttaaggcatgaacaggccattttcacttcttttgtggtggaatgtcatgagttaaggcaggaaccggccatctggatgtatacgtgcaggtcacaggggatatgatggcttagccttgggctcagaggcctgacattcctgtcttcttatattagtaagaaaaataaaatgaaatagtggtaaagtgttgggacggcaaaaattttggggggtggtatggagagataatgggcgatgtttcttagggctgcttcgagcgggattaggggcggcatgggaacctagagtgggagagattaagctgaaggaagattttgtggtaaggggtgatattgtggggttgttagaagaaacatttgtagtgtagaattattggtgatggcctggatacgattttgtataaattgaaaaactatacggaataagagaaggagaaaaacaggtattaaaagactaagaattgggaggacctaggacatctaactagagagtgtccaagggggttcagcataattacttacttggttggcaagtttttgggctctatccttgagttttttatgttgtcatacaccaggccagattgatttaggtaaaaacaacactcttcatttaagaatatacagagtcctcctttttcagcagtgagtaagtcaaggcctcagcggttttggaggacaactgcagctaaagagtcaacttgggcctggaggactgataaagtttgtgatatgtctgtgatgctagcagagaagtcattagagaggctacggaaggtcgtgacagaggttgaaatgcctgctattccagtaccgagagcaatagtagaggcagaaagtcctaaaccgacaagcaagggaattagtggaataactcttttttgtcgtgtcggtgtcatgaggggaacagggagctcttcggtcctatttgcaaattgaattttgggggtaaggaagactagtgtgcatgtgcctgtccaattagcaggtagacacatgtaggtagaggatccacagacgaagagaccttgtgcgaggcaaaactggagatgcaaagtaaagagaagcagtgctgaaaggggtgtcttgtacccagactcctaggtatccagctagggtggcagccgtcagaggttgtaatggggattgatgaagtaactgcgtagagggggaggttcgatttacatggtgtgtgagaaaacgttgagtatctacgagcaacctttcactgttattttcggggctgggtataagtaaacaagaagagggctttggagatgaagagtaaaggaacatcgagaaggtgaaagattacctaagggaattccagtaggtctttgctgagagatacataaaggagcggccacaggaatagtagtttgtgttgtgagaggtctaaatatggggggagtagagttgatataaggagaaaggtttttcaagtaagtgtggaggagggtggcagcttgctgatgtgaaatgtctggggaggtcttgctggacctgtctagaaagtaaatgagttcttcaggagggtaaaagtgagggctgttaaaggaagtctggaggtgtagggagacaggaggtgttgcctagtctgcatgtaaggtggggacaactgtgtaggccctggaagaaagggaaatgcaaagccagtggttgtttgctaaggagggattagaaacggctaggagagaatgagtaaggttgatagcgtggtggagatagctggggagaggtagagggtggcagaggaatgggaatgagaataaaagtgagtataaaagtaaagaatagaacttcgtcagggtgaaagtactggagggtcccctgccagcaaagatcatctatccactctaagagggagttaagagttgccagtcctgggcgggggcaaatcctcgagcttgatgtgtagggaagggagggggcctgaataatccctgaagagtagcagaatagcagatggaagaagttacttccttgaggatagatttccacgatggaaagaaaatgagaggttctaagaggcaggctagtggcttgtactatagcatagcctgcctttgctggtgtgtggcgattaggcctggtggaactgccatcaataaaccaagtgtgttcagggtgaggaacaggaaagaaggaaatacggggaaatggggtgaatgtcaagtggatcagagagatacagtcataggggtcaggtgtggtatctggaatactgtgtgaggccggattgaagtctgggccaggaacaatggtaattgtgggagattcaacaaagagtgagtacacctgaaggagccggggagcagaaagtatatgcatcaggtgggagaaagaaaatagatcttggaagttatgagaactgtagacagtgagtttaacacagtttgtgattttttgggcctctaaaagtattaaagcagtggcagcagctgcatgcagacatgagggctaggctaaaacagtaaggtcatagttgtttggacagaaaggctacagggtgctgtcccggctcttgtgtaagaattctgaccgcactaaccatgcctaggaaggaaaggaattgttgttttgtagaagggattggggtttgggagattagccagacacgatcagcagggaaagcacgtgtgtttttatgataattatgctgagacaggtaacagatgaggaagaaatttgggcttgactgaagtaatgggagctgtctgtgaagccttgcggcagtacagcccaggtaatttgctgagcctgatgggtgtgagggtcagtccaagtgaaagcaaagagaggctgggatgaagggtgcaaaggaatagtaaagaaagcatgtttgagatccagaacagaataatgggttgtggagggaagtattgaggataggagagtatatgggtttggcaccacagggtggataggcaaaacaatttggttgataaggcgcagatcctgaactaacctgtaagccttgtctggttttaggacaggtaaaatgggggaattgtaaggggagtttataggctttaaaaggccatgctgtaacaggcaagtgataacagactttaatccttttaaagcatgctgtgggatgggatattggcattgagggggtaagggtgattaggttttaatgggatggtaaggggtgcatgatcggtcgctaaggagggagtagtggtgtcctatacttgtgggttaaggtggggagatacaagtgggggggatgtgaaggaggcgttgaactgggggaaaaggtggcaatgaggtgtggctgtagcccaggaatagtcagggaagcagataatttagttaaagtgtctcggcctaataagggaactgggcaggttggggataactaaaaaggagtgcttaaaagagtattgtctaagttggcaccagagttggggagttttaagaggtttagaagcctggccatcaatacccacaacagttacggaggcaagggaaacaggcccttgaaaagaaggtaatgtggagtgggtagcctccatattgattaagaaggggacagacttgctctccactgtgagaattaccagaagatcggcatccgtgatagtctagggggcttccgaggtgatcgggcagcgtccgtcttcagccactaagccaagaagatctgggaaggagtcagagagccttaggccagagttccaggggctctgggagtggctgccaggtgagttgaacagtccgattttcagtggggtcccgcacagatgggacatggcttaggaggaatcctgggctgcgggcattccttggcccagtggccagatttccagcacttgtagcaagctcccgggggagaaggttctggaggaatccctggcagctgcagttcaggcgtttggagttcttgtgtgctggagatatggctggggtttgtctcacagtggaggcaaggaattgcaactcagaaatacattgctacttggctgcctctactctattattgtacaccttgaaggcaaggttaattaagtcctgttgtggggtctgagcaccggaatttaatttttggagtttatttaatgtcgggagcagattgggtaataaaatgtatattgagaataagacggccttttgaccttttagggtctagggctataaagcgtctcagggttgctgccaaacaagccatgaactggactgggtttttatatttgatgaaaaagagcctaaatgctatctgatttgggataaggaaaaggagcattaaccttgactatgcctttagctccagccacctttttaagaggaaattgctgggcaggttggggagagcttgtcactgaacgaaactgtaagccggactgggtgtgaggaggggagatgataaaaggattgtagggtggaggagtggaggctgaggaagaattggaacctagctcgacctggcaaggaggggagaggtcagatgggtctgtagaaaaggaagattagaaagactcagcgacacttggggttgggactaaggggacaggtgggagggaaagaaggaagatttgggacaagttgcattgggaacagagactagggagggaccgatgtgtaaaagagtgcctggatgtcaggcacctcagaccatttgcctattttatgacaagaattatttagatcttgtaggatggaaaaattgaaagtgccattttctggctatttggaaccactgtcaagtttgtactggggtcaagcggcattgcagaagaaaataaggcatttaggttttaggtcaggtgtgagttgaagaggttttaggtttttaagaacacaggctaagggagaagaagggggaatggagggtggaagcttgcccatagtgaaggaggcaagcccagagaaaagagcaagtagagacatggagagaaggggtcggggggttcttgccccctagaaaagcggtacttgccgctgagggtgaaggagaaggagttggggggttcttgccccccagaaaagcagagaaggggtagagacatggagagaaggggttagggggttcttgccctccagaaaagcggtacttgccactaagggtgaaggaccaaggcaggcgtccccgtgtggtcagatgcctctgaaatgtgggtgaataatcaggcaggcgtccccatgtgattaaacaccaagggaagactgtcttccccagtccgtgaccggtgccggagttttgggtccacagataaaacgtgtctccttcgtctctaccagaaaaggaaaggaactgaaattaagagaagggagagattgaagtgtggcaccaagattgaaaggagaaagaggttgagggatagtgagagaggttggagaagagagtaaaaagaggccgcttactggatttaaaattggtgagatgttccttgggctggttggtctgaggaccagaggtcgtaggtggatctttctcacagaccaaagagcaggaggacaggggattgatctcctaaggaagatcccctgattcgagtcacagcaccaaatttcacttgcgtccatgtgaagagaccaccaaacaggctttgtgtgagcaacaaggctgtttatttcacctgggtgcaggcaggctgagtccaaaaagagagtcagcaaagggagataggggtgaggccgttttataagatttgggtaggtaaaggaaaattacagtcaaaggggggttgttctctggcgggcaggagtgggggtcacagggtgctcagtaggggagcttttgagccaggatgagccaggagaaggaatttcacaagataatgtcatcagttaaggcaggaacaggccattttcacttcttttgtagtggaatgtcatgagttaaggcaggaaccggccatctggatgtgtacatgcaggtcacaggaaatgatggcttagcttgggctcagaggcctgacaaaaatgttgttaattgctctggttatagacagaatagtagcaggaataaataatcagaaacatttatggattatatctttgttgatattttaaacctatcagttacctttctagcctaatgagaatgccttgataaagccacattcttggaaattttggttttcataaatgtgcttgggttttataagtcctgctttgcctaccacttgaccaaattccctacagacttttttatataaacacctatggttaagacaaaatgtgttctttcaacaatgtacagcttctgagagtaatgtctaggctggagtatattcatatatattatttatgctttcatttaacaaacacatgctgagatcctactttttgccggacttagtactgattgctctctcctgagcatccttcttaagtcaaagagaatattcattgttagggaaggaaaaaaagatagagggaaaaaaaatagatggcaagaacatggcaggaacccagtcctgaacacccaggggttttcagaataagggagaggttaacaatctacatagagcaactgggattaaaaatgggaagctggcttcatggggggaggaatagcattaggagatatacctaatgtaaatgacaagttaatgggtgcagcacaccaacatagcacatgtatacatatgtaacaaacctgcacgttgtgcacatgtaccttagaacttaaagtataataaaaatatattaaaaaaaaaagaaatgggaagctggctgccaagactgcaggaagactgtgtcagattcagagcatgaccatcagcaaggtaaatccctactgcccacagtcataattggcaccagactctaggaaggaattatatatttacgtggtgcctaatggggatgtgaggatctcagagggagaaaactaggtaggcacaaataatacccgcacaggccttatttacacctattttatgcaaagttctaatagaaatcattaactggtttcctagcccttgcaagatccaacacaaattagtagaatgttctagaaggaatagaagtaaaaatatcaatcacagtaagaacaggcagctagatgcatattggcaagagggcagataaatagaaagatgtgagaagtcaaaaatcctattgcgatctcattttgcagggaaccaaagatcccaaatagctctctctggaggcaccagtgtatatattattaaagactcagcgagaaaagacaattcactttaagacagcaaataaacaaataaacaatgtggagctgccattcccaatccatttatctggaatagttcagcctcatttggcaatctgtattttttctgaagccccacggggtcattaaaaactccataggtcccaaatgtatttgcataatgatagatgccatccccctgcctgacagtaaagaagcagcaatttaaaaagtatgatgccagccaggcacagtggctctcgcctgtaatcccagcactttgggaggccgaggtgggcagatcacctgaggtcaggagtttgagaccatcctgaccaacatggtgaaactctgtctctacaaaaaatacagaattagccaggcgtggtggcacatgccagtaatcccagctactcgggagactgaggcaggagaattacttgaacccaggaggcagagtttgcaatgggctgagatcatgccattgcacttcagcctgggcaacaagaatgaaactccatctcaaaaaaaaaaaattcatggtattattcttttgaggaagcatactagaaatcaagaatcaggccaagtgctgaggctcatgcctgtaatcctaatgctttggaaggctgagatgggagggctacttgaggccaggagttcaagatcagcctgggcaggacagcaagactccagtctccaaaaaaatatttttaattaaaaaaggaccagtcttattaaagtaaactgcagtcctgttactgatcttagtatcaaagcaatgttagagcccacgtgggattcacacctcctagagttcacagcacaagtttgctgtaacagtagataaggtcttggttgccctgagctcatttcttttttttttttagacggagtcttgctctttcgcccaggctgaagtgcagtggtgcgatctcggctcactgcaagctccgcctcccgggttcatgccattgtcctgcctcagcctcctgagtagctggaactacaggcaccacgcccggctaattttttgtatttttagtagagacggggattcaccatggtctcaatctcctgacctcgtgatccgcctaactcggcctcccaaagtgctgggattacaggcgtgagcctccgtgcccggccctgccctgagctcatttctaaatccatcttcctccaaggtggtggcaagcatgcttctttatcccggagagatggccctttcatcaaagtctcattcagacccttctccttttggaatgcttttcttgggaggttggctgggatgcctactactcttgaggatctgcctctgatagagcctagatcttagaatcaggagagtttcttgcaggcccatcagttactgtgaaagatacctgagctagttggctcacaatccacatccatcaaaccgccccctgcagagaagtcacccggctgtcgcctgcttggcttgccctgcctctcgccattctcatttcattagcaatgcgaatgttcacacccttcaatgtgcatatgatgggtgttaatgagcataacacatctgtgaagcgtgtgtgatttttttgcctaataaataggcagtaaacaagaggaagggaagagctactatctgggggcatctgagaaaacaaaaagcaagcaaggtatgagtcagattgattgttcagtgaatcccaaagggccaaaaacttcctaaactggttttggtgtttctcactaggtgtttggacagcttggaacctggatagtcccacctacccaaaagcattcaaattaggcatgcttttaacaaagcaggtggcatggcatgtaaattgtaggaacactgttaacctttgcaaatgagtttcgtggtccgaatggataattacatatttccctccattaggagctacaaactcatcaagattctacaaccaaccggctcttgagtttcaatctccatgtgacaaggggatttattatgagagggcagagagaaaagaggaacaccgctctctttctctgcaatggaatgatggtcagaaaagaacagatcaaaggaataaacctgctctcctattaactcagcttaccaattctggcctacattttcaaagttatcagtaatcaaaacattgggaaaggaattacaacctcttctcctgaaagtttaacaacttccccatgaagcactgcttttgattgcattacaagctattcctgaagaatttatgacctaagatactctttgtcaatgtaggccatttgtccatgagtggagtgactgataaatcagctattaacatagataagaaagcatatcgattgagtcaactttgtgtttaataatatgctagacagtaatgatgcctggaaaatacactctgtaattaagtacttttccctttatatttcatgaagactcttgtatattttattctggcaaaatagattgtgactaacatctcatagaaaagatcatcatattgtgatcctatatctttatcataaaagtgaatttgagggaaatttttataatttttcaatataaaaattattaagatatcaaaactctttgttttttcactactccaaggtttatttcatcatcttaaaaaccttgtgaatacaatcagtctgctaggtcaggggtcaccaacctagggccatggacacctaccgtggcctgttaggaaccaggccacacagcaggaggtgaatggcagacacgcaattgaagcttcatatgtgtttacaactgctccccatggctcgcattaccacctgagctccaccttctgtcagctcggcagcaacactagattctcataggagcacaaacccgattgtgtactgtgcatgcgagggatctaggttgcacactccttatgagaatctaatgcttgatgatctgtcagtatctcccatcacccctgagatgggaccatctagttgcaggataacaagctcagggctccccttgattctgcattatagtaagttgtatagttatttcattatatattacaatgtaataataataatagaaataaagtgcataataaatgcaatgtgcttgaatcatcccaaaaccatcccctactcccctagtccacggaaaagctgtcttctgcaagactggtccctggtgccaaaaagattgcagaccactctgctaggtagaactgcattcttgtgattatgtattttaatgagcgcatttccttttcatatggagaagggaaccacattgccttaattccccaacttctgccccaaagctttctaggccaatatggctgcattcgagttgctgatggctgtgctaccctcccagggctgatgtacagtttcctgcctgggccgtgtcaccaatcactagggtttaggaggctatagtcagatcttgcagaatatgtcagtctcattctctgtagaattttttgtttgcctgtttttttcttctctttggcactggactatgggcagtggcagttagtggtagatccagggtggagagctgagacctaacaaagaatttttttttctttttttttttttttttttttttttgagatggggtctccataggtcacccaggttggagtgcagtggctcaatctccactcatggcaccctccgcctcctgggttcaagtgattctcatgcctcagccacccaagtagctgggattacaagcatgcaccaccatacccggctaatttttgtatttttagtagagatggggtttcatcatgttggccaggctggtctcaaactcctgacctcaggtgatccgcccgcctccgccttccaaagtgctgggattacaggcgtgagccaccacacccagccaacaaagaatttttaggttcccactattccaccccacctgtgctagaccctgtggtgacaacaaaggtgaaacagacatgctgactgtcattaaaacactgacaatctaaactaagaaagatgaaaaaaattaattgaatacccagtggaaagtaagaaggaatagttttaacctccttaaaatgcttttgattgcattataaactattcctgaagacttaatgatccaagatactacttgtcaatgtaggctattcgtcaatgagtggagagactggtaaattggcagttcatgtgatacatacgctttcagagtaaagagaggtttcttctaataatgagaggagcgcctggccagagagacccaggaaacatatgcaaatactagaaatagccccaagtagcaagtgtggctatagatggtacacgtgaaggagagtagtggggttagaccgtgaagccacgaagaaccaggttaaggaatttagacttttatttggtaggcagtggagagatgttgaatttttttttcaaacagtggagtacagtgaggaaggcaggagactttgcagaaggaaatcaggaattccaaccaatgtgttgagtgtaggattctaaatccagcacaaaaaaaccttcaaagcagcagggaaagggtttggctctgattcagcctcagtggttatactgttgccatcagggagctgggcttgggggtggacagaggctggtggcagagggagggatggagggacagagctgagtttttccaaagcagaagaagacggttttgcaacctagcacaccatctgggtcagatttatcaaacaagattatttgttgacagaccatggttatttcccatttaaaggaagcaatacatatattgtatccaaaatggctccccaaaagcagcgttgagctgatgcaaaagatcagtccattctcccagcaaaagagcagtctcttgacatcccaggtaggagggattcatgtatttcacaaaatgtgtccaatgcaatcatcaggcaaataatattttaatgttttcttgacatgctgagagtaaacttgcttcgatgcactgtctccttctaggcacattactctggagtaaaagaagagaggaaagagacagaggaaagaaaaaatatgtaatcacatatgaactgcaaaagaattctagctgaggttcttagaactataaattcttctttttttttttttttctgagacggattctcgctctgtcacccaggctagagtgtggagtgcaatggcgtgatctcagctcactgcaacctccacctcccaggttcaagagattctcatgcctcagcacccgtccccctcccccaccccaactagctgggattacaggcgcacaccactgcgtctggctaattttttgtatttttagtagaaatggaggtttcaccatgtcggccaggctgctctcgaactcctaacctcaggggatccgcccaccttggcctcccaaagtgctagtattataggcgtgagccaccgcacccagccaagaactgtaaattcttaaaatttgggaggaaccatcaagaaagaaagcctaagccttgtaaccatatgccaacctacattggtctactccctctgccacgctaggcatttcacactctcgtacactctgagggaaactcgagaaacaagtgtaataagaaatattcccgctagagcatggcagccataagctaccaaatttttgttataaaatagaaatatacttctagatgtaaacatgtatatgcttatatctaacctctctaggataacttttgtaagtggattttaatataactaaaactggatgctaaagaaatagccctctcttaaagttgtacttgggcacgtctaggatcaaaaagttaatagttttgtctgtgatcaaggagttaattttttgctgcaatatgtttacatctaacattcttttgagctatccacaatctggttatatatcagtttatccaaccttatttctcctttcctacttcaaagacctccattcaagccgttctccaagctcttgcctaaataagtagttttgttttgttttgttttgttgttttttggggttttttttttttttcaaattttttcctcacttctaagtttcattcagggactacctttccccacttcccctcatcattctctttttctaaaatctatccatccttcaaagcccaggttgaaatttgtcctcttcctgaaatcgccccaaaaatgtgccaaatcattcagatctctgccatctctgagtcttataaatcaaattcttagtggcattcatttgactaagaataataaatacatcactattgttataatcaccataatacctggtgctgttgttagatgctttacctatgttacctcttatccagacaatcctgtcctatcacccccattttacgtgagaagaaaccgaggttcataaaggttaaataactagtccaagttcacatagctagcaagtgacagtcataatagtggttcagacccagaaccgactggcttaaaaatccatggtccttcttctgtgccatatggcttcccaattatggatttcttttttttttttttttttttttttttttcagattgtgatttaggtttattcttttttttttatacttaaagttttaggatttcttacattactttttaacaaacgtattttgtgcatgattctaagaggtagtacactttttttttttaattgtttgcctcattttcccaccatgcctacttttcactttgctgaacccgtatagagtgtctggttaatgttagagaaattgaattgaattcctgacatttgggcccttttcttgagttcctcttctttgtccatagatgaatcatcccattacatctaactccgttggacagcttgcttcttcctcaattgtatgtgaatagttttcaatccactttactaaaatctaatagtcaccatctgtgtctgctatataaatgtgaactcttgaaaacactaacatttgtgggtcagaaattagaggacagtaaaataaaccactggaactgtgaagagggaggaggcgtgaagaggcactcccctctctgctgtctgtgggtcaacctttccggcctgcctgtttctcaaactgagtgagacttgtctctgaagccccattttttttttttttttttttttgagacggagtttcactcttgcccaggctggagtgcagtggtacaatctcggctcactgcaacctccacctcctgggttcaagtgattctcctgcctcagcctcccgagtagctgggattataggtgcacaccaccacactccactaattttttgtatttttagtaaagacggggttttgccatgttggccaggctggtctcgaactcctgacctcaggtgatccacccacttcggccccccaaagtgctaggattacagacatgagccaccacacctggcctctgaaaccccatttaattttccaaatgaaggtgatgtgtcccaggcatcatacataggcaagaacccacaaagtggcagaggagcaggagcaaaggggcctgggcaccccctggaaagtcatcatacagctttactcaactgtcaccttctcctggccttccttgaccactgtttttaattgcaaatcccactgcatgatgccctatccctcttccctgacttattcttctccataactcacattttcaaagcattctatgcatttcaccaaattgtttgtggcccttctcctcccaccagaatgtaatttcaagagagtagggatctgaggtcgggcgcagcggctcatgcctgtaatctcaacactttaggaggccaaggcggttgggtcatttgaggtcaggagttcgagaccagcctggccaacatggcaaaaccccatctctattaaaaatacaaaaattagctgggcatggtggcgggtgcctgtaatcccagctacccaggaggctgaggcaggagaatcacttgaacctgggatgtggttgcaatgagccaagatcgtgccactgcactccagcttgggtgacagagtaagactccatctcaaaaaaaaaaaaagagtagggatttgggtctgttttgtactatgctagatacccagcacccataacagtgtcagacacataggacatgtattgaatgaatgaactgatttataagcagaatatttaagactgttgagaagccatacccattctaatcaggcagagcagaaggttaaaaatccacaacgcttacttttgagttgtgttgaaaccattgaaaatatctgtgtcaaactgattaattacctcggtttacagaatcagctttttaacatacatagcaaattctatatgctagccaatggcaagccagatctcaagcaaggccattcttgtaaaataaatggacagatttttgtcttttctattgtataagattctaaagccttgaaagcagtaatatagaatctccttaaatacaaatttaagcatcttttcacgtttatggcctcagtgcctgtttataaaagtagttttgtaagaaaaacagtgtaagaaaaacatctaagagtagatgataaagacctatccttgtgtgaccttcagatggaaaagcatagatttaatctgagattccagaacccacctagtttttaacttcatttgtttgtctaacttaagaacgtgagtcacaactaacaaagaccatctggtgctgttcttccctcctaggagaatgtctccagaagtaaataaaggagaatcttgtccatgcaagctactctcagttccaatagaaaaccatttcagcatctaattcagagagttgcacaggagatggccaaaggcactatctgccatatgtctgcgtctccagcccagccatgaccccaaaccaatagatttatttttaggtagtatcatgtaaacatagaactttttaaactagcaagttggggaaacttcatgattagtcaatctgctagcacatagcagaagctggtgggtgccttcccagcagccagctcctctttctcctacctcatagcaccccagttattttcaggcatctaccctcctccacacagccaagaacttcagggaggctatttccttccccaggcccaaggagcacagcgtggaaggggaaagagagaggttcatggacggctctaccatgatgccatgtgtctgctagtaaacttctactgactgactgagcatgccccaggtgaaataccctccagtacctccttctgtttttggacttacctgttgtctttctccaacctggagactctcaacccttactgcaaattactgccacgtggggagcttttaaaaacctgcagacacccaagtgcacccaagagagcctgtttcaatggacctatgcaaacaggtttttttttttcattaagttctctgggtgattgtaatgtacagccaacaatgagaaatgttatactaattccattactttgaccctgtctttgagatgctttgggagagcttggcgctcaggaccatctttggggatcttttccatcatccagagggaagctggatcttagagtctggcctctcggttatgggtcctgatgttttttcattgtgtatggtttccatgatctgtcctctgcaataaaacagacattgctttctatatgtaattctactcatccttttggggtctctcttcgttaccatctgcccttccatcttgccatctcactcctcactcccatgattctggaccaaactaaccagcattcctaatctagtctcttcttgaaaggatttgaaacggggaagcagctcttcaggaaagaaaataaatagagcaaatgggccgggcatggtggctcacgcctgtaatcccagcactttcggaggccaaggcgggcggatcatgaggtcaggagatcgagaccatcttggccaacacggtgaaaccccgtctctactaaaaatacaaaaattagccgggcatggtggtgggcacctgtagtcccagctactcgggaggctgaggcaggagaatggcgtgaatcagggagatggagcttgcagtgagccgagatcgtgccactgctctccagcctgagcgacagagcgagaccccgtctcaaaaaaaaaaaaaaaatagagcaaatggaatgaagaacctctgtagggctgtgttgatttaaggcagatgtgggccacagttttggtgttcacacccaggtaaacaaggcagcttccttctgctcatacacgtgctcccctctggaagagccaggtttgcaacgggctcgcagtggctttctcatcctggcagcatccagtttcttgtggacgttgctgcatcccaaccacctagcagattacacgaaggagtgaaatacctaccactgaaaagaatgaacccacagagaagggtggcctcactgctcccaggggctgctgcagtggcccgtgggcagctagactggcctgcaggggactgaccctggtggacgcctgagtctatgtgccaccatctaccctgtgataagtgtagctccgacatgatgtacctttgcctgttgatttccaaggacaattattttagcatttcaaaattcagctcaagtgctggacgacttctccctgagttttgctgtttgccagcagcctcctcttggcatgctccctttccaacatcctcactgaacttgttactattaccaccatgtacttagagaatgcaactatcaagtgctattgaacacaccttgttttgtaaaaaccctgttgtaaattgcctccttattcctctgttccatggccagtcaaatcacaccctcatgtaaatagtgacaaagacatattacccaacttcaaattccagacacctgagtcacaggtgttgttaccactaccccaaaccacaaagtgggattatgtgtctcctagaaccgtattataatagacactcactgtcttgcaaattgctcctaacttgggtagaatattttgtatttattacttttgaaaatctatgggtttctattgcctggaaactcaaggattacagcagaattagagaatctggtctctggatcacagatccccccactgccctgcaccgcccccacccctttctcatggagacctaatcatctccacactggatccactcacatggatcttctgaccttgatccagagtttacaggtaaaatgtccacctgaggacactggtttctgttttgacaaaggtagttagggccttggaaagttgtgaaggaatggcatatctcccagaaccctgacttccatcagcatcttattccaggagctctgaggaaacctctaaggcacaagtgtggaaataaagaccacccagatgagaacacgcagaggctatttattcagagcttgctgtagcaagagagtcagccatcgtcacttgtgcctggcagagactctgaggcaagcggggagtgggaaagctttcaggtggagagaggggaaggctggggtgtgccggggctggagcttgttggcccgggaaagctggaggagggctgcctgacacaggaggcatcctgtgtgattggtgaggggattatatttggctccctctggttggcctaaagttggcagcagggacaaaattagggaatctggtatcaattgatcatttggggccagcttcctggaatgtctgctgcagattgtgggtcagcgtgctgttgtcgcatatggccaagctgttgtctgtctgtagattccatctcttggtgttcaataggccttggggccatgaacttgtagggagggttttctcaagacctgggttatggaaccagcattgaggttcacagaactcacatccaccctcaaatcagggctgggtcacagacagtttattcaagtgctccaggcacctgtcccagggtcattctccctagaaagacccaaacaagctgggcgcggtggctcacacctgtaatcccagcactgtgggaggccgaggcgggtggatcacaagttcaggagtttgagaccagcctgaccaacatggtgaaatggtgaaaccccatctctactaaaaatacaaaaattagccgggcatggtggcgcacacctgtaatcccagctactcaggaggttgaggcaggagaattgcttgaatctgggaggcggagcttgcagtgagccgagattgtgccactgtactccagcctaagcgacagagcaagactctgtctggaaaaaaaaaaaaaaaaaaaaaaaaggcccaaaccatcccagggaattcagttcaagccacttctccctcactgtgttctccatgctgctgcctggggctgctggccccctccctgtctgcaacggactctgacccctggaccaggacacccagcaggctccccaggaccacagattctgtctgaccttggggattctctggtgtttctgaaaattgctgaaagcttccagtggccattgctatgttatttgctagtcggctaaaaagttaaactccatttttatatggtctagattagaagagaggaagaaacactccagaggcatcagaggctcaagaaaatgcctagaatgaagttcagaccatcaagaagtccccggtggctcaggcacattcactgtttgttcattcctctgacagtcacggacagccccctgtggacaaggcatggtggcgggctggggacagtcttctactaggaggatggggaagacctgagaacagtgcaggaacagaaggaacaaatgtgcgggctgtgggtcacagtataataggaacacaggacagaggctgaagatggccccaggatttgagttacgaggccagtgctgtgctattagcaaccaaggggacctggaaaggattggaaggggaaggtcttgaggagaggctcctggtaggttttttctgatcaatagtcccaagggtcaaaaatatcaacagtgacagtcagtgctgggatcattctccctcacagatctgaacccttgagtatgttgattttaatgacagggacgttctttatccagccttatgcctgaccaactctgattcatccttcaagtgaggagatatctcttcaccctcgaagctttccctgatgcacaccccccgggccagggcctgccccagagctccccactgccaccatcacttccccagtgcaggcccttacccccgtctggcctgttgggcttattgactgaggcccccaccctccccagccagcagcatgcctgccccacaaagctatccagcaaatacagattgagacacaaatggatgaaagacatggaaggaatgtatggatggaatggagggatggagtggacacatggaatggatggatagatggagtggatggatggagtggatgggtagaatggatggatggagtggatggatggagtggacggatggagtggacagatggaatgggtggatggagtggatggatggaatggatggatggaatggatggatggaatggatcgatggagtggacggatggatgtaatggatcaatggagtggatggatggagcagacagatggagcagatggatagagtgaacagatggaatggatggatggagtggacagatggaatggatggatagatggagtggacggatagagtggagggatggagtggacagatggatggagtggacggatggagcagacgggtggagcagagggatggagtggatggatgaagtggacggatggagtggatggatggatggagtggatggatggagtggatggatggaatggatagatggagtgcacggatggatagagtggatggatggagtggatggatggagtggacggatgaagtggacggatggaatggacacatggagtggacggacggagtggacggatggaatggatggatggatggatggagtagatggagtggatggagtggacggatggagtgggtgaagtggatggagggaatggatggatggatggatggatggagtggacggatggaatggacagatggagttgatggatggaatggatggatggatggatggagtggagtggacagatggaatggacggatagaatggatggatggaatggatggacggatggagtggctggatggaatggatggatggaatggacggatggagtggatggatggaatggacggatggaattggatggagtggatggatagagtggatggatagagtagatggatggaatgaacgcatggaatgaatggatggaatggacagatggatggagtggatggatggaatggacggatgggatggatggagtggatggatggatagatggagtggacggatggaatggacagatggagtcaatggatgggatgggtggatggatggatggagtggacagatggaatggacggatggaatggatggatggaatggatggacggatggagtggatggatggaatggatggatggagtggatggatggaacagatggatggaatggatggatggatggagtggacggatggagtggatggatggagtggatggatggagtggacgcatggaatggacggatggaatggacggatggaatggatggatggagtggagggatggagtggatggagtggacggatggagtggatggatggaatggatggatgggatggatggagtggacgtatggaatggatggatggatggatggatagatggagtggacggatggaatggacagatggagttgatggatggatggatggatggaatggatggacggatggagtggatggatggaatggacggatggagtggatggatggaatggatggatggaatggatggatggaatggacggatggagtcgatggatggagtggatggatggaatggacggatggagtggatggatggagtggatggatggaatggacggatggagtggatggatggagtggacggatggattggatggatggagtggatggatggaacggacggatggattggatggatggaatggacagatggagtggatggatagaatggcctcctctttgtctaaaacccccagtagctacgaattcccccaacaactactacacactgccctgcacatgatcacgttcggtaagttgtgtgagagggcaggagggagaaaatggagctgcctgcctgcctcacgagcacctttcaccattttgatcacatttccagatgcagcaccaccctctgctctcacttctttcctcccagaccagggaagcattggatggtggttcatgaggtgctggaggagctaaagaaattgctgtcatcgttttgtcaaatccagggcctttatgttttaaaatagatatacaaagagatcacattttacctggtaaaatcatgacaaactgagcggacaaaaaaaaaaaaaaaacctataaacatttggcacaacagagcaaaaatcataattcctataattatttttaaactgtgaaactattgtagagcattgaatagatgtatattaaagccatgtatgctttatttgcttatgacatgaaattctggtttctgtgtgttccaccttcctattttattcttaggataataggatatgatgtgatgctttactcatagttagagggagaattgactgtgaatgagcagttcagagagaaaggatcttgggcttggcaagggcaggggcctccagcgttttgagaaaaatgaattgagcctcagcttattttataaaaatcttgacccagagcgtggcccttctgaactcccaccatgtttatgcatggtaatatattaaaaattggacttagctagtagccaaatacagtgctgtgttctggatactaaaacaaactaattctccctgctaagtaagaaaaatttcacacattatcgtcagtcagacatggaaagaggttctccaggggaagagagagaagcaacatcattcatgtgatttaaaattacaccaggccatccatttatctgcctctcaggctgtttgtccttttttgaacgatgcttcagggctccacgctggaaacggggagggtggatgtagaacagcttgtcaatgtaatcattttactataaatctgcaaaaaaagaaacagagcctaaaccaagtataaaataggatcacagaacctcctatgagcaactttgtaagattatcctttctagtgtgagtactaccacaataaacatgatgacatatcctttatcactatgttgcccaaagattttttttcagatttcagtggactcctcccctgccactcttaacagccctgctcctccaaacatagctgtatggagagagatgtccatcacagggatgtttatacaaaaacatcaaaacactcattttttcaggctggaaacggtggctcacccccgtaatcccaacactttgggaggacaaggtaggtggatcacctgaggtcaggagttcgagaccagcctggccgacatggcaaaaccccgtctctactaaaaatacaaaaattagccaggcatggtggcacacgcctgtaatcccagctactcgggaggctgaggtgggagaatcacttgaacctgggaggcagaggttgcggtgagccgagattgcgcgactgtgctccatcctgggtgacagatcagattccatctcaggaaaggaaaaaaaaaacactcattttttaggtgaagttaattgactgggaggactttatggaacattttggttcttttcctactgctgaaatttgaatagaaaggcatgaggtaacctcatgccatcactacgaaaggctaccagaaatgatagaaaacctcacacagtatcagctacattggtggagtccacctgaatcccagaaattcagttcaacaatgtcactgagttcaccagactactgggaaagggattcatgtagagacagttgtaaaaatattgaccctaacagagaaagattcactgcagtcagaagagatgccacgaagtcaggtctcaactcctggagaggctctttctgtgctgtgcaaaaatgtatgtttatccgacttcccaggccttgaggtacagcaaggaatgccagtgttggatgttctacaagtgaggacactggagcctcaagaaataatctgacttgcacaactcctgtcactgattagtggctaaggacatcctgatttctgctccagaactttccccatgacatcagtcttcccatccttgaagagttttcagttattcttagcgtgacaagtgattgctagagtttgtgtaattttcatcataatgggactaatgacccacaacagcagttctagtgacttccagaagatgttgtacatccccatcctaatgaatggcagcagcatgacttacgttcttttatcagagagtctagtttgatctgagttgtgtctgacctggaattcaggcatgtctggggctaggaaggttttgggttcgaggaggctgttttcatgagggatcccagggtctcttgggaaggaattcactcaagggaggacagaggcaagagaagcacagttcactctcggggctgaaggcagcatgggttttaggtgcagcctggtgacagtcaatcgggtggcctaccatgtagtgattaagactttggaaaagcaggctataagcaaaaatctaaatttgctacacaataacttggcaagacaatggagcagtggctggcaccatggaccttggtaagaaacactagaaaagttaggaaaaggggtttttccaggtcagagagagccagtgcatgctggtggacccacagttctgtagctatgagaaatagccccatctggttgtgcaggaaccacaggctgcactagctgctttagttgtgaccgcagaaagcaccctgccccagcatggagcaccagggcctgcacacctttgccaggccccagaagcactgccactgccatgatacccaagaagagagagattagcaagtgctttgtaccagaggggagggctgcccatgcaaaggcctgcctgggggaactccagcaatcattgggggagactttgggagagtggagagaaggggcctcctgaaaagacacagccaggggaaacctactttcatgatatcaagactctaattttagagggcagtgtttgcagatcctaccaatgactctttgtccttgagtctgtgtttgaggtggaaccactcaaagacggggaagatgaggcacctggagccaggcgcctggtctttgtgtctgcacttagccaaattccctctcagctgtattgtgtctggaggaaatagaagcatgactaagctgatttgtattctgccaaccaagggaaaatataattaacacggcagcaagactcagcaaaccccatgggaaagtccaagaaggaaagagctcccgtggctcaagatgatgtcagaggcaaagagaggccaacccactctaatcccacagcaggtctcctctctaatacctcaactcataaagggaaaagacaatgaaatccaggcctgccatgcctttgaaaagaacacacagcctctaggagtgattgcagggattgagcagactgtgatgggggttttctcatgatgggagtctcctgctgttgctgagtgctgccaatcactgcccacacctccagcagggaggtgacttcctcaggctctgctactccacatcaactgattaacgcagctgtgatagcacacctagcagagacaagagactcccagacactaggcaggagtgagaccaactgctgtatcagatatacacctagcttataattacgtgtcaagagaaggaagattaggcagacatcagtaaccgcaagaactgaaatgtgatggctggtatccatcttcagcctgctccccagctaatcatcccctaaaagaaatgcgggagaaagctgcctcctaatacatttcattggcccttcatctccgtctgctgactcacatttgaatttagagacaatttgctaaactttctagatttttatttacttaacattgccttagcctttttgatatattcaactatagtattctccaggtttaaatattgtacgttttttttcacaactttaacaaattagtgctcagttctcctggcttgaaattcccatatctttcatgaagctgttgaaactaaaaggcttaggaggaaggtcacccacctccctcattctccttcccttcttgcccagaggaatttatgtctgtcttcctgccccaatatctacatatccagccatgactacattgtttggtttaagtaactgcctctcattacagaactagattcatttattcattcattctacaaaaacttgaagaacatttatgctggatttgaatccagtgtcagaattgtctttgattggttctatcttatttcatagatttggggtttgaatttaatagctaagcatataaatataattttatgcaagatagcaccttaattctagtccttatttaatacaaatagtgatataatgaaatgatatagttttatctagtttcatctagagaaatatggaaggaaaaatacaaatagttaaaaaaaggaggaaggctgaaaatatatagcagttgatatgcttctcagagtcatcttttactaatcagtagcagtggtgatggtcttttaaaaaaaaaaagtttcggttgcttttaaaaagagatttccagtgggaagcctgtgagtactgactggctcctgtctaacctacacttcctgtttggttgatgaaaaagaaaaaaaaaaaagccaaaactaaaaggtacattccagaacaagtagtcattttaacaactggcggagccaagaaaatgcgatctagtttccctctgtcccccagtctagagccattattaaataatttaatgccatagaacttatatcaaaaatagacacattccttaggaaacatttgaaacttactggttttgaccttaaaatgtaatcattcatgaagagatcaatctttcatatgttttcaaatatgaaacactcaagtccattgtcagaatcccaatagtgtggaaagaaacctaccagggcaggcttatctctgctcattctttgctaaaatatccattgcatttgctaactgtgaaacgatgggtaggttacttcacttctctgagcattgaagatgccctgtctacaaaggataacagtctctctcccaggggtagctgtaattgtgaaattaggcaacatatataggaaggtgcctaatggagtggcaatcatttattcattcattcccgaaatatttatcgattggccacaatgcccaggcacagagcaaggtgctagtgatatcaacacgggggacacttcacatttccccccattcctccctaacggtgcagcagacaccccactaaagctgaggaggcccctgctgctccccctccctctctgctccctgagtctgtgagaggcatcgctccagcctcccaagaaagccctccccctgcacatccaagcagctccctcttatcctgatgccctgacccgcctgcccacaaggagcctcctccctgagccgggaggactttccttctctcctatgacaagccctggccctaggcagctgaaaacaatcacccaggaagctccttcaccgtcagattccctgacagccctggatctagcgagaatcaggtgatttcgatgtgaaacgaggtttgggaaccactgctttcagtcacattctttttgtttgatcttctcagaatcagcaggcatttccctctgctactttgtccaagatccaacccttctcatctgcgtcttgccagtctctccactttagagctttgttaccagctacttctaacctcttgcacagaaatctctactcaccactgtggagagtgaaaaaggaatgggtttttatgtatttctagccagctcttggccctgcgccatgcagagtatatgctgtacattggactttcgggacacttctctgttaaattctaagccttatgtctgtggtgtctccacagtgagtaagctcttaatcacattccctattgtaccttcttagatgaaagagcaatgggtcagggggactttttaaatgtccttaaacttgattagtttaatctttattatggctacagaatgtttcttaaatttacatacgataaaatccactattttatattaagtagagttatgagttttgacaaacaaatatattcaggtagccaccaccataatcaacacacaaagcaatccattacccccagatttcccttacatcctttgttgtccccctcatcctgtacttccagcccctgagagccacttatctgatttctgtcccgacagtttgccttttccacaatgtcatgttatataaatggagacatacaatatgctgatgtgagcatttagaaagatcatgtatttaaacaattattagagtaagggctggctatggtgacttaattttttggtttctgacacctataatctgatttgaagtgtgtcattctgtgcatcatgatcctttttgcagaacctgtgtctattagaaaatccagatgaagcaggctcttcctgttgtccttcatttggaaaagacagaagaacagagcgctttacgaaagtcaagttacagcttcctaattttctctcccatggacaaactcttccctccccccaccccgacctagcctcttacccactatcctttgcaaattcctatctcttatattgcccagtaattggggcgtgggggggtgaggggggggtgagttactgctgatgaaccaggaggcagagcaaggtttattttgctaaaggcttcagctgctactgcctggacctcaataagcattttctgctctttcctatcactactgtcttccctttctttgagaagcaacataaagataaaaagaaaaatacttgattttgtagcatgccagaatattaagatgctcctgaaaagtgtgggatttaaggcttctcaaaaaagagcagaggagggagtgagagaagaagacggagaaggaggagaaggggaagagaaaggggaggtggaagaagaaaaaaccaccatcagaaactgagtattacacaggacgtaacctgtgctctgagagtgaaggaggccacacagcagtagaaccccgacaggaaaatcagaaaacattatattttttcccagatcccagagtatcagatgttccattcagaaataatccctattgacccagtctctgtgtctctctctctgccaatagcatcaagcacagtaaccctttccatgctaatcccgttattaatgccatccacaacaagcgtagtgtaagtaagacacgaagtgtaaaaaaactttcttccccgcagtccgggctctcagagccctccttgtaggtcaacagtatcaaaggtgcttaacgcagatacaccaggaggctcaaagcccaaacatcgaaaaaaaaaaaaagacccactcttgtgctgtgtgtattgcccacgggtgggaggatgcaagtacaattacgttttttaaaactccagtccagatattggcttttccttggatacttttgtgtggctctcccagtacagtcagatccgccgccgcagcctagcgctccaccccgggttttgcgtcctcccctcacctgcctttcagtggtgcggggtttgatcccgagagcggtggactcaaagctgcccgccgggactcgggctgccggccgacaaaggacggtcctcgggggttctgaagtctgacccggccagtgggaaagccacctgcatcacaaagcgaggggcacacctgaaccggggctggcgggaagaggcaagtattgcgcgcgggctggctcccacatggagctgcctcccggtgcaagtgttgcaagggtgcgctgctccagcccggggagcgcgggaggcggcggagagagcgtccgggtgatgagcggggcactgtaactggattttaacacctctgcaagcagcgcttttggtcaaaaaatttccgattcttgatcttctctctgcaaggtcgggggttctttggggagtaaatcacagcgtttgggtttgcattcgaagcactaccaagtctactccacagggtcactgcacggggagcaagtaaaggaaaacgaggagaatctgagagtgctccttcgtgcagtgtgtgtgtgtgtgtgtgtgtgtgtgtgtgtgtgtaggcaaagctgagatttacatggtgtgaactgttaaatgttaacagttaaatcccacacttttcaggagcatcttaatattctggcatgctataaaatttttgagacttgtttaaagaaggggacttcctttttaatttagaacaaattagtagttgttataacattatagatactaatcagtaacaatactagtaggtaatgctttctgtaagtagacacaccccaaaagtatctgaaaagtatcaccaaaacggagcgtgctttcacactcctgcaaaacaaattagcccttaaacagaataattaacatcccgagggaagataaagcatataggttccttgaatcattacgttacatttaaagtcggtcctgttcagtttgcctttgtccctaaggagtaaaaatagcatcaaattgcttgtttggttttccccttttgaaactcagcatagtgtttggttatccatgaaggtggctttaatatttcaccctcatatttggcagacagttctggacttgctcctctccccgtagggactgagtcccactggcagtgtgtggagaatagaattgattctcgctttttctttgcataatacctaatcatcaccattagcacttcagacgttcacagctttctgaataggtgtcatttcttccacataccctattgatttgcatcattaacaattgaaaggaagctcttcttttgattaagaagccaaacaattaggaaagcgtggattctttcatagtatttattgagaggcgtctccacctgatctaggctgtgtttaatgggatgagagagactaagagagaacagaaagtgtaattaccgcctctccaggcccgtctttactttttccagaaacagagaattatgaaattatttgtaatgttacaaggacccttggagctcttctagtgcaagtcaagtttatttcacaaacgggaggtctagacagcctttgtttcttctgaacgggtctgcaaggccaagatctggattctgacccacagcgactgctgatccaggaattccatgcacatatgctatgcacttagcgctgattgtgaagaaacaccaaggtggcccgtcaagacctgaactaccacaggtctaacttgggaaagcctcattcctcacgttctttccgcttctactgtaatggtactgtgcctcttgccagcccacacttattcatttgaaatgtgcactttggaagttcactgcatttaatcgattcagaggatttcttttttttttaattttttttttaatcagtagctgagctatactacctagttctaatccgtaatagtgtgttaaaagactgttttctgtgtagttgctggctgttatttaaatcccaaggctgctgaaagttggtaatagaaccaataatagcaaccattactcaaaagtctattgcttactattaactataataattaactattaagtattgatattgtccccatcaatttttaggcgttacctaacattatccccattttacagatcagaaaacggaggcttcagaaaggtgaagttactagcccaatgtcactcaccttctaaggtggggagcagaagccaggttggtctgacccctaagctcatggtctttctatactaccttagtagtatagaaatgttctaactttcacattcccggatgtctgagctcaagacaaattttaaataaattagcgtggctttgatgttctctcactagtgaaagggtctataacactttaggcaaaatgcattgaaattatgttaaaccttcatacactgccaataagcaatgacttcccagaaaccatactccacatttgacccagtctctaatttagtgagaaggtgagatgcatggaaagaaggcaaaggagagtgactagtgacccccagaaaagggaatctcttcccgaggtttgtgttgtgccctgtggagctgagaggagagtagggaattgatggagcagaggcttagccaacgcatctgaaagagaagagtgttttatgtctttaatttcttcttgtcagaatcaaccaagcccagagctatttacgtgttgagaagggtctcccatggagaggccttcccagtggcccttctactctctgctgcggtggtttatcatgtcttcaaaacagactcgccaccaggcttccaacaggataatacaaatgtgaaatttttgtcctcaataaagagtcagaaatgatgaccattctgccactttcatcattttaaaatctgtattcctgaaaactggcctcgaatttatttctgtatagtccaaggtattgatttgaaagtgagaggctagcatgaaagccaacacttctcaactttaaaaaaaaatgccttaatatttagtattttctcattctaatgtatcctgtaagtgttctttctgtacttcttgttaaggcatggctgtgtaaacttcagagggttttgggaacagcctccattgtcatccacttttcattctaaaatcttggtatatctgtgcatacatgcacaaggcctcccatgattgcactgcttttacgaataatcatagtcaaaattcattttttaatactgctagctcaatttttatttcttattcctttgaaattgatcatcatttggacagggactgcattaaagctcaacactgaccttcattgtggccacaggaagaaaagatctgctaaatgaacaaatactgtgatcgatattgtgcaatggcttgagggaaaaaggaggttttaaccacttaaagtaagcccttttagaaacaaaaactatttcagtgaaaatgctaatcctacacctctccaaagtaaatgtgcttagaggacaccagccagagtttctttacaatgggaagttgccttccaacaagaaagggttttcaaagtgcagaagaaaactttatctggaaaaggtgagaagcagagagcctccaggctccagccccacacactctcatcttcaattaatactccacaaagggaaagttccattgtgggccacagcactccctgcttgagaacctgtagggacttaaccgctgggtttatccaatgaagtgtctgaggtccccgctgtttagcttggccctccactctctgttcccaatttcgtaaccactacctcagccagtctccccagcagagcacttttatcttatagccatgaggcatctgtgacatgtcccacaacacatcacaaactctatttgtcctccaatgctcagtgaccttattttcccaggcaaaagtggctcccgtcccggtgcccactaagccttgataccagcccacagtacagtgcttctcagactaggtcgtctcagcatttgtcaatgtattttatttatgtttcgacgtccagtctgttcatcttcagtacaggactgggtcatactcatctttccatcctttcccttgtccaccttcctttcttcgatttgaatattttctgtagttgctccattaatcagtaattaattaattgcagaaatgtatttcccaagatgtagataagtcacacctcagaatgctacaaacatttgtagatgtgactgatcagtaattgtcaggagactttgtcaatctggagaggtgctgaaaaacagagacaagaaaatgtcaactttcaaaaatactcatttaaaaaagtagtttccaagaaaagcgtagactggcaaaaggatgattgacaaaattctggactagattactaaataggtgatatgtgagaatttagaggagaatcgtgtgatttgcataatccaacatgagttccccggaatcaagccatcccatgtgaaccatatatctcttttatatataggttctgaaactggtgaaatggggaccacttgaggttagagattcgtaattcagtgttgcctctgatcagcctggaattgtagtttatatgccagcaactgcatgtagcctgagggctcccatgactgggctacagccaattgatcacaatctaatgatacccctaggagtgccttgggtgagagcgttgtccggggcaaaccttatgaaactttgtcagatggtcttcacacagcatttcttgattttagcagagcctttgactcagtctctcctagcagattttttcacttactccacagatatttatttaggtgtttattcagtgtcaagcattgtattaggtgttcagtgtttgtggctcagaagcaaattctgacttagttgataatatggagagcaaaaccgagtcaaaaattgattgcctgaaattatctttggaactgcaggaagtcaatcgattgatgaattcatgtgtgtccgggtctctggggtacactgtgtgctcccccattcactccagtccctgctcagagtccttctccaatcacctcctctataaaagcaccttgccccatcatttcctattccctcatgctgttttatttttcatctttgcacattttattctctgcaatgatcttattcacacaagcagtcctgtagttgcctgctctctgcccccttgcttggaatgtggtatgaatctagggaggcatttcacagggctgggtcttttgttccttgccgtccattcaatatgtctatcagtgacaattgttgtcattcctgctaatctaatttgcagatgatagaaagtgaggaggcagagctggcatggtaaataaggggatcaaaatgtacatcagcagcatatgtgaaagcactttgataattgaagaattataattaaatgcaagttatcattttttaagtgcgtataaatctaagccaaaaccaataaaatgaaagtatcaaggttaaatataagctcatgcatttaggttcaaaaaatcaattacacaaattcaaaataaaggagacctaagagggcagcacagtccatgccgcgatttagccatgagctgggcgactctagggctgcaacacagtccccgagtggtggagccatggctggaaattcttcgaatgttatcagttaggagggccacatggtgaggtggacattaccaagcccgagtgtggccagtggagggtcactcagaacagcagcaggaattgggacgtttagcctgaaggagaggggacttagggaggtggggacccatctttaactctctgcggggttcacatggaggagacgggcatgtgtgtgctgagtgctaagttagaacctctgggtcctggggggcagactttcattcaaggtacggagaatgatgggagcccagggccagaagcctataacccacagcatctggacgaatactgagcgctgtcactagattctatttttatttgtttgtttgtttgtttgtttattttttgagacagagccttgctctgtcacccaggctggagtacagtgacgcaatctcagctcactgcaacctctgcctcccaggttcaagcaattctcctgcctcagcctcctgagtagctgggactacaggcacccgccaccatgcccgactcattttttgtatttttactattttactctactattttagaagagatggggtttcgctatgttggccaggctggtctcgaacccctgacctcgtgattcgcccatctcggcctcccaaagtgctgggattacaggcgtgagccaccgtgcccggccgtcactagatatttaaagagaaactggacaactgtggggcagaggccagctcttaagagggatcctggctttgggttggatcttcaattgtctttgttctttgtctttccaagtctaacattcttatctgttctaaacttccgtatttttatttgttctgactgatttttttttcttggtgtgacatttgatgtaaatagtacttagcaggcttagcaactcctatatgaaagtgctttgaaatttgctgggctttggaatctctgttgtttttgcccattaagtaattccctcccatccctcttcaatgttcccctttccctatcaaccagccctttctgcaggttggagtttgatagacttggcacttggcacaccccctgagcgccagtgtcaccctctgcgttgtgaatttatagatggagaccccttcatccttttacagtcgtgctctgatcctggggtccctgaggtccagagcagaacctgaactctgagtatcaggcaagcgcatcttacttcaaaaaatgggaagaacaatttaaaaatgcaacttggatatgtttttataagatattcccgctttctgttttctacacttatttagcattttaacattttcagaatacgtgaaaattagatttagtttcttttttaaatgtgaaatataagaaaattatgattacccgtaacacatttgtgattaaaagtacattttttaggaaaaaagtattgtttccagggaacaattttctattaagttggtgcagtaatgattgcgatttttgccattgaaagtaatgcttaggccgggtgcggtggctcatgcctttaatcccagcactttgggaggccaaggcaggcggatcacctgaggtcaggagttcgagaccagcccggccaacatggtgaaaccccatctctactaaaaatacaaaaattagccaggtgtggtggcaggcacctataatcccagctacctgggaggctgaggcaggagaattgcttgaacctgggaggcggaggttgcagttagccaagaccgagccattgcactccagcctgggcaacaagagtgaaactccatctttaaaaaaaaaaaaaaaaaaaaaaaaattaatggttaaaaccacaattacttttgcaccaacctaatacttagaaagatgcaataatactagatggttacctttaacttacaggtttcgggtttcacagaaacaacagcaaacccaatagtgcttcactcagtttccctcccaaagacagcaaagagagaaaattaactacctggccaggcgcagtggctcacgcctgtaatcccagcactttgggaggccgaggctggaggatcacctgaggtcaggagtttgagaccagcctggccaacatggtgaaaccccgtctctactaaaaatacaaaaattagccaggcatggtggtgggtgcctgtaatcccagctacttgggaggctgaggcaggagaatcgcctgaacccgggaagtggagattacagtgagctgagattgcaccactacacttcagcctgggtgacagagtgagactccgtctcaaaaaaaaaaaaaagagaaaacaaaaaaccaactatctaaggcagaatggtaataaactgcccagtaatgctttcagggataattaaatgagtgatgagggcacaattacaaataagctaacccgagttacttggaaagcagatggaagcacccaagaccatacaacaagaatgaaaccccagaacagtaaacacacggtattcctaccatatatgccccccatcggtgtcacctaaaccaacatctctttgaccttttttttactcatgtgaccagttatttgattgtttggctgtcaaagtcacaccaagataataaattaggcctttcagagccaaaattatattatctagggtattacagtgaatatagagttaaataattttagtgtcctgaaaacattacaaaacacatatcagaaataagagccattctatgtagtgaatcgggggagaaatgagagaagctcagagaccaacatagagaaaagcaggagaaagcagaaagcactggaaacaaacatgtctgcttgttggtggtgggcgatggatacaaagatacccagccagaatccccctggaacaagccaggcattaaatctttacagctggagttgcattaaatctttacagctctaagctgcttgctgcaaacatcctgtagttctcgtcaattcaaactcatccccaactttctttttttttctaccttactcagtgcgtctgtgtctgggtgaacttcagaaatctctctcttacgttttcttgcaagactctttggctagttttatctgaaagtttgtttgtttttccagctagtagttcttccccctcttccctaagctcttgaagtctaacactgtttctctggtcagagggatcagacaaagagagctctgctcccggccacccatccgtctcattgattcaagccactgggtctgagtgggccccatcagagggtgtgatgggttccagacaacctggacgtgcttttagaaagcagtcaagagtaaatccataaagccttatctttgtgttggaggggaccacattataagcaaatcgtacattttcttccaatacaaagtaagatagtttcctgcattattagtggatatttttgcaaggacatatttaaaaatatatattgcccaataacccatcattcagtttaattccacatccctgctgggtgccttccagtctaccttgggcaacttaacataaatatggaaaatatagtttgtgtttatggagctcatcgccctatgagagaggccaggccctcacggaggacgaggtgacagcgtgggcacagccagctcttgaagaatatcataggtgatgaatgctctagagatcccaaggccaaagcggctcaggcacacgtcattcatttgtttgtaagcaccgtcaaggcaaagagaccaggcatctgtctttcataccccagccacaccccctgaagcagagtagataatagatgcttacaagacagcgagtgatttcatctcagtatgtatgaacagcttcaatcacacagattttgggcagattcactacctaatcggatgcgagacttttcatttcttctgacctatattagtaaacagcaatataatcttttctaattacagacacataaaatgattgataaaatccaacaattgtatgacccctccacaaagcattttttacattcaagcctcacaccagcccctggaaatagatattatttttaatcttaattcatccagcattgtgctgggtgctggggatagataggccagggaagaaagattcgaagcccctgcttttatggagctgacttgctggtgagaaaaaaataaataaataaaacagcaaacaagaacaaacaaatacatcaataatttaagtcattgttaaatacgatgaaaaaaatggtagtatgatagagagtgatcaagggaggaagtgagatctctagagtggatttgaaggaaccagatctaaagacagggggttccagttaaaggtataataggagtgtccaacctttcggctttcctgggccacattggaagaagaattgttttgggccacacgtaaaacacactaacactaacggtagctaatgagctttaaaaattgcaaaaaaaatctctcttttttttttttgagacagagtctcactctgtcgcccgggctggagtgcagtggcgctatctcggctcactgcaagctttgcctcccaggttcacgccattctcctgcctcagtctcccgagtagctgggactacaggcacccgtcaccatgcccggctaattttttgtatttttagtagagatggggtttcactgcgttagacaggatggtctcgatctcctgacctcgtgatccgcccgtctcagcctcccaaagtgctgggattacaggcgtgagccaccgcgccaggccaaaatctcatgatgttttaagaaagtttacaaatttttgtttacaaagccatcctggaccgcataaagcctgcaggccatgggttgaacaagtttggtatagcaggaccaaagaccctgaggtcagacaaggccggcatttacctgaacagaaggaaaccttgataaatagaatgaatggggaggagaaaagtagaagctgaggtcatagaggaggcagtggccaatttagcgagagggcctcacaggccaagggcaaggggtttgaagtttattatgagttgatgggaggtcagtggagggctttgatgtatcattttggcctctgtggatgatggatggtggggagaccatgagtggaggcagggaggctagcagggaggccactgctggagtttagtggagagatatggtggctttaatgagaacataattgaaggtacaaaaatgggcagattgaagatgtatttgggaggcacagctaagactatctgcggatgtattcggtgtggggaatgtggaagagagaggctcaaattcccaatttatggttgaaactgacactcaaagggattaaggaatttctgtctacagccgcaaatacagggcaggcaaggactccaggctggttctctaattcccaaatgacagctcttctcattcttgcatgaggatatgaggtttgcagaaagaagggattcatgagtagtaagtcctcttaatcctcctagtatggatctaatgattttttgaggtcatgcgtagtaaacaatgtgtaatatccattcaactagtcagctgatttgtggttacttgcaataagtcattattttcaatggggtcgataatactgtctctgacactaggtgtttgtaaccacaaagtgcacttcagttgaattcctttccgaggttgttttatgttcagaaccaacctttcgtagttatatcattagttattagagggataccaggcaacagatcgagtttatttcttgtaagcgttcttgttgcagtcatatatttcgtggtttcattaaatcggccttggtagacaagctgttctttcaaatccctctgtgagcagcaaatgctgtggattgagatctgtattctccagatgatttgctaagtcatctcagaagagtcctctgaactgtgaggtgtccccagcccttttgtcccagatccaagaaccaaaaaaagaacttgaaatggggatcctgctgattgtgcctacacttgttcattcatttcataaatacttactgggccctccagtgcacaccaggcactgttccaggtgctggagagatacaagcgagcgagagaggtcaggctgctgccttcagggggcttcttattcgtgggcaaaacaagcatgacaaatgggcaaacaagattatcacagtttaatacgtgataagttggtcaggtaaggcctgataaggcaacttatcacgtatcaaggttttggcctctgtggatgatggatggtgggaagaccatgagtggaggtagggaggctagtggggaggccactgctagagttcagtggagagatatgaccaacttggttaagttggtcaggtaaggcctcctcaaggacacggcacttaagcaggaggctggaagtataacaaagcagctatgagaggagctggggaaatgcatcccagggagtgggaacagcgaggacagagccctaaggaaagtgtggtgcattgtttagtaccctgttggctgctataatagagaaacccaggccaggcacagtggctcatccctgtaatcccagtactttgggaggccgaggtgggcagatcacgaggtcaggagttcaagaccagcctgaccaacatggtgaaaccccatctctactaaaaatacaaaaattagctgggcgtggtggtgtgtgcctgcaatcccacctactcaggaggctatggcaggagaatcacttgaacccaggagccggaggttgcagtgagccgagatcacgcctctgcactccagcctgggcaacagagtgagactctgtctcacaaaaaaaaaaaaaaaatagaaaccgagactcacaggggtttaagcaagatggatatttatttttctgtcacttaatagcatgggtggacagttcaggactgatgagatagctctgcaatattttgggacccagactctgctgtgctacaatctggcattctcaatatgtgacccctacctcatggtccaagaaggcttctccactcctgccatcacacctacttcccggccattcagaaggggagaggggaagagacggcctcttccctatgtagaggcataatatccagaatttgtgcgtatcttctccaaaggagatggaatcagataagtgtgtggtaggcaggtcattcgggaccatgtagatcatgataggatattgcgttttattccaagagcagctggatgccgctgaagggttttaagtagtgaagtgacatggtctgatttatgtttttacaagaacactctggctgctgagtggaggatggatgagtggaggatggatgacagaagggcaaaagtggaaatggaagatcatttaggaagctgtgatcttaaggagcaaggcaaggtggactcagacactgagacatcatataattgtagctttagagtattaactgtttaaagagacaatgagtaaagactgaatgttcatgcacctctttctaaaatacagggacagcctttgcgtggacaacttactggatgagcaggtttaaggaattgtatcctataaaagatagacgtgaaaccagccaatgtgaatgtgccgccaaattggacctggttatatttgtggggacccttaacttaggaatatagaaagcacatgaaagtgcctgtcaagctagagccctgggcaggggcaggctcagtctcccaggaggttagagctggaggccctctgagctcatggattcaacccttgtgctgcaggtggagaaactgatggtaggagtatggggggctgtggcttgcccaagttcaactttggacagttgcagaatcaaggcaggaagccaggactggaagccgccactctcaccatgcaccgtgagggggtatccttgatgggatgctttctcctgaatcacacatttaccttttggcctcctttgccagcacctcccttagaacaagttcccttctttacctttccccaaagtcccctggcctgtacctcaagtgattccatcagttaccttgtcttccaaacaggactggccagatgacgatggtaaagtgattttgagagattataactcacgtttgctgaaatgttttgaagtttcaagacagtagtatgcactgtgaatgccagtgttgctcaagatcctagagacagccctgggtcctggagccccggcagcctgctccaaggtcaacaggcggggccccggcaattgtttggggaccattttcacaaccttaaggtaatttgtggttcctctgagaatgcccactgaagtgttccccctcagaatgctgtggatgggagatagaaggaaacaaaagaggaggaagcagtgaggattttactggatactgcagatgcacttccacatcggcatgggttcatactggattatgcaaaagtatggattctggaatgattcattccccccaaaacctggaactcgagggcagcatgctgcctcgttgtccataaaacactcccttttgtctctgcagggatcttaaaaaaacaaagcaagctttactgtggcaaaacctcctctacatattatcattgtctgattggattttaagcacaatgctatcttggtctacacattttcttatacaagtgacagtaatactaaaaatctcagaattattatcaagagccttttggtagggtgaaagtttcttttaagtattttcattttcaggagtgagttttcacacacacacacacgcacacacaagtatcaggaaacaaaaaggaaatgtgtgcaaacttccaatttaaatgttctacatcttagttgagatggctatgatacagatacatgtatttggcaaaactcatcaaactaggcatttaaaataagtacatttttggggtacaaattatacctcaatgaagttgattcaaaaagtcaaaagtaaaccaaaaattccaattttatattccattaataagtttttggtgtctgcttctggttttattaccgaggattctcatttgagtacactcagaatggaacagagctattatcatcgaacgtttcctatactgggactaaagtctggccaggaaattaacttttaaccctaactttgtgctattttgagataaaagaaatgcacacctcagaacagcaaggtgttacagcacataactgcctgtacaatttaaaaactcgataaacccaaagctttggtagcaagtcttagcaggtgctgagaaatacgaaacgattaatttttttttttttttttttttttttttgtaaaccagaaaacaagtctggtgttaagcctgttgtgcaaatactagcattaaatattttgtagcatatcttagttccaagtatttcttttctgtcacatttttctggttcctcctgataatcaaggcaatattctttgaactgtttccttagaaaagttgttgaaatgaccaaatttctaattccattgggatttggacacatttctgaaatggcccagaaatcattttggggagcccttaggctgctgttccaatccagcacataggtgtgacagcggagacccactcggacttcagggactgcctgcctcctccctccacacccatctcctgtctccccaggacctgtcctcaggagctcaaaagaagaggggtcttggtcctgagagggtgagggggcgaccgggaggaagcacttcctctctgtttcttaagacatctcccttccctgggacaacttccctaaaaggctttctttttttttttttaaccacttttccaaagtcagaaatgaatacattctgaaaataacccaactttctttttatgtttctttctttccacccccacctcaagcccctagaatggccagcccacctggctagcaagaacttaccttcctgagcatgcctggggacagaccctagcacacaccccaccctgggctcgtggcgggactctggctctggccaacatggagatcccagccacacactgatttggaggcctgagtgtcaatgacaaaagcaatccaaacccaaaactctcaaaattgattaaacaatggaaagcttggctttacatgagatgtgtggaaagcatcctgcatccaggtactcactggaaggcagaaatttagcagatgttgctattattatccttagggttaatcatagtgattcctgacttacagaatccaaataaaggaaatccacttcatgcatcagccgccagctgctttttttttttttttttttttttttttttttttgagacggagtcttgctctgtcgcccaggctggagtgcagtggtgcgatctcggctcactacaagctccgcctcccaggttcacgccattctcctgcctcagcctccggagtaagcccccagctgctctttgtggacactcattgcccagacccccactatggtcgatcagtattaattgcattaacagatttaattataaaattatttcaactgcctgtttttttctgtcttccattctgtgttataatagtttgccaggttagctccaaacacttaatgtctgttacttactcaatataatcccacccagtacatcacctttactgggaaagaagcttgttaatctctgtttaccagtctgctcccagttattcaaggactctctgaacctaaaatgtataatatgacctaggtcagaatggcgttcccataagtgagcaccaacagtacgcagcggctgacacgtgtgaatccatctcttgttcccttgaactgtgaatcaacatggatgtagccatagtcatatctatcaccttttgtgagaaaaattttactttgaaaacaaagtaatagactgtacagttaaaggacagcagaatccagcaaaggtctgtctgtatcacaaaggaaagccacatcatgtgctttattcccatcatcagtcaacatccattttttgtagctctgggaacctaggtgtctgagagccagcgctgcgtattggtagcactggttctgccatctctaagccccaggacaagtatcctaacagaactaagccctggcttcctcatctgtaataaaataagtaccttctagtattcttattttattgtgaaaagacaattctgtgcacatatggttacacacacatagactataatgacacttgcattttattggtattcacaacttttaaaaattttcctatttaagacacagcttaaaataattaaaaagaaatcatcacatagttattactgaagatttgcttctatgttccataaaacatggttttaaaatataaaaaaaagacacagcattgatttccttcaatctgcactttttttcccattttgctcagcacacaaccttttaactcactcttaaaaaaaatccaccataaaggactggaaattaagagaagggtgttatataaaaaatgccatgtgtgctctgacttacaaagtcttcttcagtccatgaactcacagacagtgtcagccactgagagtgtcgtcgtcaaaacgaataatagatgtggaaagccgtggctcctgctcctgagagctggacgcctcttggctgacctcctgcttgagccagatccaagaggtgaaggctgaagcaagagagctcccttgagaaagctccagagtttgtagcctactaaaccagcagtgtcctatattacattaattctcctgatgtattttcctgacatttgtcagcatttccttctatttgccaaacatggacaaagagaaaaccaggttttagaagtatgctcatttataaagtctctcctgagtcctcacctttccatcccttctgccatcacctcagtcagacccttaccccatcactcaagacagctgtaagtctcctggcttgacacttcgcttcaatctcactcatctctgattaaaattgtcccatgatcgaaaattttatgttgttttcgtcaccattaaaaaaacaaaaaaacaaaaaaaaaaacccttcctcttccaagatgctccagtgcttaacaaatcaagtgtaaactgatttgaagcgtgaggccctgcgtgatatatactgtaggagacctttccagctttatccaatatccatccctagtactttgctgttaccccatgatatggtttgactgtgtccccacccaaatctcatcttgaattgtagctcccataattcccacatgtcatgggagggacccagtgggacgtaattgaatcatgggggtgggtctttcctgtgctgttgtgatagtaaatgagtctcatgagatctgatggttttataaaggggagttcccctgcatgagctctcttgcctgccaccatgtaagatgtgattttgttcctcctttgcctttgcctatgattgtgaggcctccccagccatgtggaactgtgagtccattaaacctctttcctttataaattacccagtcttggttatgtctttattagcagcatgagaacagactaatacaccacacatgctcattgatttcttggttttgtgaaaggcccatctccctctcccatcagccttctctttgcaaattgtagcccccgttcaatgatcagttcagttggcactgacacccacaggcttcccttgatcctgtgccccaatctagatccatagctctctcctctggatgtccttcatgtgactgtgcatcatagccttctgtattttgcctcggtcagtgtttattcttgactatgagatcctgcagggtattgtagtataactgtttctctgtgcctcacagtgccaagcacagggccttttgtatagagcatactaataaaatttctgattccaactaaattcttgtatgcacacataggaagtgtgacttaatatatgcatatggaatcaaaatgattactttatagttagcatgtgtatgtttgtatgcagaaaattcaaaacaagtattcaaacaagcacaaagttgtgtaactaggaaaaacacatgctcatttactcctgacctgtggggcccaggttccaggccctacactatgtgatgaagacacaagacaagaaaatatggcaccttctttgagaagcttccatctagtcagggagaaaaacctgtgatcatataactgtagcaggccctattactcctgactacactggagaggccaaaaggagcgtgcctggttcagcctaggggtgttcaaggtggtcgtatcactggctgagggagtgtctgagggaacacacagccagggggctgggagaagcagggtgggtcagagcacaaagagacttgttcatcatttcgaggcgcctgtgctttctactagagatagtcactgaagcagaatgagaggatcctacgcagtttcagaaacatccccctgagggccaggtggaggatgaaatggggggaagaaggcaagatggcgggcagccatgagaccatggcaagaactctcagactggaaatgaggctggcttgagggaaatgggagacgggagcatttgagaatgtggagattgcatgagaagggatggcttttgggtgagtgaggatggctggcctgcctgttcacccgctgggagcctggtgaggtctcatccacttaccatgttgtctgggctagagagaggtagcacctgtagaaaccgcaattaggggtcctatgcttttgtttaactttctggaaatagaacaggcctcccttttaatacatctgttattcagcctttagatattctgctttcaagcgcgtaatcaggaatgcattagaataaagcagttaggagcagagtaacagaagggttaaagtatttaacttctccaggcctgtttcctctgtaaaatgagaaagaagataataatagcacctatttcacagaggagctacaaaaattaaagaagttaatgaatgtaaattgctcagcctagggccctgcataaaatgtgcacttaagacatcagttacttttttttcctgtgtgattggtgaggaaggttgagaaaagcatgaggactccttagctcttccgaaatacagtcatgtgctgtgtaaggacgattcagtcaaccacagactgtgtgtacagtggtggtcctatgagattataatatggttacttttactgtaccttttctgtttaactacctgtagatacacaaatactaccattgcgttacaattgcctacagtattgagtacaataacatgctctacagatttgtaacctaggaaccatagaccttaccatatagcctaagtgggtggtaggctctgccatctaggtttgtggaagtgcattctgtgacgttcccacaataacaaagttgcctaacaagactcatttcacagagtgtatccccatcactaagcaacacataactagtacttgctacagttgcaatataggcaaagcctcccttcttaaatataaataagcacacttttcaattcggagatgtattttgtatactaaatttgaagacattgttttgcctttttgtagggagagctggagattctgctcttatatccagagtggcatccgtgtgacatagtcattctttgtatgtgtgcctttagcctatgggtcattgtcagaatttagaaattcaaggtgcagccagttacattgctagagagatggaatatttcagagtctctgcaagcttcctttaagaaaaatgtcttcttttggaaagccattcagaaaacatactcagtaggacagtttcaacttattaaactttcaggaaatttttttaattgtctcacactgtctcttttgctgtataaattttaacagcagggtaaagagagaagcgttcttgaatttcactagctgcggagaaaatatttctcactgccctgggatacataggaaatcacagtcgttagtttcagatgtttagtttgggatattcaggtgcattcacaataccttttgattcattattactttaaaccatttgtggtttgatcctacaaattgaggacttttctccagatgtgaaaaatacaataaaattttctaacagaggggatctcgagaagaagttatctttatttctgcagtttctacaagagtccataaacccctttagaacatggcaaaaactgcagattggcagccatgggttggctggactgaaagggaagggggctcacatttaatttagagcataagaataagctaaacagcaaggcagtgacaaatgatacaacaagcaacaactcctagctgactgctccgaaataaacacatggattccaggcctcacctagaccaagaacatattctgcaactaaaattaaaccttcgggacatgcaaactctttagggaaaggagtggaagaaggagaagaagaaggaactcagaggttaccaagcaattgagtggtgaagagaacaggcatgaagaaaagagaacaggtgtgaagcaacgaaggaaattgcttctccaaatgaaaagttttgaaacacagccctcaccaacctcagaaaaatgctaactctgaaataggaaatggagacggaattggaaatggaacgtgaggaatatcagtaaacccttgtaactgtgcgatcaacttctttgtaagatttttaaactcaaaagtaaacacttttaaaaacttaaaagtgtaagattttaaagtggtataaagatcttaattaggcatttaggtagtgcatgctgtggagccccaaacttacagaagtgacaccagaaaaagccagaatgatccctttctgtgttccagtacttgtgggaaaaaattatttttattaatttgtaaagggctaaaatatttatggactaaattcagatgagtaaaaagatgaaggtgttagagtcgcttttctttcttttttttctttttcttttttttttttgagacagtttctctcttgttgcccaggctggagtgcagtggcgtgatcttggctcactgcaacctctgccccccagattcaagtgatctcctgcctcagcctcccaggtagctgggattacaggcacccaccaccatacccagctaatttttgtatttttagtagagacggggtttcaccatgttgaccaggctggtcttgaactcctaacctcaggtgatcacccacctcaacctctcaaaatgctgggattacaggcatgagccaccatgcccagcctagagttgttttaattttctatatcgggtctcatcttgttctgaggcatccatttctatgttcttggtttgggttgaggggagattgaagcttgcacttaaagtcaactaagtctctcatttaaaaagtgtttcttttaggtgaattcagtctctctgaggcaaatactcaatctctctgccttcatatctcctttccagagtgtcaaggggcccgggattacacgcagtcttcagggtctgtcttcatctcctaggctgtcataacaaagtaccacaaactgggtggcttacagcaatacagatttatcctctcacagttccggagcccagagctctgaaatcagggtgtcagtaggggtgggtcctcttggggactcagagggggaactgttcttctcttccagcttctgatcgttactggaagaccttggtttttctgggcttgtagaagcataattttactctctgcctgtgtctccacctgcctttctccctgtgtgtgtgtctgcgtcttctctttttataaggacaacagtcactgggttagggcttaccttaactaaagatgacctcatcttaactcgaccattgtattagtccgttctcacgctgctatgaagaaatgcccaagactgggtaatttgtaaagaaaagaggtttaattgactcacagttctgcatggctggggagtcctcaggaaacatacaatcatggcagaaggcaactcttcacagggcggcaggagagagagaatgagtgccagcaggggaaatgccagacgcttataaaaccatcagatcggccgggcacggtggctcacgcctgtaatcccagcacgcctgtaatcccagcactttgggaggccaaggcgagcagatcatgaagttaggggttcgagaccagcctagccaatacagtgaaacctgtctctactaaaaatacaaaaaaactagctgggcatggtagtgcgtgcctgtagtctcagctacttgggaggctgaggtaggagaatcacttgaacctaggaggcagaggttgcagtgagctaagattgactctagcctgggcaatagagggagactccatctaaaaaaaaaaacaaaaaacaaaacccatcagatctcatgagaactcactatcacgagaacagcatgggggaaaccacccccatgattcaattacgtccccccaggtccctcccttgacatgtggggattacagttcaaggtgagatttgggtggggacacagagccaaacagtatcaaccacatctgcaaaaactgtctttccataaaaaggtcacactcacaggtaatttgacatagctttttggggcacacaactcaacctgtaataggatccttacaggtctttgctgtggtggctatgctggtctggtggccacccttgtggcgctgaggtgctgaggttgggggatgttctgccgtggcttattaaagggcatagtgctagccatctcccattcttcctgcatctgtactgcgtgcaggctgcaggggagcacagcactacctaagccccatccaacagacaagtgtggctctcttaacagggggacttactactcgtgtgccaaattcaatgctgctaataggaagcttgaaagcaaacagtctatgctttggcaaggaggatccactctcactccagccccatgtttcaacgtttaaagggaagccagaatacatacacagatggtctccaacttatgatggtgcaacttacaacatttttactttaccatggtgcaaaagcaatacccattcagtagaaaccgtcctttgagtacccatacaaccactcttttcattttccctacagtattcaatagattgcatcagatattcaacatgctattttttttttaaacggagtttcgctttttgttgcccaggctggagtgcagtggtgtgatctcagctcactgcaacctccacctcctgggttcaagcgattctcctgcctcagcctcccgagtagctgggatcacaggcatgtgccaccacacctggctaattttgtatttttttagtagagacggggtttctccatgttggcctggctggtctcaaactcccaacctcatgtgatccgcctgcctcggcctccctaagtgccgggattacaggcgtgagccaccacgcacggcctcaacattctattataaaataggttttgcattagatgattttgcccaattgtaggctaatgtaagtgttctgagcacatttaaggtagggtgtgtttggtaagttgagtgtattaaatgcacttttattctgacaatatacaagacagtaatattattttttgactgaattagtggctgaattaataagtgaaagacaaaaggactgcttttgcagggtgagctcaaaaacgtacgatgggtttactgggatgtagccccttcatgctggaggaacctctgtacgtgtgtttccttagggctttgcaatcactgttccttctatctggaatgcttttttccttgggttccttttgagaggtgacagcgtgctggcagtcctcagagccctcgcttgctctcggcacctcccctgcctgggctctcactttggtggcatttgaggagcccttcagtcccccactgcactgtgggagcccctttctgggctggccaaggctggagcccactccctcagcttgcagggaggtgtggagggagaggcacgagcgggaactggggctgcgtgcgggccagctggagttccgggtgggcgtgggcttggtgggccccacactctgagcagccagccagccctgctggccccgggcaatgggggacttagcacccgggccagtggctgcggagggtgtactgggtcccccagcagtgccggcccaccggcgctgcgctcgatttctcgccgggccttggctgccttcccatggggcagggctcgggacctgcagcccgccatgcctgagcctcccacccactccatgggctcctgtgcggcccgagcctccccgacgagcgccaccccctgctccacagcgcccagtcccatcgaccacccaagggctgaggaatgtgagcgcacggtgcaggactggcgggcagctccacctgcagccccagtgcgggatccactaggtgaagccagctgggctcctgagtctggtggggacatggagagtctttatatctagctcagggattgtaaatacaccaatcgggactctatatctagctcaaggtttgtaaatacatcaatcagcaccctgtgtttagctcaaggtttgtgagtgcaccaatcgacactctgtatctagctgctctggtgaggacgtggagaacttttatgtatagctcaaggattgtaaatacaccaatcggcactctgtatctagctcaaggtttgtaaatacaccaatcagcaccctgtgtttagctcaaggtttgtgaatgcaccaatcgacactctgtatctagctgctctggtggggccttggagaacctgtgtgtggaaactctgtatctaactaatctgatggggatgtggagaacctttgtatctagctcagggattgtaaacgcaccaatcagtgccctgacaaaacaggccacagggctctaccaatcagcaggatgtgggtggggccagataagagaataaaagcaggctgcccgagccagcattggcaacccgctcgggtcctcttccacactttggaagctttgttctttcactctttgcaataaatcttgctactgctcgccctttgggtccacgctgcttttatgagctgtaacactcaccgcgaaggtctgcagcttcactcctcagccagcaagaccacgaacccaccagaaggaagaaactccgaacacatctgaacatcagaagggactgactccagacgcgccaccttaagagctgtaacagtcaccgcgagggtccgcggcttcattcttgaagtcagtgagaccaagaacccaccagttccggacacactttcacctggctcagagctcaaatgtaatctcctcagagtggccttccctgctcctgctacctagagtagcatctccccgtctcactctctcccttctcctgctttattttcttggtaaaatatcatttcagagcacgaggctttctttaagcaaaggacagacattttgcttattgctcaactagtttttgagctcatcctgaaaaaagtagcttttttgtctttcacttattaattcagtcaaaaaataatattactgtctagcaggctgggcgtggtggctcatgcctgtaatcccagcactttgggagaccaaggtgggcagactccctgaggtcagcagttcgagaccagcttggccaacatgatgaaaccgcgtctctactaaaaatacaaaaattagccaggcatggtagaatgtgcctgtaatcccagctacttaggaggctgcaacaggagaatcacttgaacctgggaggcagaggttgcagtgaaccaagatcgcaccattgtactccagcctgggcaaaagagtgagactccatctcatatatacttgagatgtatatatatgtatatatgtatacttttatatatatgtatacgtgtatatatgtatgtgtatacatgtatacatgtatgtgtatacgtgtatacatgtatgtgtatgcatgtatacatgcatgtgtatgcatgtatacatgcatgtgtatgcatgtatacatgcatgtgtatgcatgtatacatgtatgtgtatgcatgtatacatgtatgtgtatgcatgtatacatgcgtgtatgcatgtatacatgcgtgtatgcatgtatacatgcgtgtatgcatgtatacatgtgtgtatgcatgtatacatgtgtgtatgcatgtatgcatgtgtgtatgcatgtatgcatgtgtgtgtatgcatgtatgcatgtgtgtgtatgcatgtatgcatgtatgtgtgtgcatgtatacatgtatgtgtatgcatgtatgcatgtatgtgtatgcatgtatgcatgtatgtgtatgcatgtatgcatgtatgtgtgtgcatgtatacatgtatgtgtatgcatgtatataggtgtacatgtgtatgcatgtatataggtgtatatgtgtatgcatgtatatatgtgtgtatatgtgtacatgtatatatgtatgtgtacatgtatatatgtatgtatgtatacattatgtatacatatctgtcaagcataatgtcagaattagcaatattgattaaattatgtagtccttgaaggtagaaactctttttcactattgaatcctcaccacctggcatacaatagatactcaataattccttgtgtgggtgataaatgaatgggattccataacaaagttgatctgtgtaagacttttatttcactctttctataaaattaagtccacaatttttccatggatccttgcccaagaccacatgttgaaaagaacttatacgaatggcagatagcatcacggctaaagaaatagaatcttttgaagacaataactattttacttttaaaattgctcacaaattaaagaatgctggtagagataacaaagatgatttccaggagtaagaggccatcatgcagtttgtgatttccagatacttttgcagaaaggcaaccatgctgtagagtcagtagcagagttttcaccacctgtctaagacagaggaaaatgaccccaaaaaaaaaaggcaacttcaggcccttcttcaaaaatgcaaatccagggctacttccagctgtctccatagcatggcaaaacaatattcccagccaagcttcaagccattaagaaaaaccatcacagctgtgcgcggtggctcacgcctgtagtcccaacactttgggaggcccaggaaggcggatcacgaggtgaagagattgagaccactctggccaacatggtgaagccctgtctctactaaaaatacaaaaattagctgggcgcggtggtgcatgcctgtagtcccagctactcaggaggctgaggcaggagaatcgattgaacctgggaagcagagattgcagtgagccaagatgaagccactgcactccagcctggtgacagaacaagactctgtctcaaaaaaaaaataaaagaaaagaaaaaccatcacatatgtttggcaggggccaacatatccatggggttcagtaggcccacagtacttccagggacccacaaaagtgttctaataacatttaaaatcagaagaaaaaaatgaactgttaagtcaaaggaaaaatgttctaatatataatatgttaatacataatatcattatattcatctttataccaacacagtcctaaaatattacttttgatttttttttaatggaggaagaaaaccttgaaagcaaaagtgcctagggcctgtgaaagtcatcacatgaccctgatttggcgtctgctttgccttaaaaaagcattctagacagatattcagctggaaatactgaaatgggctcatgccaaaagaactagatctcttgttatccagaaaaccatattttctaggcagattcatttcccccaagatgcctaagagtcatgataacatattttagaggcgagattaatgcgatcgccccataaaatattttaagctctcatctgttctgaaacaaagtacgcaacatgtcaccaagagaaaatgactgctcataccgagaaaatgtattttcttcgaggtgccacagccactgtaatttgcacctcctgaagtgtagatggaagtcccctcaacatgtacagacagttaaaagagtcacggtaatgataggactagagaatgtgcccagctgagaaaataagcacacagcgagcattgtcagagctgaaaattaagatcccccaagcaaacatttcagatagagcccctcatcttttgttaaaagtaaaatgaaaatcaacagccctctacaccacatctgagccatggaagtcactccctttaggtgtctaagagacgactgcagcttcagtgcctggctcagattagctttgttcttccttgtctcttatcctttgaatagctctgacagtgccacaaggagtaattaccaattcgcagggggacacatcttcagttaaagtggattatctgcaagttgaggggtgggggttgctggcggctacaactgagttaggtattaagtataatctgcaaatgcagggagagttctgcagagccccaggcagttcttaactttctagaagtagctcccagctgaggcctcccctggtctccaggcatctggataatgtcttaactggtagagtgatggttaagagcatgagttttgggggcaaatttcctggttttatgcactggcacttcctagctcatgtgattctgggcaagttacttcactacagtgagcgacaatcagaatgggtccaaaattgtaccagccatagcaaggtgctgcagatgtagcaggacgaattgcagacaaaactcagacaccaagttaaagaaggaagaggtttattcagccgggagcatcggcaagactcctgtctcaagagccaagctacccgagtgagcaattcctgtcccttttaagggctcacaactctaagggggttccgtgtgagagggtcgtgatctattgagcaagcagggggtatgtgacaggggctgcatgcaccggtggtcagactgagacagaacagaccaggaagtttcacagtgtctttctatacaatgtctggagtctatagataacatcagttgctaggtcaggggtcgaattttaactaccaggcttaggtcaggcgggcccaggcctggtttcgggtctggttcctaggcactgggctacctgcctttagtttcgcttctctttccttttctgattatagaacaatataaaacaatatgagagggtctgtctctcttctctcacaaacattaataagacattgtgtttcaaatgctaagcatacatctaatacatggtaataaccccaagaatctttagctgttaccattatatttttatattttttttaattaaaattgaatcccttttttttttttttttttttttttttttttgtcttttgtgacagagtgcctctattgcccaggctggaacgcagtgctgtgatcttggctcactgcaacctccgcctcccaggttcaagccattctcatgccccaacctcccaagtagctggaattacaggggtgtgccactacacctggctaatttgtgccactacacccggctaatttgtgccactacacctggctaatttttgcattgttagtagagacagggtttcgccatgttggccaggatggtctcgaactcctggcctcaagtgatccaaagtgctgggattaccaacataagacatggcacccagcctctgttatcattattaagcattcatttaagccaagatctaaggggaaccaaggcccagtagcaaatctgctaatactcaggaaatgggtttgtgagaaatgttgctgttctttatcattattattattattattattattattattattattactattactgctacattcactatgagaaaacattcacgtctcagaaataacagtaataaggggtaagcattgccaggaggaggcagaaggcacatactggccaagtccggctctacgccctgtgtgtacagatatgtcttccaactttcgaaaagtctttgtaaaggttttcgctgatttgagctgttttcagctaagtcaccagaacatccagaatctaattttaaatgaaggttattataatgtccctcagtttcgtagcctcttattcaagagagattagaattctgtgaaggaaaagctttgttttaagttccaagggatgtaaagatttgctaggctgtctttaaatcccatttgggaactcaccatttatataaaaatggatgacatataatgtgtctttgggaacagtgaactctgaagagaaagatatggtcaaatggcccggcctcctcccacctcggaggatacactgcaccctcttcctacccctgatttggccctttcacaaatctcagctctagactgaggcagaaggacataaagatgcccatttccaaagctctccggctccccagtgcctctggttctatccatctttgtgacctgacgtctcagtggctgggtcccagatagggagctctggtctccggttcctggaggctgagcctgaatccctccacgcagaaagagagtcagggacagcaccgggggctgaatccctgccccaccttctagcagagtgacctcagtcaggtgactttactcctcaggctgtttcttttctggataacaaaaggtcattcaaccccatcttgtggattttctgtggagatttagttagataaaggactggcacacagggtgaagtgaggcagccttcccctcttccgcacagtgccacacagaacaggggtctgaggacttgccttctcccctgcatggctggtccccccctacccctgcccttccctggtgtttccaccgcaccccaccagctggaatgacatccaggattgaactcaatagccccttggcttacagggccactttctccacacctaccctggcagacttgatctcatatttgctttcagtataagatccagttgagcatccttccattaatgccccacagaacaagtctcagccttctccctggtgccggcctttccaacacctgaaggcagtgacggtgtgcttctagagtcttctcttccccacattcagcatccacagttccttccagtctgcttcacatgacaccgtctcaagcatggtgccatcctcaaaacacaccccggtttattattgctttcctgctcaagatgctctgtccagaactgatcacctctctggggtatgctgaccaccccaggggatggtctcagaaaccactttctaaattggaatatagactccatccttttcatgactcagtcaggtctcactcttaattcctaaatcccaaataattaacaaaaataccagagtcctgaggggttgctggaaaacaaaactggaaaaaaaaatccagttttcttctatcagccccattgtcccaacaaaggagggggagaggaggctacgtgcagttaccaggtgtgtcctatacaatttggtattgaaggtgattggggtgggggaaggcacgatggcatttccaaatatagaaattggttattcgtttctgctaaactgtatttagttatatctagggaaatcatttcagcctctcggagtccctttggctcacgataatgtcctcttgagtggagccatccctttttactaaatgccatatggcacattcatcaatgtgccattgatgtctttatccaagttaataaaatgattaaatgtaggcttggaatcaccactaaaattctccttgaagccaatttctacctatttatcaaattccaccactgttcatctcatgattaatctacctttaaaatactctcatgcatcactgaacgacagggatacgttctgagaagagtgtcattaagcaatttcatcattatgcgaataccacagagtgcacttacacaaacccagaaggtgcagccttctacacacccaggctctgtgctacagcccattgctcccaggctgcagacatgtgcagcacgccactgcactcaatactgtaggcaacggtaacacaacggtatttgttcactaaacatagacaaagtatggtaaaaatatgatataaaagataaaaattggctgggcgtggtggctcatgcctgtaatcccggcactttgggaggccgaggcaggcggatcacaaggtcaggagatcgagaccagcctggccagcatggtgaaaccccgtctctagtaaaaatacaaaaaaaattagctgggtgtggtggtgtgtgcctgtagtcccagctactcgggaggctgaggcaggagcatcgcgtgaacctgggagttggaggttgcagtgagtcaatatcacaccactgcactccagcctggggacagaacaagactccgtctcaaaaaaaataaataaaaaataaaagtaaaaattggtacccctatataggacacctaacaggaatgaagcttggcaggactggaagttgctctggatgagtgagtgggtggtaagtgaatatgaaggcctaggacattatactactgtagattttataagcactggacactttggccacattaaatttaccttttacaattttctttctttaataataaattaaccagctgggtgcagtggttcatgtctgtaatcccagcactttgggaggcagaggagggtagaccacttgaggtcaggagttaaaaaccagcctgatcaacatggtgaaaccccgtctctactaaaaatacaaaaattagcctggtgtggtggcatatgcctgtaatcccagctactcgggaggctgaggcaggagaattgcttgaacccaggaggcagaggttaccgtgagccgagattgtgccactgcatgcactccatcctggtcagcagaggaagactccatctcaaaataaataaataaataaaataaattaaccttagcatactgtaccttttctaactttatagacttcttaatgttttcaaactttttcactttttcatatttttgtctaacacttagattaaaacacaaacacattatacagctgtaaaaaatatttctttttatatgcgtattctataagattttgctatttaaaaatttgtttttaacttttaagacttttttattgaaaactaggacacaaatgcacacatttgctttggcctccacagggtgaggatcatcaataccactgtcttccacctgcacaccttgtcacactgggaggtcttcaggggcagtgacacacatggagctgtcatctcctgtgataacaatgccttcttctggaatagctcctgaaggacctgcctgaggctgttgtacaattaccctttttaaaaataaaaaataaaaaaaaagtaggccaggtgcagtggctcacacctgtaatcccaggactttgggaggctgaggcaagcagatcatgaggtcaggagttcgagaccagcctggccaacgtggtgaaaccccgtctctactaaaaatacaaaaattagccaggtgtggtggcgggtgcctataatcccagctacttgggaggctgaggcacaagaatcgcttgaacccagtaggtggaagttgtggtagctcagattgtgccactgcactccagcctggacgacagagcgagactcagtctcaaaaaacaacaacaacaaaaaagaagtatactctaaaataatgataaaaagcacattatgataaatgccaggcaatagaaaaatttcagctccattataatctcctgggaccaccctcctacatgtggttcatccttgaccaaagcatcattatgtggtgcctgactgtactactcaaacatattacaatgagaccatatctatttgtcttgaccacaaaaatgtcatgagaaacttactaaaatgctttgctgaaatttagatggcctctctcagtgctctcccacctaggaggctattaccccaatctgaaaataaaggaactggctttaggggttcagcagtgagaataggtgttgacaggaagaagtatccaaaggcctcccagtgggtctccggactgtgtcccttggtggcatccagggtggttgcgatcgtatggtttaaattttgtgatgatccactggagcttcaagttcagcctcaaagcattaggctctgttttctgaacatcattttatatggcaaggtcccgagattctaattttttcttgtgttaattatgtgacatggagcgtcagttaagggaaccatccaatacactttccagaaacagttctccctctcagtttcttcgtgtgcttgactggctcatggccctggggaaaccatcgctttcaatccctacctcaggtccatttcgtgatgtttatgcattcatgcgatcttagtcctcaaaggatttttttttcttctcttgggtaagatagctttagaggccttctgggataggaattataatacaactgagaacaaaggaagaaaaataaaaagtgaactactttctgttttactgaatcattcaacttgacattatctggaaatacaaaaatttgctaacacacttttcctagcctacactttgttatgctgcttgtgaaatgtatgaggtcaacacctttctacccttttttccccattgtcgcaaattctcctgctgtccagagttagtttcaaatgaccctctgctagtcttggccggcatacctaccagtggcttggagaggaattaaggaaaagcttgaaaactgaagctcatttttttgtatggtgttggctagagtttaacgtggttctccaaagccaaaaaaacattttagcagaagcggagcacacacagagataaattatttttctgtactacatttcagttggtaatttcgtacacaggattctatttctgctgctatcaagataaaatgcaaaagtggaaacattccaatgagtaagaagcaggtctgttcattcccagctcatgagaaactcaggacgcacattagtgttctgtttcccagcagcaaatagccaggacatatagcttcaatttactgggattcgaagaagtcaaatcagacctgatttcccatgaagtaaatcatagcacccagctctgtggtttgagtgacaggtacatccattattctgaaaggtcttgttactttcagcagagcttgttattcttagccctaaaaaatcatgccatgtgacagggcacctgaggctgaggaatggggcaccagcaccttccaggctttctatcttacatctgacaacttgaaacatccaggaaagaagtggaaaatccacatatcagatgtgtgctcctacccattccaaatgtctggtgtttgggaaacatttaagggatcataaattctcttttgtgtcaatgtttttggtactgtgtaattacaactatatatgtatagttatgtatatatgtatgttatactatatataaaactatatatagttacatatatgtatatatacaactatataaatatataaactataaatataaaatataaatatatatatttttatatatatatagtatattatatatatacaattttttttgagacagagtcttgccctgtttcccaggcttgagcgcaatgccgtgatctcggctcactgcaacctctgcctcccaggttcaagtgattctcttgcctcagcctcccgagtagctgggattacaggcgtccaccaccacgcccagctaattttttgtatctttagtagagatggggtttcaccatgttggccaggctggtctcaaactcctgacctcgtgatccacctgcctcggcctcccaaagtgctgggattacaggcgtaagccaccatgcccggccattacaactatattctaagattaactagcaatcataagttttttgttttcagtctagattttagaaatgcgaatgacaccaggcccaacactttgggaggccgaggcaggtggatcacgaggtcaggagttcaagaccaacctggccaagatggtgaaaccccctctctactaaaaatacaaaaaaaaaaaaattagccagacatggtggcgggcgcctgtaatctcagctattcgggaggctgatgcagagaattgcttgaacctgggaggtggaggttgcagtgagccgagattgcgccactgcactccagcctgggtaacagagcaagactccatctcaaaaaaaaaaagaaaaaaagaaacgtgagtgacaatttcaacctatttagtatccccaaaagctcaggagctgtgataaattgatacaaataaaaatgtaatacttcatctttttgcaaaatagtgcagtgggctctatgaagacatttctttttattgttgactctggaaagaaaaaatccagttttgtgttatcagtccttagaaaaagatttatgagttaaaatgcagcagaggccaggtgcagtggctcccatctataacgccagcactttgggaggctgagggggataggattgcttgaagccaggagttcgagaccagcctgggcaacataatgagaccctgtatctacagaaaatttttaaaaacaagccagtcatggtggtgtgcgcctgtagtcccaggtacttaggaggctaaggtgaaaggatcacttgagcccaggggttcaagggtacagcgaggcctatgatcacaccgctgcattcctgcctggctgacagtgagaccctgtctctaaaaataattaaaattcaaaatgtggtagagacactagaaggaaaaatgattctgcttctcccagcattctgcctctgcataattgagttagtgcatttcataggtcaagaactatttaaattacacctgcatattttagtcctgcatatttcttcataagagagaaaagcatctaataaatacaatgaaatttcattcatgtctttatttaagggatgaataaaatgtcacagtacctaatcgtatacatcaattatggatccagatttaattctggctgtgcctctttggaaaggcagctgatgagcaagacatcactgatcaaaaactgcattctgttagagcaggagctgacagggaacctagatgccagcatttccatgccctgcctgatgtttaccatttgatcacgttcgaactgaggaatgaggcttatcggattttatgttgctttttttagatgaatgctcttggctttttgttgttgttatggttacttcccattgatttattccactaaccatttagactcccgttcattcacctacggccaaatgggactagaatggaaaaacggaatcctacccgatcaatgcaaattctatttctctctctccaagaggcccagatgaccagccctgacactgggagccactgggagcttcaggtgctggcccagcagtgcctggccatgttttcaagtgtacatcaggtgaccactcacctgttgtacttcagtctgattttccaaggagtatttaaaaccacccaggcagtgatttcaaaccgactttctacttattccacaaggtaccgtcgaaccactgttctacgtgtgaggcctgtggagggtttatacagcaatgagtgttcagtgttaagtcctgccttccttcatagaagagaaatttatcagttcctctgggtgtcagttttagagcaatacaacaacgttttgaaagacaaatccatttttaatgagacggacagattttcaggtaatagtactgctagaaataacatataatgatctactggttctgaatacactgctgaattcctgaatacgctgaagacctccccctcctctttcctggttatgttctgcacctgtttacactatgaagctgaaaaacaaactttgactatagctaactatgattgttctaatttccatagtacttgatcccctcccacacaccaaactatgaatgacagactgctgaatagatggtttcagtcatagaccgtccctgacttatggttccacttagaagttttcaactttaccatggttcaaaagtgatatgcgttcagtagaaaccgtactttgaatacccatacaaccattctgttttccactttcaacactttattataaaataggtgtgttagatgactttactgaactgtagactaatgtaagtgttctgagtatgtttaaggtaggctgggctatgctatgatgttcagtaggttacgtgtatttaatgcatttttgatttacaatattcccaccttacgatgggtgtatggggaggtaaccccattatacgttgaaaagcatctgtatattcattcctacagtcactggtgattactttgtccaaggcattattttgggggaacacaaagagaagtgacatttagtcccagctgtcaagaaaactttaattctaggaaaggcacagttgcgggcctctggcccatccgaagagagcaggaacacacctggtccagttaggtagagccgggagcagaatccaggaggaagccccactcagcgggggtctctggtgttctaaagtgatggatagtgactggtactaagtgtgaggggagagggtggattacacctgaatagtacagaggctctaaggcagaacatccagggacttagagagacgtcaaactcctccacaacaatgttccccaaacaagagtcatttgaggaccaatgtcacgatttttgccatttctgatgacatttttaccatttctagtggcctcctttactgttgtttacttaacattttcctttaaatggactcactatttttacttaaataaatttatgttaaaaagtttatgttaaagagaaattttgcaatactaccatgaaatgaaatgccagtaccgcttgctgtcacgatacggtggtgctaaaaatacgtaatataaaaatataatgaaactcagcactgttgcccaccgaagcatccaggtctgaggtctgacctctctttgttaaaaagggaaaatagcaagtattggcaccataataaagatagtccagccccacactgagccggcctgagactctgagaaattgaaagggaatcggggaaggaataagactggatgttatttagctcccagtctgtgaattacctaaagacccccagtgccaccagtgcgacatacttcaccccagaacagagggaaggaacagaatggtaggcagtgctttggggccagttgtactacagtctctgcagagcaaccatatgctgtgtcagggctggaaccaggtttggccatctgtgttgaccccacagattctatgaagggtgacttccacaatccctagcacactggggagcacacagtacatacttatcaaaagtcttaaattaagtctcactgatgccctaaaatcttctgcctgtttcataaaaagtagaaaatgaagttgacagtgattctttgtatctcataatatcacatcgccctccccaaaaaggaacattgatagaaaactataagatataaaacctaacaaaaatcatctggtgaatagatcccatggaatacacaagaagaagatataggtgcatttaaataatctcaaaggaaaagaagaaatctcctttgagaagtcacatctaaatgcttatccaggctgggcacagtggctcatgcctataatcccagcactctgggaggccgaggtgggtggatcgcttgagcctagttgtttgggaccaacctgggtaacataacaaaaccccgcctctacaaaaaaatactaaaaaaaaaaattagtcgggcatggtagcacacgagtgtggttccagctactcaaagaggctgaggtgggaggattgcttgagcccgggaggttgaggctgcagtgagctgagattgtgccttgcactccagcctggatgacagagtaagaccctgtctcataaataataaataaataaatccctgtccaaataaataaatgcttatccaatcgctgaaaaggagctcaagcatgtacacgaggccccaagcacagctctgtcctccgtggagctggctttattctcccagtgtttcctgctcaggtgcccttttctctttcatttctcacaacactcccgcctctcacttggcattcagtaactgaacaaggagcgggaaagcatgctaatgcatcgcaaatggagttgctgcatttccttaaaaggactgtcatgagcatttcattttaacgtattacccggaattgtgtcagtgttttaagtgaactattttctgtaatccatatcgttatgaatataagacattaacgtactgattgccacttgagaatctcattttaaagtgattgtactgcatttctaaaatttgcatttttaaagcaagtttcccccacaaataacaccttacccaagacacctccaggcagaacgttgtttcttacagtaaatgatattttaatatttggtttcagtagagaccagtctaatcaattatagagtaacatactttacttgtaataaattcaaaaaagtgatagctatactgtcatttgtagatgttcttaagaaatatggaatcttattccagacaggcatttctataactttgtggtgctatcaatgatgctaatgaagatttgacatcagttcaccacatttttgaaaatcaaattgttggctcagccgctaatgaaacacaatctcaaagcagttttaacaaccatttacattttttctgaaaacctcactctaccgtttctatggggtccctgactagaaatatcaaaagtctacatgaatataaaacaatatagtctatttttcaaagagaaattgagactgatgcaaaatatttgacttcttttttttttatatgaaacataaatgtttattcattggcaaagccttaacttctctaagcctcgtttccctcatctgtcacttggcgggtaatcctatttagctcagagggttaccaggagacttaatgggatactgcataataagtactaagcacagtgccccccatcatgtactgcccttggtctgtgctctaatattgaagcaggatgcttccctgaccgctttgtgggacttgcaacaggggtgccctcaattacccagcccacagctttcaactcctcatgggaggaagcacgcatgtgaatgaggcaggaactggagtgcatgaatgctgaaaccagccagccacttaggtactgccaggagcaaacgccactcacttggacccactgtgctccaccccttgcaggggtaagcacgcgggtgagtgggtgcaggagccagggtgagcgcttttgagcgccaacaggagtgaactctgtgcaggctccgtggcagcatctaggggtggtgcctgcaacccctgaagccccagagggcatgttacagtgcttttagttctgctgtccccagacagcctaagtatcaacagctcagtggcttttcacgtaagctggctgccttctgccagtgagtacaaagggcaagtgtgacagccttttgtagccacactagcagcatccgagctcttgtcccacatccaggagaaatgacatcacacaaattgaaggatgacaaatgtaggggatttttattgccgatgaaagtggctctcagcaggaagggaagttgaaaaggggatggagagggaaggtaatcttctcctgaagtccagccatctctggccagattcttctctgatgttacgtgtcaagctgtccctctgaagtgaagctgcttctctccaatgtctaaccatagtcaccaacgtccagctgcttctcttctctctgccagctgagtatggggtttttataggcacaggatgtcagggggcaggcccatgggtggttttggaaaaggcaacatttgagctggaaaacagggatgtaagttctcactttgggctgcagtttctggcttgagggtgagggtttgacagggacccgcccctttctgcctagattttctctgccacctttctctaccattgtatcaatattattatcacatggccctgagttggaaccatcaggtcctgcaaactccagagcatctacttactgcacattggcccccccccaggggaattggtcccagccaagggtctctaggaaagaggcacatcaactagatgtggaacacactccggttttggaagtactggttctgttctccagggcatcagaatcctcctttttgtgaccctgctgccttacaggaaagaaacaacagttgaaacactgggaattttccccaatagggagaaggcacagaaaggagaaagctaaagaagagagtgaaagaggcccaaagagaatggaaaagtgagagcaggccatttgccagggctcattcctgccatccagccccagcttctggctgctcagtggacgcttctgccaatgctcacagccccacaggcctgggcccgggagcctctgctgccacccgtggtttctctccctgttccaccatcggaaccccgtgccccaggctctctcccttgaggccacctcagaaggagataccaaggggaagacagctctttaagaagtgtagactccatgttaaattgagaccccgcagacagatacggctttgaaacaattgattttctgtggtgtcatagggaaacctgccctcctcaaagttgcgaaaactgtcagggaccctatgaaatggagcgggagtcacaagttttctacccagctctaaaagaggagacaaaactaacactggttcacaatagataacagaacggcttcagcaaagggcaagcaagcgtagagagatgctggagaagaacaaggcactttatccatgtcccccacagcaccctgcctcagcgccggggcaaaagaatctttgtgtgagcccagggagtcggcagggacatgaggggttgatgcggcacttgctcagagcaatcgcagtgctgccgctggaattatctttctcacacagttcccagtagtggttaaaaggctctgaggtcagtccgcctggcccactagctaagggctcttaagcatttaaggactctttcaacatttgtttctgttagtttctaaaacttggaacagagggccattgatttaactggtataacaacgtgtgggtacattgcacttgttaccttggaaatgcctctactcagtctcacctctgagctgagttagtttgggaagatgttgagcctacaggtagtggggagatggtgagattcaccaaggcatgtgttgtttgtgattgattgggttgggaaagtttcctgactgccaaaacctccatcagacactagccggggattctgtaaatctcagaattccaaggggattggattttgaagaaaggagatgttcacgtacaggctactagaattcttgttctttttttttttttttttttaaagaattctgaagaagaaaataagtaagagatctaaaacagaaccatattttgccaggagggcagagcagggctgctttgttcaatttgttaagagggtcagggaagcatcagaaaagataaggagaaaaatcaatcagaaccaagtcactgttgtgagtttcggcagcgtctgaagtagccagaaggtactgagaaatgtattttatcacatatagtcttattttcaccctaccgtattttctgttaacacaaggttcctttaaagtcaagtatgcagccctaaatcttatcgacccattaatatttcatccaaaacaatgtaacatcttaaactgaaacctaaatgtaagctttggacacaagcattcaaagacaggtatgttgtacagctggactatggtgagtcaagtaacattttcatttctttttttcttttagaaacagggaaaattgaccaagagattcacaaatacaacaccccaggattcactggttgcctctccagagtccagttcaaccagatcgcccctctcaaggccgccttgaggcagacaaacgcctcggctcacgtccacatccagggcgagctggtggagtccaactgcggggcctcgccgctgaccctctcccccatgtcgtccgccaccgacccctggcacctggatcacctggattcaggtaaagtcttcagcaacctcaggcaggttgcttcatttctttaaacctcagtctcttgggactatggaatggatttaataacagaacctcactggtaatgtcattggaggattaagaaagggcaaaggaacgttgtgagtacggagttctcagggcagcacttagcacatctgaaatactcagggccagaaataaataagttgaaggtaaagaatgtaggaagtattaactcttcaattaggttaaatgatgacttgcctaaactgatgtctgcgccatgactgtgggtgatttgatcaattcactgtctcacttttgcctcttatgactcttaatgacttgctgtaacataatctgtgttttaatttaagaagagatttacctaaagcaatatagagatccgtctcctggctctgtatttatatgaataatactggtggcttccagatctttaagaggtgcctttaagcttgcaaaactctgtggatttagtcccacttctttgagtgggaagacatgtaatttgaaagcacagggctcaaatgaaaggatgtagctgttggctgaaaaattaattggatgaaaagagtatacacataaccctgggtgggagacagcctattaagctgtatctcaggagacttaggtcgtactcctagctccacctaaattggccttgggcaactcaagtgacctgcccaagcctctgctttttcacccataaggtgaagaaggggaggggagtgtaacctctaagtgacctccgaatccaacattcagtgggtctccaggcaacatgtgatgttgctgaagctaaaaagaggaagaagatgaggcaggaagcaacagctaggaggcctggattccagcaccatcactgcctctcaccagcagattaaccttaggcagttttcataacctcattcctcagtttccccacttcctaaatggagataagacctaacccttggaattctatttaaagtgatgtgtttaaatctgacgtgttttatcacaagcgttaaagtttagctacaataatattaataatctaatattattatattagacacaatttgctataatgcttgaaccttgagtaaagacttccaaatcctctccccctgcaaacttgtaatttgtaacagttcattctctaaacctcgtgcatttgattgctttaatcatgttccggccctgcacatggagtgtgtggcttcagtgcagccattgtcattgtgattccttgccagggctgtgctgcaaagctttgtgaagcttagagagaagccaaaattgccctgttgtcagaataacccatttacagacgaaacaatcctctttgttcctcacacatggattcctagaacttgacgcggggcgctgtgagctaagggcacgtatgaagaattcccttttatgaatgttgttaagattacacagtgggctggcttgaacaaaggaaagcattcctaatgctgaaagaagaaaagtaagagtgaaaatacaagaggagaaaagacatgtcagggccacagaggaacagagatctctcagataaattcctccaaatgcccgagtagacaaataccgtgaatgatctttgcaaggcaggagtccttccgctgtcaaagggacccactgcctgaggctgtgagcacctgtggtctgagtcagggccaatagactagtttctaaaacatctagatcctaccttgggccaatatgagttttatgtattattacttaattaggaacttgtttgttaagatctgtgagatatgactgtagggaccaaagagtttttgttcctttactttaaaaaaatcatgctttgagtgtgacaggttttttttttttttttttttttttggagacagacagagtctcactcagttgcccatgctggagtacaatggcaccattgcaacctctgcctcctgggtttaagcgattctcctgcctcagcctcctgagtagctgggattacaggcacccgccatcatgcccacttaatttttgtagagacaggatttcaccatgttggccaaactggtcttggactcctaacctcaggtgatccacccgcctaggcctcccaaagtgctaggattacagagtgctaggattacaggattcttttgattgatttatgaaaatgtatatagggaacatatctgtatttgatgttcaaatccaaattctgtaattctgatattatggtaggcctgtgctatgtaacatgagatccatttgcagaaaaatttccacttacacttggagagttcttacccagtgtccagcagatgaagtattaatgcaattgtcattataccaattacaaggacagaaaacagttgaccgggctcggtggctcacatctgtaatcccagcattttgggaggctgaggtgggtggatcatgaggtcaggagttcgagaccagcctgaccaacacggtgaaagcccgtctctactaaaaatacaaaaattagctgggcgtggtggcgcacgcctgtaatcccagctcctcaggaggctgaggcaggagaatcgcttgaacttgggaggcagaggttgcactgagctgagatggtgccactgcaagactctgtctcaaaacaaaacaaaaaaacaacagaaaacagtttacaaactataaggcagaggtttattgaaataatatgattttcctcttttaggtgaataggaacatgagagacaatgtgggttgaggggctggaaggggcagaggacagacgtagaaatgagggaaggttacttaacagcagcctctggttgctcagtgtcagggaggaaaaacttttcctctgtcctcttaagttcagtacctgggggcctgcaaattaagctgataaaagacagattaacaggtgggcagggggaccttatttatatgcatataggagcttgaaaaagaagaaactcagtaagtagttaaagctagaaacttatatgcccagcttagtagggaaaagaggcagtgggggaaaaggcctctataggaggaacagatggatttctagaagaacaaatgagagataaagagtttgtgatagtgcttgttcatgcaggcctgagtgatctctgtatctcattcatggccataaaacttccctggagagaggacttacggtaggtttcttgatcatcttcctgggagtaaaagccacccgtaagagggaggtatggcagcctcatttttccagaagtctctgctttttgtcagataaaggaagcaccaagaaggcttctttctgcacctattgaatccccagtggcttcagtttaaaatgagttccataccaactcgggttctaagtgcatccctcacatcagcaattgcactctggtttcgtgagcctaaggtcatcattctgaatttggactttacggttttgcacttttctggtaatatttcatgtttgactagaataagattccttgctatcagatatttaaaaacaaaacagtatatacacaaaaatgcctttctacctgtaaataacgtgaggtacttgagtctgtgtagggttaggatggaaagaaaataacatgagagctcgtgagtcctggcttgactagaggacatttggaagtagattatctcatctggtgccttggaagtttattcctcaacaagcagcaatgggtctcctggaagcttttttagaaatgcagaatctcaggcccctccccatactgactaaatcagcattcgtgttttttagcatggttcccaggtgacttaccactgcaatttaaaagctctaatcttgtatagtgcttctcaatctgggaagcactttaaaactacctggggagctttttaaaacccaaaactacctggggagctttttaaaaccctgatgtcaagactatacttctgtcagaggtgtctgaaccagagcaactccatctcgaataggggctgggtaaaataaagctgagacctactgaaaactggttgcagtaaagaagccagctaaaaccatcaaaaccaagatggcaatgagattgacttctggtcatcctcactgctacactcccatcagcaccatgacagcttataaatgccatagcaatgtcaggaagttaccctatagggcctaaaaaaaggggaggcatgaatgatccaccccttgtttagcatataatcaagaaataaccataaaaatgggcaaccagcagcccttggggctgctctgtctgtggtgtagctattcttttattcctttttgttttattattatactttaagttttagggtacatgtgcacattgtgcaggttagttacatatgtatacatgtgccatgctggtacgctgcacccactaactcatcatctagcattaggtatatctcccagtgctatccctcccccctccccccaccccacaatagtccccagagtgtgatgttccccttcctgtgtccatgtgttctcattgttcaattcccacctatgagtgagaacatgcggtgtttggttttttgtccttgcgatagtttactgagaatgatgatttccaatttcatccatgtccctagaaaggacatgaactcatcattttttatggctgcacagtagtccatggtgtatatgtgccacattttcttaatccagtctatcattgttggacatttgggttggttccaagtctttgcaattgtgaatagtggaggaggagaggtgctctgctttttagagtttccagtttttctgctctgttttttccctatctttgtggttttatctacttttggtctttgatgatggtgatgtacagatgggtttttggtgtggttgtcctttctgtttgttagttttccttctaacagacaggaccctcagctgcaggtctgttggagtttgctagaggtccactccagaccctgtttgcctgggtatctgcagcggtgtttgcagaacagcggtttttcgtgaactgcgaatgctgccatctgatcgttcctctggaagttttgtctcagaggagtacccggccatgtgaagtgtcagtctgcccctactggggggtgcctcccagttaggctgctcaggggtcaggggtcagagacccacttgaggaggcagtctgcccattctcagatctccagctgcgtgctgggagaaccactgctcttttcaaagctcagatggaaatgcagaaatcacccatcttctgcgtcgctcatgctgggagctgtagactggagctgttcctattcagccatcttggctcctcctattcttttattcctttactttcccaattgatacagtttgactatgtccccacccaaatctcatcttgaattcccatgtgttgtgggagggacctggtgggaggtaattgaatcatgggggcaggtctttccatgctgttgtcgtgacagtgaataagtctcacaagatctgatggttttataaaggggagtttccctgcacaagctctctctttgcctgctgccatccatgtaagacatgacttgctcctccttgccttccaccatgattgtgaggcctcgccagccgtgtggaactgggagtccattaaacctctttcctgtataaattacccagtctcaggtatgtgtttattagcagcatgaaaacaaactaatacactaataaacttgctttcactttactctatggatgcaccctaaattcttggatcttgcgtgagatccaagaaccctctcttggggtttggatcaggaaccctttctagtaacacttccatgcaccatttctatagtttcttaccagagaagtttctctgaacatgtggagcaccggaaaccacgaggaggcggctcagcattcactcctgagcatgaagctggctcttggtggtgcttctctgcaattgccttttgctgctgatgatcactcttctcttcctttgggagagtgaaagggaaaggaagccatctgaagggtcttcatggttattttttaaaaagaaaaatcccaatatctagtactaaacccctgacggaccaaatcagaccctcggggggataggagggacacaggtgtgtgtgatgtaaacccccctccccaggagtgtccagtgtgtgaccaaggtcaagaatcactcaccaaatgaaagaagggtccctttggtaagtgcatcaaaataaggttaccaaaagaaaaaactgaatacccaaatactgcccaaaacatggtttatgaaaaacaataaagccgttaggtggttaaatcacaaatagtaaaggctgtaccatcaagcttgcaaagagaccaggctctccggccattttataaggaagctcactcagaggagatgtttttacctaaacttgaggagaactgatctgcctgtttgcaactggaaagcagacttgaaacaaacaaatgaacaataaatttgcagtgtggggcaggactcggtggctccagtgaaagcacctcattatgaggaagatgtgaaattattactgtgttttgaattggctgctaacctactctgaaagatagaaaaagatgctgctttaaaatgagggctgtgcttttctgaaaatacagcaggtgccttgctgtgaagagtaaggaatcatatggccttatggttaaagggatcttggcaaaccagggctactcaatccatacctataccaggatgtttgcatacctataccaggatgtttgttttgcaggaacttggtgttagaatggaaattagaattgaagacatctacccataggtctggtgatctttctgctcccatacctgtctttctactgtctgagatcatagtaaatgataaaaacagaaaataggttctaaggtatgctggctttagtaataagattctttttctcatctgtaacactactgttacacttctataacaaacactatttgttacctctccaatgtcctttgggctctatcagtgttttctaaaatgagggacatttatgttggtcaggttgtgcactgcacaactataacagatgtcatttgtagtgcagtctctggcttctggagcagtgcagcatgtagcctagatagggggtcgccattatgggaagcaaatagacatggcctcgtgtaacatacaaagcaagtcatttcctgttcatttgtctttcagtccttctgattttataaagagaaagtctctatttggttctggcacgcttttaacacctctcccatgattgtattttaccttataataaagagagaacaggcttctggttagtgcctcacaggcaatagaattactcagtagggatgtaaagttttatcaatagatttatataaataagaaatttaaccaattttgtgaaaataagtaaataaataatacttggattttacagtatatgtcaagaaaaatatgaaggtgattttcacatgattggagtttgggaaacactgggcagtagagaaagatcaccccaagcgctagggcctagcatggggctttaagaacacatttttatagggggatgaggtaaacaaaagacttacacattatgatttaagttgacttgatttaaaacaattctgctctattggaaacatccaatctttttttcttctagttatttccctctttgataataagtacagcctgtttctaaaccattatatggtccttaggaatatttttagaacagtagttacaaggtagaaaaagtaacccccagccctgagttaaggtttattttaaggtcacagaatgccaggcaattgccgtgatttacctctcagaattatggactctgttgtgtttcttcctttttgtctaatttagggaatcttatttgcttggaatgaaaaggatttgccagcaggaagacagccacagatggcagtgcacattctgtaaaatacaaaaacaaaacaaacaccagaaaaaataaatccaagagtctgatcccataaatttctgcactaaggagcaactccaaactgcacaccaagctgctttaaaaggcgtttgtgttaagccttagagtgttttatcacattcgtgatatttgatacagaatacgtcagaccaaaagccacatcctaggatcttctttaaaatatcattaaaatagatgaagcattttaagatgtaaagtttcatttcctaagggatcctctagttgtaaagattgcagctagttgttgttgttattattatttgagatggagtctcgctctgtcactaggctggagtgtagaggcgtgatctcggctcactgcaacctccacctccggggtacaagcaattctactgcctcggcctcctgagtagctgggactacaggcacgcaccaccacacccagctaatttttgtgtttttagtagagacggggtttcaccatgttggccaggatggtctcgatctcttgacctcgtgatccgcccgcctcagcctcccaaagtgctgggattacaggcatgagccactgcgcctggccacagctagttattttaaaggacttctagtaggtccaggctagattctcagcaaagtttgcatggtatgtgatgtgtggtgcatctcaccccagaaaggacctgggagtccttctgtaaattgctagcaggtgaattcacagcatccactgtaaccttaagttatctggttctctgccctaacgctaacctgcatctgacactgggaggtccttgaccaggaattctcacagctcctccaacagggaagtgggtaggagatggaaaattcagaagcaggagtggagggaagggagttaacacccaattctccacctcccccagaaccaaggccaggattgtcaagaatccagggttgagaatcccctgccaagctggtccagtggattcactcaggttggcagagtggctgaaaaccagccctcttaggcacgtgggtcttctcccagatatattaggaactagatggaacttggcacttgggatcactcagtgtaacaaccccatacccccattagacttgagtatacccagcactgagctaggaactcactcaggcttcccgtcaccacatcggacactttaccactggccacagattggtttctgaagacctcttacctccatcgttatgacttctaagttgatttctgtctatattccaagtttcctttctatcatctggccataaaatatttttatatcttcatgtgcaaagagttatggatataaagaactttttaaaattacatatatcatctattctgttttctacctaactacaagctgatcattggttttctttaccacctgcaagcacttaaaagtaatcattcctgctcttataattacatctgaattatttctgaacagatcccttttctctccttatgctaagactgcatgattaatgcatttttatctctcacactcagtctttttattatgttatttgtctttttccctcttcagtcaccaacacagttcacacttaatcgtgtgaagaaaaactatcatcccttgcttgctaatgtgcattttcctgcaaagatccaaattccacttttcctgcaaaaacaccaagcgcatttatgtatctcaaatcaactatggtattagtcttacctatttttgcctggtcattttagttgtatcccaccttttgtttctacagtgttttcatagaaaatcagtttctacagtgttttcatagaaaatcacattgtatccatgattttgttgagtcaaaggatatgtgtgtttttaattttgatactactacaaaccatcctctaatgatataatccgattgacagtccagcaatctatgaataccttttccccacatcctcaccaaaacagtgcatcatattattcttttaaatgtggctgttctatatgaaaaataaaattttcttgttatagtttgtatttcattaattatgagttgggttaagtatctttgcatatgtttatatatcatttatatttatttttccataaactccctctttatattctttgctccaataattatttatatctttatattctttcctattgatttataagtattcttaatatattaagtaaattagtatttttaatgttttccttgtttcatctcaatttttttgaatttatgggatttttttttccatgtaaaagttactaaattttacatggtgaaatgtaaagtgttttatggcttttgggttttgtgacataccttctccatttagaacttattttttaaattattccatgttttttataataattttgtgttttatttgtaagttctacgtattttcttccctggaaatttatttgggtggaaggtggaaggtaaaaatctcactttattttttcccaaatggcccactgttccagccccattggttgaggctccatcctctccacctttaccatcttctaaattcccttcatttctgagtccctactggactctctggtctattacattgatatgatgccttgtgacatgggagcaaactgcagtacttatcattgagcttttattatcacatttagtggctcatagagctaatttccctttttttctgagttttttttcccagaattttcctgttcatccttgcacatttgcttttcccatgtggatttgagaattttaatcattttattggaattgtttaaaatttttactgggattaaggtttatgtataagttcattacctggtgatgcccagttacaccatgcgtgtcttctccatctctctccaagttgcgaaatgattcagataagtgtcatccagattttaatgtgcttagaatcacctgggggaaattagcaaatgcagattcagctggtcaaacatgggattagagattctgcatttccaacaagctcccaggtgctgctgatgcagcgggtccctggaacacactgggagtggcaaggagataagcagccttgaggcactgcctctggtagatttcataggtttcccctggaaaaccacttgagcccactgcttcttgtgggagcagatctttgacaactctctcaagttattttatgataatctgtctaattagattttctttctcatctaggataatacccgttattttatctttttctagaaattcgtgcatttaacctaggttttcaaactcattactgtggagttgaacagaaacttgttaataatttaatttccattccctttttcgtgttttttatattgaatgtttctgttgaccccccccccttattgattagattatgtggctttttttttttcttttctcaaagaaccagctcttagatttatttgtcaattctttgttttctttctactgtcgtgtcttctttaaatttatatttgctggcctctaactttctaatttgaatgtttggctctctctcttattttccttcttggtggggtgtgtgtatcatggtcttataagaatgtgaaccgaagtcaacaaatcttaaactccagccatgctctcttctgaccacacctctgctgccccagccccgcctccaggactgcaccctccagatgtaattgacaccaatggcttgcactagactttttgctaagggacctgaaaagaacttagaggctggcgtaagttgccaaagccttcccacatcactgagagaatagacttggcaggcttgtgttttgaaaagcagttgggggtgcgctctgtcaaggctcagccatgatgaagaaataatcaaagagcaaaacgtcacttaagtggctaaacatgactggcagcagggttggattccccttcagcatcgaacacctcacaggccatcctctgtgtagacgggctgctttctagtggctccacaggcctggccgtgtcaggggctgcctttattcaaagacttctgttctgtcttaaccaggatcacttaactctctgaaactccagtgataaaaaagcaaaaccggcacaaacatacagctttggaactatctccaaggtcattgttttttcccctgccgcgaatttctttcattcctaattttcctctacctttctttcccttcatcccctacgatagattttgaaccccagggaggttaggactctgtcccgttcttctccctgggctgtccaccctccgacccccaccccacctggcatggcactcaaaggtgcattttcctggggtctgtgcatggaaatcattgcagctgtcagcctgtgtcacgtggggctggctaagtgcggggcaacgcggttgtacatgttgccatggtgacttctctgttgatggcagaaccactgactccagcaagtcacagtattcatttttgcgtcatgctcgtgctacaggaatgctatgagtagcccatgaaaagggaggcgagttgagctcagtgttatcccttgacttgtgtgtctttccttacccccagcgatcccccattcagatgcttcctactgtaccgcatttttgagtattcttcagtatcatgcttctgttacagcaccatatcactcagctatggaagcactcagaggagcacaacaccctctaaattatccgccatcacttcttttacggcctcatttaaaaagacaattgtcagaattcccaggtgtgaattctcacaggggaatctctgtcagtcaccacctggaaatgttagttccacctctgctggccaatcagcacctcatgtccttgctatgatctctacagttgcagaagcattatcctgatgaggtttttaacacatcaccacatgcttttcagagaaaagtccttttataaataccaataactaaacatgataaattgcttcactcctttgagatctttgtctgattccacgtgctctgcatagactattcagaaattctaaagacggatgcagattcctaattctgctgttgagtttgttcctgagagcaacgctgaaagacttttaaaaaattaaaatcagctttatgttgaaatgtaattgtacataaatagccatatgaatgtggggtacagttattttaaacatagaaaataagatgaattgttttggaaattcccctttaaacatgctaaaatgattttcaatcattgacgggaattttaacttttagaaaactggaaaggatacagacaaaagtagtgataacttaaatttgtaaactattttatttgttgaaatgctttaatgcatgattttgttttatcctggaatggccacatgtggtaggcaaagtggacattatcagccacattttaaagataaggaaaatgcagctcagagaaaataaatgtattcattccctcagcaaacactgactgggtggccacagaagtgcggtgcacaaccctggctgcacatcagtcacctggggagcttttcacaaatcccaatgcctgttccccatcccagaggattcctggtgtgcatcaggattgtgaagcaatggggactgagtttatagcaccttactctaaagtatgcagagactagcattatgaagtggaaaatgcatatatttcagattcagttatttttttcccactattccttcctctcaatgaaaattttggagtaaaacatataattccagttctttattctgaactgtcttactattttctatcaccctttaaatataatgcagaagtctggaaggatatgtaatttgcatacctgttggtgaaatccctgctactaaatacactttgctttttcttgttccacattccccttttcgacagggaataaatcatccccaaggctgctagagccaattaaatattttttcacactccgttgacatgaatgagaagaactgtgacagagccacacggctcatgccaggactttatcacgctatctttataatgatgtgagccaggcaccagggaggaatggtgtggggaaccatcaggaagctttaataaccaaggataatttgtttcatcagtttctccttgatggccatttgccatttcacctgtcaggaagcaaaactagttgtcttgtgagatctcaggttaactcaagaagagaacagctcagacaacaatggaagcatatttagcatggagcttttatactcagttctctgaagtcagccttcttggaagaaaatacattgtcttgggattggaattataaatttcccttgtgctaatgcaaccgaaaagagtatttcaaaaccaagagccgaactgggcattcataaaagacttaaaatatgtgtagaattaatttttaaaagcactttaggtttgcccatgccccccttctaaccgcacagtggagacagaatctggtcagctgtctgtggtctgggtgactccaccatgttctcagcaacgctcctcatctatgtattatactagtttctgaaaacttaagaataaaaaggatcaacctcacattttgatgaaatagcagttacaacacaaacatcccatgcctattggcagaactggtccacagagcacagaagcacattcatcgtgtaaagctgaaaacagcgtcttctgcaagttgagataccgaggttccagcagaagataaaaagcatttaaaaatatttaattattcactgaactcctttgaaagacacaggatgacaaagcagatcaataatattcagccatttccaaagggtccatccacagccaaagtatggcctttgaatttactagaaatttccacagagggagagtaaaaggaatcccttcatccttgcttgagtcctaaaataacatgcgcctaagtattctcacaaatgatgaagcgcatctcttgagtagacttaaggtgataaaatgttattttcactgagctcccaagccatacatcatggaagtccaaagcccttactgataattgcataatgcccaggggatgtgtttctctgcagaagtctgaagacaatagatccagggtctcctgaagactttcatcttatgaattgtgcgaatccctgaccactgcctaagaggaaaggtgaaatacatcagagaatgtccttaaaaatatccctttttgacttactataattggttgctttcctcttttaactatcataattttctcagccaccctctccctagaaactggggctatttctatgactcagcaaacaaccaattcttgctaatactgctttgctaataaggaaaccacaagttctcttagctgagactcctgtatagcaggtgtgttcacaaaacttggtgagcacccatatctgagacacagcattccataaagccagaggcagtcaccgaggctgtctgacataccataatatgcccgtatggcttcaggctttccaccctgatctggctgtatcccgcattgcacccatgcagcagcagaaccagcagtaagaatgttttgtcaaaaaacaaatccataaacttcaaaaaaatccacggtacagtatttttaaaaatacgtctagccaggcgcagtggcacgtgcctatagtcccagctacatgagtccaggagttcaagatcagcctgagcaacatagcaagaccctgtctctaaaaagaaaattttaaaatgcatctgttctctctcatatatgcctttaaacgcatccatagcatcaagaacctaaatgccaacatcccaatatttttcctccctgataaacttgctttagagattcaacttgtatttttgctttgaaccaggaaaggtatccaaggtcatactaagataaccatttattaaactctttggctgttttttcctaaactgtaataaactccccctctccaacattcaaaataatagtaaataattctctctgaaattaacacagtgttcctattattgctttcacaacactaaaaagaaatagaactaacggagtcgaactgtggggcattctggcaggcaaatcattaaattcacacaaatgattcggccaagggaaaaaggacaaggttctcagaaggaattatttcagctccctctcagacactgctttaaattaaaacacacacacacacgagcagctgaagacctgagtcaccaatggtctacattaaatttctgcaactgaaagtcaggcaggtattcaagcactctgggagcctgttagaaatacagatgcccaggtcccccacccgagaccaactcaggcagaagcagcatttttaccaaagctcagggcatccgtatgccccttaatgtttgaaaggtctgaatcagagtgctctcccccaaaggcatctcagactgagatagaaattgaagaaaaagcctaaggaggttcagcaactttttcaaggccgaagaacccaccagttacacaagtgcagagccctttgtccctgacattcagagccctgcatgcataggaagtgacagccccttccggggcaccctgctgccgccacgcgcattctggaaactgtgcagcaggagaaacagcgttttccttcagaccggggtttaaatggcacttcccgaatttatattcccctagatttggggcttcttccttcttgcactcctgttaacatcagcatgaattcataaactccctgcagcggaaaggaaaagaagccgcgacaaacctcaacgaagagccgtacggcactgttaaccaagtgctccagtcctgccccagtgtttacaggaaattggttccaggacccccaaagacacccaaatccacagatcctcaagtttctgatagcaaatagtgtggtaaatacctacatataacctacacacaccctcccatatactttaaattgtctcttgtagattacttgtaatacctaatacaacataaatgctatgtaaagagttgttggccaggcacagtggctcacgcctgtaatccaagcactttgggaggctgaggcaagcagatcacgaggtcaggagttcgagaccagcctaaccaacatggtgaaacccaatctctactaaaaatacaaaaattagccgggcatggtggcgcatgcctgtaatttcagctactcaggaggctgaggcaggagaatcacttgaacccaggaagcagaggttgcagtgagctgagattgtgccactacactccagcctgggcgacagagtgagactccgcctcaaaaaaaaaaaaaagatttgttatgctggattgtttagggaacaatgacaagaaaaaaatatctgtacgtgttcagtacagctgaaactttttttcccgaatatttttgatctgagtttggttgaatccacagttggggaacccgtggatgtggagggccagctggatagctgctcctggcagtgaggctctctgatccagactttcaaggttcaccctgagaactacagtaagatacatgagagagtcctgaatgaggagtcgaaagacctcgtcctcgtagcagcgactctggcacccaccaaccatgtggctttcacctaattatcatccattctgcatttttgcctccttaactgtagagaggttgtggaactacagaatctataaaggccagctgtcacaatcaatactttacaagtgcccacaatattttacaataactttgaccattgatttataaacaattataaccaaacattaggactggaacaatttgcccacctgagaaataacaagacatttatctcacatgaaaatggacaccaaataccttaccttcgtgtttattttatgaaatacaaaatctgagcatatattaataatgagctatttttttcttttttcttttttttttgagatggagtcttgctcttttgcccaggctggagtgcagtggcacaatctcggctcactgcaatctccgcttcccgggttcatgctattctcctgcctcagcctcccgagtagctaggactacaggcacccaccaccacacccagctacttttttgtatttttagtagagacggggtttcaccgtgttaaccaggatggtctcgatctcccgacctcatgatctgtctgcctcagcctcccaaagtgctaggattacaggcgtgagccactgtgcccggcctaatgagctattttcaattaaaatacctctttatcgttaatcagacaaaagagtacaatgtcagcctactctgagagcattaagaaatctttttcctgaaaggcaattgagacaattcagaagttaactaagtaactgatggaaagagggagtacaatggaatcaattgcccactcagtcctttcatataaaagttggtttaaacaatcataacatatagccgatgacgacaaatttgtttattctgtttctcttcactcgacctcttttggtcactggatcttggacaatcatgaaagcagctgccactttctcattcctttaagaagctggaaatgtaaagcttgtttaacttttcaagtcaggagccaaaaagtcacaatcaccttcccctgtttgaaattggaaatgctggctggctactttttttttagaaactaggaagtgaagggtagagagagaaatgtgaaactcaggatcatgtcagtacatgccacataatgctctgcctacggaaaaacctgctgacttagagaaatcgctccctcccaaaaatgtgattagcagggatcctctcttaaaataaaacaatgtcccttatatcttcagcatcttagtcgataaccatttgttttcatatctgtttcagaaatatcaatagtgaatggctaaaaacattatttaagaaaaacaatcattttctgctatataactcagatttgaaaacagaataaaatgtaataaaacaaagaagctaagaacaaaggcagagatacctcatctcgcccggacccactgtaaaaataatgttgcaatttaaattaaattataattaatagcagcagttttgttgaagtgtctcaaattattactttagatgctgaaactccagtggtttccatggagatattttctctaggagatgtcagatatgatctaatttttttgtctctgatatatgacaacctgaagcttccagagcctttcattttggggggttttatgttagatatttcaatttatttttatatgcacttcaatatgttttgtttgcaattggtttctgagcctaaatattttgaaacttagtaaataagaaccacaaccaccaaatttatcttctgtagttaaaaaaaaaaaaaaactttactctctccttattcactaggacagacaaacatacttctccttgggtgaggagcatagtagtgcatatgtgtgtgggcgctaaagccttagccaggatgtttactaagtacgttcctgggagaagactctcccatcatcaattcctccagcaatatgtcctgcctggcctgtgcttggtggaggaggggaggagagctaatctctgagtggtgcaatggaaacatggtctacaaatataggaacacggatgactacacacaagggcacgtgcaagggaaatatgcagaaatatgtgggcttttataagactctaaatcagactggaatggcaccatgctttggtggttaacatggagtgtcatttggggatccgcaagagaagtatgttgaatagagtctgtgcttatttgatgaaagactggtcttgagaatgttatagctagtctgttttaaattaacacgccaaatttggacctactcactgtttcccaaagtataggttccttgatactccaacaccactaaaattgttcagctctcccagcaagctgggtgaggggaacgtggatgttagcagtagaataggtgagctttattatccatgtctcagtcatgtttcttggtctccgtttttctctgtgcgcatttccaagaggatgtttgttcccaggggaaaggtcagtggcaataaaatgtatctatcaaaatagcaattgtgttgatcgccagaataaaatggctttgcctcaagggggtaagcactcacatgcattaggacaaccaggcttacagcataaataaatccaggaaaataggagtgctcacactaaacaaacaaaagattttgcccttgaaatgtataaggattcctgacctgaggattttctacaagttattttctaacaataaccaaagtccagcggactaggagtcactaatatattttctatattcaatatgtccatctcctttgttaggaagaataagaaacctgcctcactgtaaggatttagttgagactaggcatctgactttcaaaattctacctgcatagaaggttttgttatcagaagaagctaccgatgtttacatacctcttaatcaactgattttaattatgccagccaatgaacatccatttagcccttgctactgcattgttagtcactggaactgcaaacatgattaagattggtctctgacttgaagaggatgactgtcatgtaagaagtcacaagaattaagattattcccattgagaaaagggacacacagtctgaggtcgctgaggatactttcaggaaagtggtaagatctgatggacaaagaaaaggatagtaaaccagatgtccagacagagtgccatatggcagagaaaaggtgtgtcaactggaggcatcaggaactcctatgagacgggagagttccctagaccccttcactggacttgcaacagggtacagctcactcaaaccttttgcgggacggcgagcacacaggcaagtgggtgccaccgctggggtgaacgcttttggtctccagccccacagcagcatctaggggtatgttacaattaatgctgttttaacagttactgtctggggatggctaagtgttaaccagctcattggagacagggtgacagacttttaccccctgccctcttggtacccaggtccttgtctggcatccaggaagaatcaggtcacacagttttattgagtgatggaggtggctctcagtgggatggggagctggaaagggatgaaatgggaagataattctcttcagtcatcctcagcgaaactgctttccaactgtccagttacctcttcaacattcagatgctgcttctcctcttgatgttcagccgcttgttctcttctctcctctgccacactgctctgctcctctgccagtggagcttggggtttttatggttacaggactggggggcatggcaggccaggctggttttggaaaaagcagcatttgggtgggaaaacagggctgtgaatttctcatttagggctgtgggctcaggtttgtgtgtggaacccttgccagggactccaccctcttctacccagtatttccctgcctcctgtccatatcacctatacctagaatgttgagttggaaaagtgaccccaggaaggaaggggcaggagagaaatccagctcaagggagtctttcttccctatgccaaggagttcagatttacacccaaaacaatcgtggaatatttttaaatgttcctccctagctcttgtcattctccttgcgtcatctcaggtaactccttccactatctccgtatgttctgctactgtttttatccgtaacctcaagggaaccagattaccattgtaattttttttttttttttttttttttttgagacggagtctcgctctgtcgccagggtggagtgcagtggtgcaatctcggctcgctacaacctccgcctcccaggttcaagcggttcaagcaattctcctgcttcagcctcctgagtagctgggactacaggcacgtgccaccatgcacagctaatttttttttttttttttttttttttttttttttgagacagtctcgctctgtcaccaggctggagtgcagtggcacgatctcagctcactgcaacctctgcctcccaggttcaagtgattctcctgcctcagcctcccgagtagctgggactacaggcgcacgccatcatgcccagctaatttttgtatttttagtagagacggggtttcaccatgttggccaggatggtctcgatctcttgacctcatgatccacttgccttggactcaccgtgcctggcctaccattgtaattttttatcactatatttaatatatttcgaaggtacatattatttaaagaaggtcggccgggcgcggtggctcacgcctgtaatcccagcactttaagaggccaagaccggcagatcacgaggtcaggagatcgagaccatcttggataacacggtgaaaccccgtttctactaaaaatacaaaaaattagccgggcatgttggcgggcgcctgtagtcccagctactcgggaggctgaggcaggagaatggcgtgaacccaggaggcagagcttgcagtgagctgagatcgcgccactgcactccaacctgggggacacagcgagactccatctcaaaaaataaagaaagaaagaaggtcatgacggggcaggggataagggaagacaaagaaaaaggaggtcaggaaatttctgcgtttatcaaaaggagacaggaaatatcactcactcacaaagtatccaaatatctagtaaatatctccacctgggtgccccattagcacctccaactcaatatgtccaatacaaaactaattaattcctcatcacctaaaagggctcctcctcccatagtcccaacccaagccaaactgtctgcaagctgggacttcctcaacccttcaactccttgtccctttctagccttcaaaaggcagggtagagaagattgttgactttggaacgaaccctacacctgggttctaattttaactagactattcacaagcttggtgactttctagaaggatatggactaaatagtgtccagagaagagtaattataatgtcaaaaggtctggaaaagatgggcagtaacggtgcaagttttcattcctgaaaaatagcttttggtctttgaagggtggcttatgccagggaattgtatacattcataaccaaatcttcctgtgcttatggtttatgggtagcatgacttatcaggcaatttactgtaaatggacaagttcataactgaaaccacatccatgcttcagtatataatctaaagactatataaaccaaactcttcaaggatgcgtagaataaacagaccatgtcggaccaagaagttctcattagctaaagaactttattctttgtctattttattgttcactgtatatcctcagcacttggaaagaagtctgacatatagtaggcattctataaagatttagtgaataagtaaatgaataaatttgaagagaagattcaggtttaaaaaagaaagccaaggtttttattcaaggtttttattatatgtttttatataaaccagttttattcccacgggataattttaggactaatcttatatctgatgataagcctaataaatgaaagatctttgcattcttgggctgacatttgggattgggaatattaatccacactacctaccccagaaaatcctgaagggaaatgggaaagtgagctgatgagaaagtagctgactacactgtactacatgttggctctccccatttccctgcctagctaactggatttaggattggaccaattggccgggcatggtggctcacacctgtaatcccagcactttgaaaggccaaggtgggaggatcgtttgagcccaggaattcaagaccagcttgggcaacatagggaaaccccatctctacaaaaaataaaaaaatttgccaggtgtgatagtgcatggctgtggtcccagctactcaggagtctgaggcaggaggaacacttgagcctgggaggtccaggctgcagtgagccatgattgtgccactgcactccagcctggtcaacacagcaagaccaaatcttaaaaaaaaaaaaaaaaaaaaaaggattgagccagttaaaacaagcaaaaaccatcagtggtctcttttgcatcccccagttaaagacttggggaatatgaaatccttgaatacccaagagttaagttcactttcatttgtagcttgcttagtgtctgtgcttttactcagtcaactgatagttgagataatttggaatatatatacgtatctatctaaaaagtataattttcctggtcctaaacaagaatatcaagtctggccaggtgcagtggctcatgcctgtaattgcagcattttgggaggccagggtgagtggataacttgagatcaggagtttgagaccaggctggctaacatggtgaaaccctgtctctactaaaaatacaaaaattagccaggcatggtggcaggtgcctgtaatcccagctacttgggaggctgaggcaggagaaacacctgagcctgcaaggcagcagttgcagcaagccaagatcacaccactgcactcactccagcctggacaacagagtgagaccctttccccacactgcccccgccccacacacacacaaaaaaagaatatcaagtctaaaagagaaaggattaaatcacatgtgttgaaagaatctggaatctccctttttggttgccatatttccaagagaagaggaggaaaaagggctctacctgcttttcatcattatcccggataatcttggaagtccatagcccaggaataaattagtgttagaaaacggagtatgtagcaatgttctccctgaatcataacataaacctgtttgcctggtgtgtacacatttcattgtaccaaataagtacttctaaattctttttacatttaactggtgccatccagtagccagagcttgctttagactaaggtgacctgcttctgttggaagatttaccttaacttctccaacagaagaccaacaaatgtgaattgtttctgaagttggattaggtcctatggatgacagaagatagtctgccgacttgcagatggacttcgggatctatttgcctttaccgggcttaaaatttgttttatcttagagaaatacctaaatttaacacaactgattcttacgtttataatagggaaagaaatagaaaattcactaggcagttaatattcttaactgttttgaattattacccccttacaaattcctaaagtgtgccagtgtcttattacagccatgaaaaatacaagtttaaaggaatgattcctttttaaactttttaatactgtagctgtaaaaagctcatctacaaatacattgaatgccaccagttgtgcatggggttaaaagtggatgggaagcagatttcaaccaaatgtaagaaacatattcaaatgcataaactcgtctgtctgtggaactagagcaggccagctcaggtagctctaggattctctaatattgctccaagtgggaagtcgtgtttacctaggccttgtgcaaagagaaacagcaggaacagggatggaggctgttgtgattcttgtgggagacaatggcaagacgggtccatctgaaatggagatttcatttgggaaaacaggaagtgttgaagagttgcatgaagaaataggtatcaaattatttgggatcaatagtatacttgactctgacacttgactctttctttctctacagccagtgcggattttccatataatccaggacaaggccaagctataagaaatggagtcaacagaaactcggctatcattggaggtaggtgatgtctagaggaggcttatatggggctactcaactatggaaagtaatagttgtcaataacatagtagtctaggaaaaaaagttttctaggtttttacattattcattttgctgtttaaagattatgacatatgatgtgaagaaatatagtaaatatagccgggcacagtggctcacctctgttatcctagcactttgggaggccgaggtgggcagatcacctgaggtcaggaattcgagaccagcctagccaacatggcaaaaccccatatctactaaaaatacaaaaattagctgggcgcggtggctcacgcctgtaatcccagcactttgggaggccgaggcgggcggatcacaaggtcaggagatcgagaccatcttggctaacacggtgaaaccccgtctctactaaaaatacaaaaaattagccgggcgcagtggcgggcgcctgtagtcccagctactcaggaggctgaggcaggagaatggcgtgaacctgggaggcggagcttgcagtgagccaagattgtgccactgcaatccggcctgggctaaagagcgggactccgtctcaaaaaaaaaaaaaaaaaagaaagaaagaaagaatatagtaaatgtaacctggctactttttaatgctggcttgtaaaaaacaaatagcagtggaaagctggacagactcagaataattaagtaggtagtagtgaccatagccaggacatttctttatccccctcggatatttttcagtcttatcctttcgcatccaaaatggtccaggatagcgtactataaaaaaatgaaaaggaatgctgggtgcagtgacttacgcctgtaatcccagcacttcgggaggccgaggcaggtggatcatttgaggtcaggagttcaagaccagcctggccaacatggtgaaaccccatctctaaaaatacaaaagttagccaggcgtggtggcgcattcctgtaatcccagctactcgggagcctgagacaagagaattgcttgagcctgggaggtagaggttgcagtgagctgagatcacaccactgtactccagtctaggtgacagattgagacctttctcaaaaaaaaaaaaaaaaaaaaaatacgaaaagggaaatgccagtctgatttcagttatcataataaaaattatcagaaaatcactggaggtcattattttaagtgaaataagctaggcacaaaaagacaaatattgcatattctcactgatacacaggagctaaaagatttacacacatggaggtagaaagaaaaacacgtaacagagattgggaaagttgagcaggaggaggaaggagaatgaagagaagtgggttacagggtgcaaacatacagtaagaaagataaaaggaacaagttccgggtttgctagcagggtaggatgactatatctaacaaaaatgtactgtacttggttgatgaacccctaaatactatgacttgaccactattccttatatacgtgtaacaaattttctcatgtaccccgtaaatttgcacaatgaaaataataaaaactaaaaatgtatcagaagatttaacaagctgtagcatctaaaatattccagtgttttcttctcaccatggacagctacataataatttgactctcctcggatagccactgagcctcatgcgtagatcgatattgacatccctgttaccattaagatcccaatcctcactgtcttttgcttttttaaatgaacttaattgaagtataatacgcatctataagtgtaacaagtccgtaacttttatttattattattttttgagacagagtctcactttctgttgcccaggctggagtgcagtggcgtgatctcagttcactgcaatctctgcctcccgggttcaagcgattctcctgcttcagcctcctgagtagctggaactacaggcacgcatcaccatgcctggctaatttttgtatttttagtagagacaggattgtaccatgttggccaggctggtctccaactcctgacctcaagtgatccactcgcctcagcctcccaaagtgctgggattataggtgtgagccaccgtgcccggccccaatcttttttatagtttgtggttggtttgtcctatctaaaaagtctgcctacccaaaggttttgaagattttcagctttcttctagaagttgtatcactttatcatttgccatcaggtctttaatcacttcgagttaatgtttataaatggtgtgagagaagagtcaacgtcagtattttccaaatgaatatctagtcattccaagaccatttgttgaaaaaaaaaaaactatacttttcctcaattgaattttcttggcacttttgttaaagcaactgacatatgtgtgtgtgtgtgtgtgtgtctattttctgggctttttgttttgttggtctatatatatctttccttagccaatatcatgcttgctttattgttgtatctttttttgttgagatgggagtcttgctttgttgccaggctggagtacagtggcgcgatctcggctcatgcaacctccgactccctggctcaagcgattctcctgcctcaacctcccgagtagctgggattacaggcacgcaccaccatgtccagctaatttttgtattttagtagagacagggtttcaccatgttggccaggatggtctcaatctcctgaccttgtgatccacccacctcggcctgcaaaactggtaggattacaggtgtgagccatcgctcccggcctgttgtatctttatactaagtcttgaaataaacaatgtaagttctctaatcctggccaggcgcggtggcgcacgcctgtaatcccagcactttgagaggccaagacaggttcattagaacatcttaacgatatttagtatttctatctttacatggtgtatctatacgtttatttgtctcatcagtttctctcagcaacgtattgtggttttcaatgcgaagtcttgaacagcttactatttcattaatttcattttctaagtgtctctctctggcatataaaagtataattgatcttttatatcagccttgccttctgtgaccttgctaaatttgctgttagttctaataactttttttgtatattcctcagaattgtctacctagacaagcattttatctgagaataatgagatttttttacttgtttctttccagtctatatccttttgttgtttcattgcaccgggtaggattttcagtacaaaagtgaataaatattgagatttgacaattttgcattgttccctatgttaggggaatgtgtttgatctttcactatgaaataggatattggccgtaggtttccaacagatgtcctttatcagattgagaaagtttcttctactcatagtttactgaaagctgtttgatgaatgggtattggaagttttccaaatgctttttccacatctatttagatgatcatattgttttactccttatttgcttaatgtggtaaatcacattgctttattttttaatgttaaaccaaacttgcattcctaggattaacattatcataatacatgatcttttttacatattgctgggtttgatttgctaaaattctatttaaaagaatattgtggccaggcgtagcagctcacgcctataatcccagcactttgggaggccgaggcaggtggattacctgaggtcaggagttcaggaccagcctagccaacacagtgaaaccccgtctctactaaaaatataaaaatcagctgggcgtactggtgggcgcctgtaagcccagctactcgggaggctgagacaggagaattgcttgaacctgggaggctgaggttacagtaagcccagatcgtgccattgcactccagcctgggcaacaagagtgaaactccgtctcaaaaaaaaaatatatatatatatatatatatatatatatatatatatatatatattgctccatagttttcttgtaacatttttctggttttagtgtcaggataatgctggtctcataaaatgaattgagtagtgttttctcctcctatattttaagaaagatgtgtaggattggtctaatatcattaggtaatgcttgttagtagtattgttcgagtcttttaaatttttgctgattttctgttcaattgttctatcagttactgacagaacagtgttaaaaaatctccaactataattgcaaattggtctaattgtcctaccagttctgcccgtttttgcttcatttattttgtacttaggttagatttatacacattaggaacattatgtcttcctgatgaattcacccttttgtcattatgaaatgttcttcatttctactaacaaccttgtcctttgtctcatattaacgtagctattccagcttatgattattgtttgcatatcttttcccacccttttactgttgacctgtatttaaagttcatgtcttgtagatatcatatagtaggcatcttttttatccactgtctctactttttaattggagtgtttagatcagttatatttacttctgttttatctaatctgtattatttcatccagtatttttttctttttccattttttttttttagacagagtcccccccccccccctcacacaagctggagtgcagtggcacgatcttggctcactgcagcctccgcctcccaggttcaagcgattctcacgcctcagcatcttggctagctgggatcacaggagcgtgccaccatgcctggctgatttttgtacttttagtataaaagaccgggtttcaccatgttgcccaggctggtcttaaactcctgacctcaagtaatccgcccgcctcagcctcccaaagtgctgggattacaggcgcgagccactgctcatttcagacattgtgtgtttcacctctacaagttccacgttgtctcattttttttcccctcattttgatcatgttttcctttaaacccctgtgcaggtttctaatagctattgtactgtcctcatctgctcattccatgctctgtcctttctgtttctaatagctattgtactgtcctcatctgctcattccatgctctgtcctttctggctctccttctaattgactgatgtttcttctggtcaagtgacattttgctacattttttttctctgaattatttttctctgcagcttgacgttatttagatgtgttttaaagctttttcaggacagagctagagtagtctttattctaggcctattttagcaaacaccttcagcatgaccattctatcaactgtattaaatgctctgattgttcaatgaggtctcttcagtgtggttgttggactataaacatctcccagccctccgtgagctctggttttttgcctggcctgtggacttttattctgtacatgcacatgttagtattattcggccacaaattcagagagacttatgtgcagattattagggttctttctatacatagctctctcgcgcgcccactctatctcccctctccattcagggaaaccactgtgctttcttgtgctgcccctccctacactgctgtccaaaaatcgctgccagccagaaaactaggaaaaatgtaggattcctcctttttgtttctctgttctcagacatcatggttcctttctgcctgttttctaatgtctgtagactgtcatttcatagactgtgtccagtattttagttacttttggctggaagacaagttactcctgtttttcctgttactccttcatggacaaaaacagacatcttacttcatttttgttatctttgttgttttggaggttgtgttttatatgggagagggctgtgtctgacggagctgtagtgaagtggggacagtgttggagggactcccaagccctgtctaacctctcgtgcttctcctttctccgtcaggcgtcattgctgtggtgattttcaccatcctgtgcaccctggtcttcctgatccggtacatgttccgccacaagggcacctaccataccaacgaagcaaagggggcggagtcggcagagagcgcggacgccgccatcatgaacaacgaccccaacttcacagagaccattgatgaaagcaaaaaggaatggctcatttgaggggtggctacttggctatgggatagggaggagggaattactagggaggagagaaagggacaaaagcaccctgcttcatactcttgagcacatccttaaaatatcagcacaagttgggggaggcaggcaatggaatataatggaatattcttgagactgatcacaaaaaaaaaaacctttttaatatttctttatagctgagttttcccttctgtatcaaaacaaaataatacaaaaaatgcttttagagtttaagcaatggttgaaatttgtaggtactatctgtcttattttgtgtgtgtttagaggtgttctaaagacccgtggtaacagggcaagttttctacgtttttaagagcccttagaacgtgggtattttttttcttgagaaaagctaatgcacctacagatggcccccaacattctcttccttttgcttctagtcaaccttaatgggctgttacagaaactagttcgtgtttatatactatttcctttgatgtcctataagtcggaaaagaaaggggcaaagagaacctattatttgccagtttttaagcagagctcaatctatgccagctctctggcatctggggttcctgactgataccagcagttgaaggaagagagtgcatggcacctggtgtgtaacgacacaatcagcacaactggagagaggcattaaagaaccagggaaggtagtttgatttttcattgaattctacaagctaatattgttccacgtatgtagtcttagaccaatagctgtaactatcagctgcaataccatggtgaccagctgttacaaaagattttttcctgttttatctgaaacatactggatttatatatgtataagcgcctcaatggggaattagagccagatgttatgatttgtttgctctttttcttttatagtttagttatagcaaaaatatggataatttctagtgaatgcataaattaggttgcgtttcttattttgctttaaatctctggtagtttttccacccctgtgacacaatcctaatagacagtgtcctgtaaatggacacaacacaataaagtcaagttattattgctgttactctggatgatatggaaaacactgccatattttaaatcaactactccacgtgtttttccatccaatcacactgctgtgattcagggatctttcttctaagacggacacatttgaacctcaggttcatcacaaacctggtacctgttgcttcccagaggatggagaagtgtagttaatcacacctcttagtttaatctgaaatcttgacccagttatttaacaaataaatacctcattgattatatttaaaagtaatacacttcctgtaaacaaatggggacaatgcatccaaaaaatctttttaaacagattacacaaaaattatttccagaaaggctaccatttatcatcattatatttcaagcctcttatacttaataagcactttctaaaaagtcttgagatcccaccattctgaggaattcaatatgatcactttttccttctttgcctgggagaggttaagaggaggtttcgaaggtatagatgctattgttctgatggcccggctgaataaaatggaaattctagtttgttagaattatgcattctttttcaagattctcagtgtgcctaacttattggagcacatcagtttcttgggtaatggaaaacattacctagagttgccagtggcacattacaccagtacagagcacattccaaaggagacattggaccagttaattcccatacaagtcaaggtaacagaacaaaagggaatcctgatgcccttttaccattgctggttgagctcaggcactgtcatggacacccttaattttaaaaggttttaatcattcttctataaaatacatttaaaatggaaaaatacttaatatcactaaatatcagaacaatgtaacatttacaaatgacatattgaaagcaaaggctgttttatttagccaagatgattaccattaggagttactttatgtattgttgaaagcaaattttaaacatgatgttttagaagtgtttctgatttttaaacctggtttacaggtattacttctgcacttaccaaataatgccagatggaaatttattatttcttgcaattcccatgatagctctgttctttatgcattgtctcaacactttcccttttttcccaaaatgagtagagaattaaagccacccaaaacagcttctgctactaaaatgttctcatcctttctcctccctctccttttcctgccacaaaaggtgaaaaatgagatccaatcctctcaccaaaatttcaaacctaggacactggaatgactgcagggatcagtggttctcccatatcaccatcaattaagacatataggacactgtcttccttcaagagggttacaatgtggccatcagacaggaaaccaaacggtggataaagtattaagtaactaagtgccaaataaatgctggaaatcttgacctctccttgggattatgggtgtaacaaaaatccctacatctgtttatgaaggccatattcagtacattttaaatggtaaataatctgtttatgtgaagaaaaagaattaagtctttcttccaactctctccttggatagcctagcacagtgcagcctccataaccatgacattcccgcccaagctctcagtgcctaatcctgctttgtcattcacatctcacaaaatcttgacatcttacattccaatacattatcaagcaagcacaagtatgctggtagtagcctctttaaataatatgtatagacaacaacaacgacaaaaaatagactgttttaaagtttcagggaaagttggtggctgatttaaagttgtgcaggaaacatcttctgtgtatgaagcaaatgtcgatgttttgaaaaaagctaggagatgactttgaatgaatgcaaggttagtgagatcctaagctctcaaaatagcatattccctagagctcaagaaagctggtccaggaggttgaaaaagctattttgttgttaaattattttctggcccttcttaatatttaaaaatgtatttccccttgtggctttcaaccacctgctcaaaaaaagagacttgttacatgaaagttttcattaaagagctgaaaacaagaatttagagagccattcctagaaaatgtcctactgccctgcatttgacaaacaagcatcctttactaacaagagcaggaattcagaggcacaagaaaaagcattggcatgagccaaagagtctgtcttaatgttacttttgaaaatctgctgagcggccaccatatgcaggctgagagctgggcacaggcgaagccattggaagcacttcaggaacaagcacacagctgtgggacttgaacatgcaagtgttcaggttgtgtcaagaagcttttctttccttctatgatggaatctgttcttttctatcctacttttttctctcttcctctcctcaccacattataccctgctcttacgcagtaaacgttttaatggcccgtttatgtctcatgcctccaaacaacactgaatttgaaaccccccattttttcttttcaccaccctgttgagcaattttcccaaaaaaagggcagcaattattaaattgaattcaagtaagccagccaaagataggtcctaaattgctagtcccagtagaaccacctgatcctaaaccagtgcgaaacaaacagtaacaatgtccccagctgacttcagctaagaaccaatggctcctacccccgccccgcttttttttgttgttttttgttttgttttgagacggagtcttgctctgtcccccaggctggagtgcactggcgcaatctcgggctcactgcaacctcctcctcctcccacattgaggcgattctcctgcctcagcctcccaagtagctgggattacaggcacccgccatcacacccagctaatttttttttttttttgtattattagtagaagccaggtttcaccatgttggccagggtggtctcgaactcctgacctcaagtgatccgtccacctcggccttgcaaattgctgggattacaggtgtgagccaccgtgccgagccagccccattttttaaatgatgttttggttaagagtggaccatgagaattagctgacagcatcccctttctctctccctgccttggtgggaccctccctgtgtgaccttggtcaagtcctcgaacttttgtcccgtatttaagatggagctgttttacctacttcataagacagttgcgaggtgccattgattcttgactgcaaaataccttgaaacccttatataaagactgaagtcaacggagcctagtgaaagacttactttgtggcttgtggttgaaagtcacatcaaaagacaaatgtggccacgttcaggaattggagacttactggcatggctctacagctgctcagttattaatcatgcagactaacctgtcaacactgggagatgcaacatagcaaaaggacagagaaattagaattttttgtgcagaaagccctaaattcccacctgaatgtaacttacagctcccttacctactctcacacatgccctcaaacatgctagattggcttatacataggccaacacaaaatacaaacgtgacgtgttcatgtagcctagtggctatatgcctattctccatgtaccctgcatggtagtgctgcaaactttaaagtacatttctttcacagcagtattttttttcataagtggcatataaatgtcattcaatgaaatggggaaatcacgttgagaagttggtctgtcatctcccattgagcaaagactggcaggagataataaaaataaatatgggcacacatgtattaatatacagcacgcatttacaagtttattttccagataaaattgtgctataagaacagctctaccaagacagtctgcaccatttccaagtctcagttaatttacagcaactgctgctttcggagatggctgtgaaaatatggaagttcctctcaagtaggccaagaaacagttctagattttactaagttttattttgtcaggttttttaaattttttcagtgagcgtggtgactgcagaggttagtgctgtgaaaagctgggctaaatattctttctgtaaagtcaaacaggattccatcccctgtgaaataacacaaaatttcactctctaaaagcaacagcatgtaaactagaatgaaagaaggaaattatgtacgtatgcctaatattctttgtgaatgtctttcatttaactaaaattatattagaaaccagattgataaataaaaaattcaaagtagttttaattatcctaa

SEQ ID NO: 968 - DNA, 228333 bp, Homo sapiens
ggcccgcggagtccagcgaagtttggcggaacatggcggaagcgtctggggcacgcaggagcgcggggcggcggcggccggagcccgaggagctgtagcagccttagtcgccgccgccgcggggcgaggtcgccgccatggcccgctggatcccgaccaagaggcagaagtacggggttggtgagtgcgcgccccaccttgtcccggcccgacccacgcggccaagttcgcggacagcggccctgccaggtttgcgcagagcccggcggaggaccctggccgggggctcggcccggctgcgcagctctgggagccggggacggtaggagtcctctccagggagcgccgatggggaagtcgcccagggtttggggactccgagtgcttccaagtgcagctgagcttcgggaccgtaatcccgctcttgcatcccaatctccggcacttcacaccagggaaatgtcaacgcgaggggggcgcgcctgctgctcttttggggccgcagctctgtggctcgccccggtgcgcccagcgtgggtttcacctgggagtaggtgaccagcccgggtcggcacatggactggtgctcattgtcccagtgctttctgccccccgctttcgtaggttcttctcagacgccccttaagtgaggagttgagggtggaaagccgccctgccccctttcctccagagactgggatcttgatgacagttgtgagctggatggaaactagagtcgtggcgtggaagtgatggaagggacaggaagttgtggcacgggaagggggtggctggcccctggggctgtttgtgcgcactcatcccctaacggagcctgtctggagagggtgtaaggctgccttccggatcctgagtttcatcctggagacgagaagaggacattttattaaggaaactgtgccagaccccgtgctgggcacttggcattcagaacagcggtgctggagagccccgggttgtgcgcaggggttgctggtggtggtgctttggctccgaaacaatagatgtgcggggattttgacccaggtggaaagtcaggctcctttggctttttatcaaggattgaagttattgagggcctgtgggaagacttctgccctgaacggggtgattacaatggcagttagacctggggtgattccctacaataaacacggctgagtgtgttgcgaattttatcacttcctctcagatccattcatttggcctgtttgtaatttagtctttgactttactcccttactgaggtcctgtttttcctcacctcactggttaatgaagtgcagtctcaattaagagctactcaacgtgtctaggggcttttcaactctgtagccaggagtcagggttttttgttgttgtttgttttgttttttaacagtctcatatttactatattattcttaggttgtgatcctttatatatttattattttttgttttccctcaattcaaaagacattttcttttttgctcttaagttgcttttagaatcttagtctctcccttagctgcatctcagaaatgggtagagatgttgcttctgcctcagggctctttttttttttttttttggtttgtttgtttttgagacggactgacgagggagtctcactctgtcgcccaggccggagtgcagtggcgcaatctcggctcactgcaagctccacctctaggttccagcaattctcctgtctcagcccccctccccgagtagctgggattacgggcttgcatcactacacctgactaatttttgtatttttagtagaaaccaggtttcgccatctgggccaggctggtctcaaactcctgacctcaggtgatccgcctgcctcggcctcccaaagtgttgggattacagtcatgagccacctcacctggcccctagatgaaagcatatttacaatgcccaatcactacagaaatgttatcaactctaattttatcaggattaaaagctcttttcaaaactattcagttgagggtaattaatgcaaacatgtttcaaaaatgtggtttttattgccatagtcctaggagcaagtataattgtttttaatattttgtttttatgttctggagtcagtttactgtgtcacttatcagtcaagaaaaatatttgggccaggtgcgatggctcacgtctgtaatcccaacaatttgggtggcagaggcaggaggattgcttgagcccaggagttcaaaactagcatagcaacatggcaaacgggtctttacaataaatacgaaaaaaatttagccgggcatggtcgcctgtgcctgtggttctagctactgaggaggctgaggtgggaggatagcttgagcctgggaggttgagggtgcaccgagcccccatcacgacactgcactccagcctgggtgatactgtgagacccgatctcaaaaaaaaaactatatatacatatatatacgtatatatatatatacacacacacacacacgtatacacacacatatatgtatatatgtatatacatatatatgtatatatgcgtatatgtgtgtgtgtgtatatatatatgtatatggaaatatgggtggaaattgtgtgtgtgtgtgtgtgtgtgtgtgtgtgtgtaaaatatttggattgcatttccagggcctaggtgttagggaaactgctccaggatataattctgaacacttatttcaccagacatagattctggtttgtctgggtttgacaaaaggacccacagttgggataaattaactgaagagagaaatctccattgcttattgctaaaactcattgtttttgtcacctccttgcttatgtttatgtcacctccctgcttggaagtctctcgtggtcaacaggataaagtctgagcctccgttccaaggttcctataatctggttcagcctatcttcagcattatctctcgaggcttctttcactagctctccaatgcagaccaactgcccttcccactgttgtgcaacataccctgcagagtccctcctttgggactttgctcccattgtgcctgtccctgccaggagtgccctcccaactctgcctcagacagctcacctttccttgagggctcaaatccattcctactcccttcttcaaatttgctatttgtcagactgtcccaaacctccttgcttcttcctcgcagttcctggactgtgccatccttgggttcagtgaatcagaccattgtggttttgtattcctagcactcaacaggtgtaccaggtattagtgcattcagtttgcttgtccttgatgttggggtgccgttctaaagtacactaacctagcttgtctggtaattgaatgcagttttttcctcttctttttcttcccattaggcataacatctcattcaccccaatatgagttgaattttgtttggttagatggaggaagggagagcctccactctgtctttatctctgcaagtaagagaatgagatattctgctgagaaaacaaggaagcatggagcagacagactttcttaaatatagttgggaaaattggctttctggacttctctaagtgtgtactggtcagatttggtttctggatgaaggaaccgtaggatagtcatgttgaagcatttggatgactcagagctagctatgactttgcctgttgtgctctaagaggagtgtgcctctgcagagctagtctgtgtgaggatagagctttggactcagtatgaattgtgcctgctgaagctggcagtcgctactgtcatattttatcttggtgccactcttggctgttcctgacatatcctagatgtttctacagggactgaaatgcagcctgtctgggctttcttagttcttaaacagcagtgttggctcaggctctagcattaagtggatctcaatggtttctgtgtgttatcaagtgaagtgactgatctatttgattctttaaacttatggtgctctagtaccccagtgttaagtgctcagtggctaagtgttcttccctggagacgtggaaaatgtgcttttttctcatcttttttctttctttgtttctcttttctctctcttttttctgtttgagcatatgaagatataaaacacttttaagcaaacattagtgataaatatccagaatagtctgattataaaaacatttatttttaagtttgcttccacacaagccattatgtaaagaatagccccagattaggttgactatggattctttgcaaagcttttttttcttttcttttctttctttctttcttttttttttttttttttttgagacagggcctcactccacagcccagactagagtacagtatgatcatagctcactgcaacctgccatctcagccttccaagttgctggaactgcaggtgtgcaccaccatgcctggcttaagttttttgattttttaagttttaaaatattaaacttttaaaataatcattttaaagatggagtctttctatattgtccaggctgatctggaactcttggcctcgtgtgctccttcagccttaagcctcccatgttgctaggattacaggggtgagccatgagcctggctgatttttttttcttttcttctgagacagggtctcgttctgtaacccaggatagagtgcagtggcaaaatcatggctcactgctgcctcaacttcctgggctcaagtgaccctccagcctcagcccgctgagagctgagagctacaggtgcgtgccaccacaaccagttgatttttgtattttttgtagggatggagtttcaccatgttgcccaggctggtctggaactcctaggctcaagcagtccttctgcctcagcctcccaaagtgctgggattacaggcatgagccaccacacccagccttattctttgaaaagtagctcattgttgcatgttgggatttgtgatcacatatatttttatgatgtaacaaaaggcagttttgggaaatattactagttagctcttcaggtgtttacttgtttaaagctctttagttgtttagaagcatctgacttaacggagtagagctttgaatgctgatttaagactgacttcagacttgggcttttgttgtgtttttgtttgcttatttgtttgtattttgagatggagtcttgctctgtcgcccaggctggagtgcagtggtgcaatcttggctcactgcaacctctgcctcctgggttcaagcgattctcctgcctcagcctcctgagtagctgagattacaggcgcacgccaccacgcccggccagtttttgtatttttagtagagacggggtttcaccatgttggtcaggctggtctggaactcctgacttcatgtgatgtgcccgccttggcctcccaaagtgctgggattacaggcgtgagccaccgctcctggcccagaatgtttttaaatgcataaagtacgatacaaagttccaagtcactgtagaaataaaaattaagtaaattacaaaggatagaaaatgaaaacagccgtattgaaataggccgtgaaggtgtttttcaaagttcgtgatactgcagtatatgtacttctttattaatgcataaagtaccaagatctagtgacaggtctaataactagcataattttgaattagtcacgagcatatatgatttttcaagatatctgcagtaaccatactatgatataaaaatccctgttttattggtgacagtatcacaggcgctagtagtgcaattgcggtttattggctacagtcgtaattaaagtgagtgctgaatgtcagaaaatagagatgtaacttttttcttgttcaagttcgtggatcctctggatttaacagattaagtatccttggctgaggatcacatagctaattagttacagtgccatctgagcaagacagtgatacttgttgaccacctctttgcacataacactgtaccggatattatataattataatgacccgaagaaggcctggccttaacttggtcatgggtttttttttttttttttttttttttgagacggagtcttgctctgtcgcccagggtggagtgcagtggcgcgatctcggctcactgcaagctccgcctcccgggttcacgccattctcctgcctcagcctcccgcatagctgtgactacaggcgcccgccactgcgccaggctaattttttgtattttttagtagagacagggtttcaccgtgttagccaggatggtcttgatctcctgaacttggtcatgttttaacagcattgaggctaagaacaaaaggaagagagaattagtattcattgagaacttctcttgtgaggtaccattctgaaccctttattttagtatgttccagggacatgtggggtcttggagacacgttcagaatggggggggtccatgaaattaaaactttctttttgcaataatgctaagccgttattggcctgtttacattctcattctctcgttagtggagttttccagaggctttgcaaagtgcgatatggccaccgatggaatgcaggggcagctataaagacccagctgcctatagtgaagtcagacattaaagagacttccaaatatgcaaaacaaagccacgcttccaagtgtttttgtttgagaaaatagttctgttccttgaaaatatgtatttttacaaacatgtattggatttatcatagttattttaaattaattaccaactactttttgaatgtttcaatttgaatttctgatatggcaagttgtgatagatgtcacccacatagaagctctttggtggttctcagtaacttttaagcaagtaaaggggttctgagacaaacatttgagctgctttacctgttatttcattaaatcattgtggcagtgatatgaaatgctgttgtcccctgtttctgatataggaaatgaggtttgcagaagatgagtttctcatccatggccatataatctcactccaaaaacaaaatcttttttttaaaattatatatatatatttattatactttaagttctagggtacatgtgcacaacgtgcagttttgttacatatgtatacatgtgccattgtgtgctgcacccattaactcgtcatttacattagttatatctcctaatgctatccctcccccctccccccaccccacaacaggccctggtgtgtgatgttccccgtcctgtgtccaagtgttctcattgttcagttcccacctgtgagtgagaacatgcagtgtttggttttttgtccttgcgatagtttgctgagaatgatggtttccagcttcatccatgtctgtccctgcaaaggacatgaactcatccttttttatggctgcatagtattccatggtgtatatgtaccacattttcttaatccagtctatcactgatggacatttgggttggttccaagtctttgctattgtgaatgtgccacaataaacatacatgtgcatgtgtctttatagcagcatgacttataatcctttgggtatatacccagtaatgggatggctgggtcaaatggtatttctagttctagatacctgaggaatcgccacactgtcttccacaatggttgaactagcaaaaacaaaatatttaacccatgttgtgtttcccaagttccacttgttcatcgtcaccttggttttgccctgttcaggtaccactgtgtagcagcttcagggctattgctatacccatttccatctgtattcttttttgtttttcttttaagagatagggtctcactgtgttgcccaggctggagtgcagtggtgcaatctcggctcactgctgcctggacttcctgagctcaagcgattctcccacctcagcctctggaatagctggaactacagacacacactaccatgcctggctaatttttgttgttgttgttttcgtagacacagggtttcactgtgtttcccaggctggtcttgggctcctgggctgaagcagtcctcctgtcttggcctcccaaagtattgggattacaggcgccagctaccacgctcagcctatactattttctatgttatattttctttatattgtctgcttgttttcttttttaattttagcagttactgaaaaagaaagccttatctttctaccactacttgctgtagaaaagaaacaattgtaaaaatgaaagcaacaaaaataaaagcggtgtattagattctggctagatactgttgctgtcaagcctagagccccagacctgctttttcttcattaaaaaaggaggaagctgatacccaatggaatctttctcttcagtatagtgtccattctcattattcatggtaattatgttctatttagtcacagtgaacactgagttagtgaatactgacccgttgctcctaggggagaggcagggttcctgtgagcctctggtcacaagcttttcatcagccaatcaatacataaccttattttatgtgtgtttgtgtttaaagttaccttatttaacatatatagttggttcactaacattgagcccatggcaaaaagcactgtaactcatgcctgaatgaagaaacttatctaacgtgtatttttttttttaaggcacattacagcttttttttttttgcatttaggtacttagacagcactgtagcactatgcttgggaccattttaaatagaaaaatcaccagcaaaaagcacaaaaatgaggccaaatgtggtggttcacacttgtaatcccagcactttgggagactgaaacgagaggattgcttaagcccaggagtttgaaaccagcctgggcaacgttgtgcaaccccgtctctacaaaaaaaaatacaaaaattagctgggcatggtagcatgtggttgtggtcccacctacttgggaggctgaggtgagaggatcatctgagcctggggaggtcaaggctgcagttagctgtgatcgtgccactgcactccagcctgggtgagcgagtgagaccctggtcaaaaaaaaggcagaaaaataagagaaatgtggcagtaaatagaccctgaaaaagacacttgtttacaatatgttagcctgaaaaaagaatgcagagcgtcaccttgctcacccttagctaggaacttgtgcaggagtattggttttaaggttccatgtatattttagtgagtaggtgaattcgcaaatatggagtctgtcaacaatgaggatctactgtagtttcacaaaacgataattgaagccgggcatggtggctcacacctgtaataccagcactttgggaggctgaggcgggtgtatcacctgaggtcagaagttcgagaccagcctggccaacatggcgaaaccctatctctaaaaaatacaaaaaaaaaaaaaaattagccaggtgtggcggtgctcacctgtcattgcagctactagggaggctgaggtaggagaattgcttcagcccaggaggcggaggttgcagtgagccaagatcacgccactacactccagcctgggtaacagagcaagactctgtctcaaaaaaataaaagataattgaaaatggaatcacttcctttccccatgtgtttgtttttgttcacatattggatgcagttgactttacttctagaaacattttcttctctagacttttgatcccatttctccacagttttcctcccatatccccaccctccatcctccctgccttccctccgctttgccacaactttaagtcttgccatagcctggctggcttttgtgtctcctttatctacctgataacaagtgatctcatcccccgccttggctctcattcccattcatttgctgcagccttccacatggatagccccagaccccttccctgtgcttcgggatcacatacagctgttcactgggcgtctcccagtgtttttcttaacaggcagtccctgcttccagaacagaagtttggatcctctctaaccccagaaccgcactttccccagtttcttgctgtctgtccagtggcccaggcagaacactaagagtcaccccacattctatctgtcatcaagtgcagtctgtccttcctccaaaatatgtcctcagattactgctgctgatgtttccatttcaatgcaagcctgcattagcgtctgcagggctactgcaacggtatttttttttttttcttttggggacggagtctcgctctgtcgcccagactggagtgtagtggcgcaatcttggctcactgcaacctccacctcctgggttcaagtgattctcctgccatagcctcccgagtagctgggactacaggtgcgcatcaccacacctggctaatttttgtatttttagtagacatggcatttcatcttgttgaccagtctgatcttgaactcttgacctcaagtgatccacccgccttggcctcccaaagtgctgggattacaggaatgagtcaccacgcccagctgcaatggtcttctaactggactccttatcacttttttttttttttttttttttttaagatgggcatcttgctttgttgcccaggctggtcttgaactcctggcctcaagtgattctcctgcctcagcctcacaagtgctggaattacaggcatgaaccaccaagcccagctaagaggaactttttaaaggcaagaacctgacattgccacctccctgcttccaccttcccattgcagttgggatggcactgaagttcctggtcatgccctcccggccctgtgggatcagacctgccgcctccctctttcccttctgcattccagccacaccagctttatttctggtttttgaacttgccaagctcagcttgactcaggaccttggcacttactcctccctcttatggaatgtgtttccctagatctttagatgtccggttctctggtcttccttcaaataatccctgcttagagagagccttctctgagaagaaccctagctgcatgatcccacctccttgctgacacctcacaatgtctagcccttttcctttatttatttgttagtgtttactgtctgtctcccatactagaatgtaaagttatgaggacacgaactctttttcatcagtgtgccccagcccctggaatagcacctggctcatagtaagtcctcagtgaatatatgctgtatgaataaatgaatactgaccccatcatctctttaaattcatcttgcttaccatcagcaggattttgcccacactttggaaaataccaccctgtgtgtatttcccatgagagaaacatcaaaggcagagagaaagggacattcaagtaatggagaaaatagatttaataaactgcataagcaaaagattacgtgaatcctgtggggtgggtgaggacttagaatcataaatgttgcattattagatggaagtgatgggatttgcttttttatttttgggtcattatttctggaggctttatggaggaaggggcactgcagacttggctacctggaaagaaaatgcttgaccatgtggtgtacagagtttaggaggttctgagtcattggttggtgctgtgttgagcacatgaattggaaaggaaagaaggcgcagtctcatggaagaaacaagacatttagattcatctgttatttcccatttctaatacaaggagttgagattccttacaaaaagagcatatgtactgtacactcaataattaaataaaaaatctgagaaatcacaagtaatttggagaagaagaaaaagtaatttagaatactggcaaggggctttgaagccatggttactcaaacattagtctgtctaaatttttcttgtggccatagctgtcatgtagccatcttgttagctgaaaatataaattaatttgtgttttctcctcatctaaatttcaagagacaaatcagtggggcttgaatgtaaggaatcaaatctcattgtacttaattttaccataaagcaaagtttttctaacttctagcttattgccagcagtattcaatgcaatgacgttataatgcaatgcatataaaagattttagtactttcaaaagaattaaaaaaaaggaatcatccagttctttggaatgagttgtagcggaattgaaccgtatgtctgtggtcaaggaacacacagtttgttcttcactaaatattttggctgggcaccgtggctcatgcctgtaatcccagcactttaggaggctgaggctggaggattgcttgagcccaggagtttgagaccagcctgggcaacatagtgagaccctgtctattatttaaaaaaaaaattagtagaaagaaaaatcgttttccccttcctcaaacaggtaaaatcacccagaatatgcctactctccgtggacattaaaggacataataagccctttgggagtcctttgactgatttataactacaccagcatacctccggaataatgggggttttattgtcaagctttataaaagtgttttttgagaaattattttgaggcagagatgtggatgagcacgttaattgtgtttttccaagtaatgtttgggccatgtcctctcagagcctgggctcactcaaacgattgtctgaatgctggcagccacttcccaagcaagagacagaagtgggctttgtctttcagaaagctctgtgccattgcaaagccactgttgttcgaatgggttcatggtcattatccaccttttcccaaatgtgccgtttgctctcatatttccacagctgattaaaccctgtcactatccacatcagataatagttggaccccaaagatgccctctctttaaggatcgtgtctttgtctttttttttttttttttttttttttttgagaaggagtctcgctctgttgccagggtggagtacaatggcgtgatctcggctcattgcaaccttcgcctcctgggttcaagagattctcctgcctcagccacccaagtagctgggactacaggtacatgcaaccatgccaagctaattttttttttttttttttgagacggagtctcgctctgtcacccaggctggagtgctgtggcgcaatctcggctcactgcaagctcagcctccctgtttcacgccattctcctgcctcagcctcctgagcagctgggactacaggtgcccaccaccatgcccggctaattttttgcatttttagtagagacggggtttcactgtgttagccaggatggtctcgatctcctgacgtcgtgatccgcctgcgtcggcctcccaaagtgctgggattacaggcatgaggcactgtgccggtgtctttgtcttttaaaacagcttgagggaaggaaaacacagtggagactaattccctcttgaaaataactctttgctgactcagccaaggtgcattagaatgcaccctcctgatgggtttgttacctgtatacctgcaacaagttgcatcgtatttgatttgtactttctgtgagcctggaacaatgcggctctcatgacccagccttccctgccagagaccagttataagacgaagtgacgaccagacacggtgtctcatacctgtgatcccagcactgtgggaagctgaggcgggtagatcacccgagatcaggagtttcaagaccagcctggccaacatggtgaaaccccatctcgactaaaaatacaaaaattagctgggcatggtagtgtgtgcctgtaatcccagctatgcaggaggctgaagcacaaaaatcacttgaacccgggaggcagacgttgcagtaagctgagatcgtgccactgcactccaacctgggcaacagagcgagactccatctcaaaaaaaaaaaaatactaagtcataaataagactcagttgtcaaaatctaacagttttgccctcttgtatgtagaatcagaagatattaagagccggagtttgtaagtattacctcttggctaacaccctcattttatcagaagaaaaaaagccccagagacatcagatgacttacctaaaagtcacacagctagtagcaaatttttgtttcaacttgctgtctatctttctccttacttacaactctggagaggggtttgttaatcagatctccttaaggttggaagagtaaattctcccctctccatccaaaggggaagatgcctgtgtctcctgggttttttccaggtggaggttttgttataagtaaggtttggctgttaaatatcttcccttttttaagagttctaggaaggaagtgtgtttgaggaggtttgagcctgcaaagtggaagtgacactgtgggttgcacggtttggccactgacttctcacgtggtttcagtccttagcaccgtggtattgacatgacatcagttgcaaaattaataagtaatgtggcattgttactacatcacaggcatatttgagaatgaacatcactgtgttttgcaaagtaaacgtttaaggggtgaagaaagggtcatgtattgctaataaaggattatgttagtaacctggatgtgagagaacatttctactttttcagacctgtatttcaaataaaatgtgatgtcatcttctgaagacttaggaaaagtttgagtgagtaagcgccttctccctcagcttccatttccgctctgttctttttttttttttttttttgtgagacggagtcttgctttgttgcccaggctggagtgcagtggcaccatctcagctcactgcaacctccacctcctgtgttcaagcaattctcctgcctcagcctccctagtagctgggattataagcatttgccaccacacccggctaatttttgtattttagtagagacggggtttcaccatgttggccaagctggtcttgaactcctgacctcaggtgatcctcccgccttggcctcccaaagtgttgggattacatgcgtgagccaccacgcccaaccaacttctgctctattttctttgctgggagtggacagctttactctggaggaggagatgcagcctcttctcatgcagagacaatcactgtcattctccatcgggagcaaactcctgaaatggggcaatatctacccacgtggaaccagaggtgctggtgctggtgctggtgctgagctttgaacttccttcagaacaaaagtaaacagcaagttgcccttgttctttaccataagcagagaaggcctgtctatccaattgtgactgcatgatttgttttagatttgttaatttacattttgcagaatactgaggcacattttctgtgaacttatgtggttatatatactttcaatcagtggatactggaagcattgttatacatttgatgtcttttataaaagaatcctaagggccaaaaatgttgggaactttggagtaactgaaatggcaatgtgctgtatcttatcataatactttggagttcattgtgacttgaaaattccaattaaagttggtataacctctatcatgtattgattaaaaatgcacataccctttgacttagcaactccgtttctctgagtttatcttacaaatatactccacatgtggggaataatacatggacaaggttattcattatagcattatttataccaaaaacatggaaactctcaagtgttggctaattggggatggatttagtaatttatagcacatgcatacaatggaaaactatatagccattaaaaagattctgacgcagtgatagataaagtgttgacaaaggtgagagtggcatgtagtggttgaaggatgatcttttcaaaaaatgatactgagtcgtttgtttatctatactgaacaaaatgtatcaggacccctacctaataccacataaaaaattgattccagctgtatgaaagataaaacagtggaagctcttagaagaaaacataagagcacatttttgttaccttagaatagaccatctgtaatttaatacattttgctttctgccattcagttagttacttatgaccatctctttgttaatcaacaaaaaccaaatccaatattttacttcaataaagggcaaaataaaacatgcctgtgctggtctcatctctttataatcctactttttaaaacttgtataattacatcttattaattgtagtgttaatttgttggttgtttaaggatctaaatggctatttcttcttcttctttttttgtttgagatggagtcttgctttgtcacttaggctggagtgcagtggtgcaatctcggctcactgcaacctccgcctcctgggttcaaacaattcttctgcctcagcctcctgagtagctgggattacaggtgcatgccaccatgcccggctaatttttgaatttttagtagagacagggtttcaccattttggtcaggctggtctcaaactcctgacctcaggtgatccgcccacctcggcctcccaaaatgctgggattacaggcgtgagccactgtggccggcctaaatggctatttcatggtgaataaaccattagcctcaggcttcgtctcctctctctgtttgaagacaataaagtatgatgtaattgtattattttgataaggtaatatttagtcccatgacatacaaaacactagtagcattacataaaacaaagtatttcaatagtgaaagagaacatttatatacaattatttctatagtctaacagtatcactaacattacatgccttttaaaaaatatgtttgagttactgaagaagattgagatacagatgttgacttgtttagggcaacaggttaagctaactttagaacgctgattactacctttagtcctgcaggctgtggagccgggcagccaagccatgcttgaaatcagaatcgtcaaggtggatgcaagagccattggctgcagagtgaggttttggagagtagttgcttgtggctgggatttttgaagtccaagtctcctaacttttattactctttaccttgtgaagtcatataaggctctaagtcaagtaagacggaaggaataagattagcacacttcctggtacagtgggcagtacgtgatagctatctgaaagtttgctcagtcgcagcctccctgacagtaccctagcctggcaatcaggtgcctttgtttgcagagtggggctgattaccaagtagttaatactggttggctcagaacctgtcctcaaagttcagaatagatttgagtatatttttgattttagagccttatggccagaaatggccttatcttgcaagaatcttcctgggaaaaaaacatatatatatatatttttttcttctctttgagacagagtctcgctctgtcacccaggctggagcgcagtggcacaatcgtggctcactgcaatctctgcctcccgggttcacgcgattctcctgcctcagcctccccaagtagctgtgactacaggcatgcaccaccacccccagctaatttttgtatttttagaagagatagggttttgccatgttggccaggctggtctcgaactcctgtcctcaagcgatccacctgcctcggcctcccaaactgttggcattacaggtgtgagccaccgcacccacccctggaaaatatttgaattcccagggatctctgggtgatgggactgttactttcttctgatcctgtgcttttggggtggtactcactcactggcttagaacagcctggaatcctaagaggaatggatgaatgaatgaattcacacacaacaaactaacggaaatgttttgagtcacgccaccttgcgtgtgaatccccttactgtggctaacccacctcactgttctgaggaagcccatgttcactgagcaccttttatgttccagggtcttgctgggctggatggtggtgaggatcacacagtagtcccgccttatcctcaaggcatgcttgaaaccacggatagtacccaagcttgtatatacaatgctgcttctatacaaatatatttatgataaagctgaatttctaaattaggcacagtaagaggttatcaacaataactaataataaaaaagaacaatcaacacaatatgccagtattaccactcttgcactttggggccatgattaagtaaaataagggtgacttgaacaccagcactgcaataccccggcagtttgtttttgaatttttttatttaatatttttggaccttgagtacctgaagccacagaaggtgacacaggggacactaggagactactgtgtaagataaagagtctatagaaacacacatagaagcagtaggcagggattcataatggctgctttccttttctttagcttgataagagtgctaccaaatacatctccagtgtcatgaattcatggatgtgtgaccagtagctcttggccagccatttctggtcttaacacccagatcatcatagaatatgaggataggaatccactgatgacagaatcctgaatgactatcttatgtgcctgaaagcctgcctcaaagaaggctgatgtcttcttgaattaaagagttgcttgcatatagaatatactggagtcatttttcagaagatccttacatggcttggcagagggtggcatccagtttatctttggcggaattagatttgctgctcaagattgttttcaaattgtttgatagcttcagggaggtccactggtaagctcacaaattcagaaatagtttgaggctacagaagaattcttttcatgtttgagctgtgatctaagccaagagccttggaaattttgaatccgtcttatattttctttcctgaatgagaaatgggtatacttgctcagttccgattctgacaacatgacttatttcaaaaacaaatagctcactccgtgaagcaaaccctgtatcactctcctctggtgacatttcgattctgatacaatgtggtggcatggggatagattttagaccaggaaaagagagagcctctcatttgtggcccaaaagactcaattttaaagatcagattggaatctgtcagggaggacatatggacatagtgattttttcttttatttgccttttttcgcctctctttacttttggtttaatgtcttttaggacttgaggtacaaaatcccatgttgtggaggcattagctaacagttgtaaaaccttaggaaaagtacagcatctcagtgatcctgccttcctaaaattgctcctcaacaaatacagatggaggaaatagaaatatctaaaatgaaacgtgttctttcgtcttagatgtctttatcttcttgcttttatcagcagccttgagtgacaggattttatacttttggaagattagagggtttgtttgtttttcttgcagaaatagttacttataccatgttcatttatctgcctcagttctgagaattctttgccaatttttttaatagcatgtgtttggatgaattatagacttcatagaagtaacttcaggaattatcgacttcatagtcgatacaacataatgagaccctgtctgtactttaactttttaatacaagaaattttttaaaattttaggggcatttaggtttttgggggatagtgcatggagtgaaactaacagaagtattgatcccaggattaggaagttgggtttgtatttcagtctctgttacaggagtgaccaagtggcttgactctctttagcttagtttttccatctgcaaaacagagataatattttctattaccttctagattctcagagtgtgatgaattttcagttgttgaaaatttctgcaaatgaattaagcgatgcctgttaggccacattaatggactaaaaactgctaggatctaaagttgacatgccattgaactttctgcctgaagacttactgaggaaactttgtctacaaaggtttggtgcaaagaaccccattactttatggccaaattttcttcacatgccgatggtaatccagtagtctttcttctaacttcttggcggctttcatatactcttcagactggctaagtcatacgttaataggaagaactaattttctctccctgaggctgaacttgtgatctttttcatctggtttccacttctcagatttccccaaatctctcagtcgtctttcccaaagtatttaaaggaagattgattttaacagagtgctatggactgaattatgtccctcacaaattcctatgttgaagcctcagcccctagtgtgatggtatttggagatgggtcctgggagataattaggtttagatgagttcatggtggggccctcatgaggggattagtgctttttttaaaaaaaattatttttaaaaatgtcttttattaaaaagttaattaaagtacagacagggtctcattatgttggccaggttggtcttgaactcctggcctcaagcaatcctcccacctcagcctcccaaaatgcttggattacaggtgtcagcccctgtgcctggtctcttcttttatgtggagagcgctctccctctctctcgctcttgctgtctctcactctctctccctctgtctctctctttctgtctttctctttctctctctatgctatgtgaggatacaatgagagggtggccacctataagccgggaagagagccctcaccggaaactgaccatgatggtaacttgatcttggacttccagcccccagagctgttagaaaacacatttctgttatttaagccacatggtgtgtggtattttgttatggcagcctaagctgactgagacacagggagttgcgtgttatttgaaatacgagtccactgttgccagatcaaagttcaatctctgtagtttaatcctagatttttccctcctcttttacagggatttgaatctagtgaaagtaattcacatgcacatcagatacatgcctttagcagccttctggccttgaaaatcctgctgttgctgattcagttgtcagggcccaaatcagctggtgaactcatgagtttgcaggtctagaattgtaggtgtgggaaggggagagagacatgggttactgaagacttgtgcaaataaatgctgtgttcatcttcaccgattcaccaggtatctgagtaggaggtatgcacttagcacttggaatactcagagataatgccattgcacacttaattgatacttctcctaacacttaagagaagtggacatagattctgtttgtgggaagtttataatgaattaaaagaccccaagtataaagccataaataactccagggaaaggaaggctgaacatgaaaaaagttgcaaaaaaagtccagttggggttattggagtttagagaagcagagattattctaattgagggagttgaggaagcttcagggaagtagttgaactttatagagatggacatcaggtttgggaaggctggggacctggcacagcgtgagccctggccctaacgcagttatttgtggcaagtggataatgaggaagttgtccattcttgctgaagcaaagggtgggtaaagtggaaaagagggaaatgatatagattttgtcagattatggggagacttgtttaccttgattttttttcttcctctttaaccattcatgctgcaatagtgtgctggtaaactagctctgtagagtgggaggaaaaaacttgagtttgtagcattcaccaatatctgtggtgtaaatactcccacagtggccaatttcagaccagcagtggattaagagatagctcacagaattcctgaaaattcctgaaaatgtaacagttggcccttccaaactagtacaagtttgctccagtattctgtgaaaaacctgggctagttcctacatgacaaatagttacagtacctgcctgcccacagcctggatagaagacccagggaaggcctaggtagcctcgttttacaccatctaagattcctgtggccatcactgattgtccctggatggacacactacctagaggccattccgtagcctggacaatgacatatggtttgacgcaaagaagtaagtactcaatcaggttccttctcttgggaatttgaatgaggaaataccaatatgttttgccacaggggcaaaagctaaaaggatgtcgtttgggagttgagttggtggcaacctgaagccatgtggaagccaatgttgtgaatggaaaccacaaggaaactgaaaaagctgattgatagagagaggggagcagatgtggagagaccctacagccctagagtggcccctgttcttagcagctttccaagtccaggtctaaaacatcccttttctgaggcaatttgagtgagtctctgttccttgcaataccgtggcatcactgaagaagtttatgtggcaactcagggtactttgcagagctttctatgaatgcagacatacctccttctatatagcacatcactttattgatcgaccataagattcatggtcgatcaataaagcaatggttcatgaagtttgatgaaagaagtttaataaaagaagccattgccatagcatagaagtgcaaggtgaggcagcaagtgctgatatagaagctgtggcaagttatccagaagatctagtgaagatattgatgaaagtggctacactaacaacatattttaagtgtagatgaaatagccttctattgtaagaagatgctgtctagtactttcatagctagagaggagaagtcagtgacgggcatcaaaggataggctgaccctcttgttaggggctaatgcagctggtgactttaaattgaaaccagtgctctttcaccattctgaaaaatctgagggcccttaacaattatgctaaatctactctgcctgtgctctataaatggaacagcaaagtctggatgacagtacatctgttgacagcatggtttactgactattttaagcctactgttgagacctacagctgagaaaaagaagattccttgattcaaaatattactgcccattgacaatgcaccaggtcacccaagagcttagatggagatggacaaggagattaatgttttcatgcctgctgacacaacatgaatactgcagcccatggatcaagggataattttgactttcaagtctgattatttaaaagaatacatttcatgaaatggtggctgccataaatagtgattacgctgatggttctaggtgtagtacattaaaaaccttctggaaaggattccccattctaaatgccactaagaatattgatgtttcatgggaggaggtcaaaatatcaatattagtaggagtgtggaagaaattgattccaattctcatggatgactttgaggggttcaaaacttcagtgaaggatgtccctgcagatgttgtggaaatagcaagagcactagaattagaagtggagcctgaagatgtgagaattgctgcaatctcttgataaaacttgagcagagaagagttactttttatgaatgagcaaagaaagtggtttcttgagatggactctatcttggtgaagatgctgtgaacattgttgacaaccaaggatttagaataatccataaacttgttgacaaagcagtggaaaggtttgagaggattgactccaaatttgaaagaagttatactgtgggtgaaatactatgaaatgctatcaaatagcatcacatgctatagagaaatatttcatgaaaggaagtatcaattgatctggcaaacttaattgctgtcttattttaagaaattgccacagctgccccagtcttcagcaactgccaccctgatccatgagctgctatcaatatcaaagcaagacccttcaccagccaaaaaattaagagtccttgaaggctcagatgatcatatgcatttttttagcaataaaatattttcaaattaaggtctgtacattttttagacataatgctattacacacttaattgactgtagtgtaaacataacttttataggcacaggggaaccgaaaaatttgtgtgattggctttactgcaatatttgctttattgcacagtctggaaccaaatccacagtatctcctaggtatgcctatatagcaaatttcttaagaatagaggacaaatcacttgcttctgattgaggttaaaatatgcccatgaccttcatttctttgccttccctccctccctgcactcctcccaaatgacttgtgaatattattttttcattctttttcattccagcagagctggtttggaattcatgatgttgaaagaatagccagtaggaacatgtggtggggtgatgttttgttggcatttaccattacagaaaatcacaagaaaattggagccattagcagcagggaaaggaaaatgagttctttatctgctgagggcatctggtgagggagggtctgtgaagatgccgcgggtgcactgctctagtatgaaatgccatttgaaggaggctcagagcacattagcgccgtcatccctgtctgatgttctcaccacacgcaagttcgtgaataattaaattgttaggaaggggaaagtcatgcatggcgggtcttgcccgaggctcaggcagacacacaatgaggtcgctactctgggagcccagtggtccaggatgccagtctggcagtgccagggaaggatgcttcctttcaataagcgaacattgtgagggagcggggtggaggcaagagaccgcttagaaatcagcacatgtgaattctgcttcaaactctgccactaaccagctatttgaccttccagaagttgcttcttcatctataatgaaggatgatgccaagaggattttaactttttgagaaataaagctcctttgagactgtaatgaaagctgtggattctttccacagaaaatggtgcatatgtctgtcgatgacatttcacatacaactttaggaagtttagaaatctttggggactcaaggatcccagcttaagaagaagtcttgcatgagatgatgtctgaactttttttgtatctctacaattgcatttttctgagactttggatcttggaaggaacctagaatgtcagctgggctctcacttctactctcaacaagaggcaagcctgccctgccagcatttcgtgcagaaggcgcaagcaacatgggagcctcctgtgttttcctcaaaagacaccatacttctttttcattagagacagggtctcagcctcgctctgttgcctagagtgcagtggcgccatgatcctcccccctcagtctcttgagctgctgggactacaggcacatgccaccatccccggctaattatatatatatatatatatatatataaatgtgtgtgtgtgtgtgtgtgtgtgtgtgtgtgtatctgtctatttatctatctatctatctatctatctatctatctatctatctatctatctatctatcgagtagagatggggccttgctattttgtccaggctagtcttgaactcttggcctcaagcgatcctcctgccttgggctcccaaagtgctgagattacaggcatgagacactgcatctggccctctataacctcttgatgtgtgcattctaagcgggaagaaacagacagcaaatgcacagtatgtatagcatgatgtcagtgatcagggctttgaaaatattgatgaagcacagtgatgccatagacagtgatggggtgaggtgctgttgtcgagttgggatggtcagataacggctctgtggaggggatatgtgggaaaagatgtgaataaaagagggattgggaccgggcgctgtggctcacacctgtcatcccagcattttgggaggccaaggtggatggatcagttgaggccaagagttcaagacaagcctgcccaacatggagaaaccccatctctactgaaaaatacaaaaattagccaagtgtggtgacacatgcctgtaatcccagctacttgggaggctgaggcatgagaattgcttgagcctgggaggcagaggttgcagtgagctgaggtggcaccactgcactccagcctaggcgacagatcaagactgtctccaaaacaaaaaagagggactgagccatgcaaatctaaagtaagaacattctaggcagaagatgtggcacagttaaggagcagtggaaagtgccaatgttcctggagctgaatgaggggagggggaagggaggagggagaggtgggagacaggttgagagactggcagagctgaggttggggtagttctttgtctactggaaacacaattatctgtactcaaatgacatctaataataatggttattgataagccacccattcatttcataggcttggttcattaccagcaatgggctgctttaataagacagtggtcctcaaacctccttctgtcaacagcacctggatagcctgctttgcagagtaccattggaatcagatatccctgtctttaaggaacttacagtacagcagaggggacaggatggtgtctccattattttgtgcacatgggagaattgctgtgtctcataagagaagcacagaaagtgccaaatagagtttcaggagaggaagtgagtactatctattggagaggtcaggaaggccccagggaacaactacgccagttttatcacccatgcactggggatggtattagaacctcccacagcattgtatagataaactgtttgagtgcctagaaagctttccacacagggcctggcacacacctagtaagtgctcaataaaatatgggcaagcatttgacttgcgtcttaaagaaggtttacgatttctgaaatataaaatgctgtctgtggccaggcacagtggctcatgcttgtaatcccaacactttgggaggctgaggcggaaggatcacttgagcccaggagtttgagagcagcctaggcaacatagagagaccacatctctgcaaaaacattaaaaaattagtctggtgcagtggtgcatacctgtagtcccagctactctggaggctgaggcgggaggatcgcttgagcccaggaggtcaaggctacagtgagctactatcatgctgctgcactccagcctaggcaacagagcaagagcctatctctaaataaattaattaattaataaatgctatctacgtagtttatcatgcagattttttagaaatacagcttccgccgggcacggtggctcatgcctgtaatcccagcactttgggaggccgagatgggcagatcacaaggtcaggagatcgacaccatattggctaacacggtgaatccctgtctatactgaaaatacaaaaaaattagccaggcatggtggcgggcacctgtagttccagctactctggaggctgaggcaggagaatgacgtgaacctgggaggcagagtttgcagtgagccgagattatgccactgttttccagcctgggtgacagagcgagactccgtctcaaaaaaaaaaaaaaaagacagcttccatgtaaagaactattcaggtcaaaatagctagctatttttttttaaatctggttgtttgctttatgagtagtcttaattaacaagaggatcaagatttttccaaatctaaatccatctgtatagccttgttcaggaaacattttgttcttgactttggcttgtgtttgatacacttgaactgtctgtgttatttattgcttctttaattagagcagcttttaaggaccaactgtgggccaacagtgtgctaagggccacgggcaagtttcatgtggggtcttgaaagagcttacattctagtcggggaaataagaagtatacacaaaagtcaaattatgttgagtcttcattatgtgggtaccacctaggaaggggactggatgtacctctgctcaaaacatctggatcccatttcacttgcgaagtctgttttgaaaggaaatatccagatgtgtcacgtgactgtgaccaattcatctgaagtagctagagagtgtctgaataattttatttcgatgcttgcaagagagagggtcgaaaacccctttatgctggactagaggaaaacctcagcaagggaggtctgtgtcaggccagcgtgattctagatggggctgacaccatcctctaccctccccagccatggcagggaaatgctcaggaaatagattaaggcacgagggcttggcgtggcttaattgacccctgagttttgactgccaaaaccctgaataaggatgaatctgctgtttggagaatattccctgagcaatttaaaggctagtttctgggtttgcagaaaaaggcaaggttcactgtgaacggagtcttggaggttgcctacaatggtcatgggtggacgagtttgttggaaaagcccccgtgactgggctctcggtagagtggcagggcgtgtgtgttggaatggaagatggaaagttaaaccttgggctcagtgggcgtctaatcaagagagaagtttcctgtgcgtcaggcccagacctaggaaacggggaaggtctccgtgtttccagcctcagcctcaaatgaatgggcaccaggatgggccgcagtgacttctccggggtctctctgatgtccaaagctctccccacacccagatatttttgtttcacaggaaagtcaggagcctcctgaaaacagacatgaatgtagcaaaaaaaaaaaaaaaaaaaagctgataatctctaggtttcatcccccttctggctgctgcagctatttgtaacctttcctttgtgtgcgtctggtagtgtcccctttttgaagccttttaacgtttgagaaactggagacctggtgttttttgtttgtttgtttttttgttttcctagtttttactcttgtttagggtctggcattttcattttcctcatgctacatcagggtttaattagcaactgtctttgaaatagccttcagggaggaatgaactttctttgtgaatacctcctcaccccccaaagaaaagcagtaatgcaaattaaatgtgtatccagaattgcagtcactctaatcctgacatcacaaacgcatttgttcttggaaatgactttggtggagcctgacagttttatgcttcttactgtggctgaggtggagtgtcctctttagatgcaataagagatgggggagaggttgatgctttgattagtaaacctgttacaggttgtgtgtcccttatggaaagtacttgagaccagaagtgttttggattttgtatttttttcagattttagaatatttgtgtatacatactgagacatcttggggatgggacccaagtctaaacacaaaattcattggtttcatatacaccttatgcacgtagcctgaaggtaattttgtacaattattttcaataattttgtccatgaagccaagtttgtgtacattgaaccatcagaaagcaaaggcatcactctctcatggcaacgctctaacagtttcagattttggagcattttggagttcaggtttctggattagggatgctcagcccttagcaggttctgttgtctccctcactgacccctctgcttttagagaacgaattctctgctttgcctgttcctctttgatcttaaccttggatattttcctctttctcctggatgtttggtatccaggagggcacagagaggtgagcctggaccccgtgttgggtgtgtgtcttggggtcaagggatcctgggcacatgagtggggaagccatttctgagcacctttgaaaaaggaaaagtggcattttcacagcaaatatgggttgtgtctaatctggtagttcccaatttcaatctcctatttacctcttcaacatccaggcgggtgacacacactgtcagtatctataagtatacacagtgattcctgtaccttcactgtaagactgtcagctgccaacccctgacccccaagccccactgccacttctcttaaagtgtgacttaaatgccatcccctggcacctcttttatcctgtgggaatagtcttatcgattcagcagtcatcggttggtcattaatcttccacaaaccacgcactttatcattgcgaaaggggacagagaggatcaggatgttgggttgtgacacgcgagagagccccatctgtccctggctgctccgctgaggtcatggtacagcacagaggaccagatgggatggctagaatctgtgtcctaccctaactttgtttttatccgccactggccagctgcaaatttgctcttgccagcagaggctagggcctggaatgaaagacttcctatactgctggctggacatatttctcccatgcatcagcagatgagccttttgaagggtgagacatgatctgtgactaggggctgtgggaaaacatgcctgtcctggagctgggggaatcctggactccattttggagagggagtcatccagcccccgttgggatatggttcttcaggccagggaaggccctaacaatggctcagctggactctttgtgtctgtttgaaaaacaggggaattgggtgaccagtttgatttcagctttaaaacatggataggctagggtgacactgccatcaacatattccatgggaacagagggcctttggacaaggcagtgtctctgggtgagggtaggatgggggtggggggatgtcttttctcctctgtcctggatctgtagaggctggggagagagagagaggcacagaactttcagtgcttcaagtgcaggaagtgtttcttctacaccccgatccccagtaccctggccatcatcagaggccgagtaaggtcactggtgcaacttgtccactatgtgacagttgccatttattgtgaaggtaggacagtgactctcgggagggcacagataaggagaaaggaattcttcccaagcagggcaggagagcaatttgcaacctactcaatcccttggtcattgtgttatttctatttccagcaacatttctgacaacagtatgtatgattagaacacatctcttttttttcacctttaaatataaaaaaggctttattaaagcagtactgttctgtttttaatgaatatataataattcctattacaataataacagaaagtgatagctattaactttgatattgcttcccccagtttggatagagaaaaggttattgtcatttctatattagattattaaaagtaacacctctcagatttttttcttaatcttttcaaatcctggaaataaatacacacacacacacacacacacacacacacacacacacacgtatacgatatgaatatatatctgcatacagtatgtatatatgtatacaacatgtatatacgtgtatacaatatgtatatatgtatacaatatgtctatacgtgtatacaacatatgtacacaatgtctatatgtgtatacaatatgtatgtatacaatatgtctatacgtgtatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatatatgtatacaatatgtgcatacaatatgtatagatgtatacaatatgtgcatacaatatgtatagatgtatacaatatgtgcatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacaatatgtatagatgtatacaatatgtgtatacatgtatagatgtatacaatatgtatatatgtatatataatatgtgtatatatacacatatatacgtatatatgtgtatatatacacgaatgcaggagaaggtgatagcattgttcactttcctgttgtagggagagagagagatatatatatatatacacatacacatgtatacatacaatatgtatatatgtatacaatatgtatatatgtatactatatatgcatatatatgcatatatacacacaatatcatattagtgggagatttttaaaactagtttgtatttaaacaattaattatactgatgatctctggacaccttagtaatgaacaacttaaaaacggggaactgaagttaggggtttgagtcaccatgagtttactgaagttactacccctgggacttgccctgaccagtagcattcacttgttggagagtttgagattcttctttctgtgccagctgataccagcaacgcatgtgccagacatcaggcaaatagagttgttctaatgcctttagttccagtggcacagaagtcagcagtcaaggttgggtgcttcttgggtgggttatgttggtggagaacaatgtgtcaaagttggtgggaaaatattattgcccagaccagcacctgcaagaaggggaccatgtctgtgatttcagagagccatatggtagtttgagagggtgcagtatgcatgacattaatctaacattgaatcatgtagtgaggaaataattctttaaaaattctctttcagtatttctggtttcaccaaagagaatgggacatgttagtaacgactctctaacatttgcaatcccagtcttgcaggccactgcacctactaagattgttctttattaccttttattcaaagggaatggtgctggttttccaattactataaagaaatcaatttaaataatttgatttcaaatacatctaaatgatgtacttatgagaaaaacagtgaattcgtttaagcaaatagtaagcaaataagtatcacaggtggctgatgggactgaaatcctggaggcaggtacatgaacaaacagagcctgggaaatcctgagctaggtcattggtgtctctggaatttgttttcaagtgggtttcatgaatcttttcttctatgaaagttaaactttttaagattttttcagaatggttatgacctgattaagtgacagggactctcctgcctccgtggacaggaatggagtgtggaatcccagggtgccctcaggttggtcacacaggctctgattatcatagggcatccctgcagggcccggggtggccgcagagctcagcttctgtcctggttaccacacacatgccaccatgaccactgtgctcttacagttttatttcacgctgcttgcctccatagtgcctctgtgtggtgtctggaccttgccatggtccagggacagctggattgttacaagggggcatcaccaatgtcaccttagtggtggctaggagatgttcctagtccctgactagtaggatcttttaagtccctcctgtggtgtttatgacacgttcagctgtatgctgggggcaatggacaatgcaggagaaggtgatagcattgttcactttcccgttgtagggataaatctaacatagaaggaaacactaaccgatttgtcacaattaaggactgtcttgtgtggagcctctgtggcagtgctgtggctcttctagggagaggcttgaaggctagagcaggaagacaagtttccaggaagagagcttaggtggcaggaccttgaaggctgggtaacagaaataataatcattgtaatcaaaataatgcatgcatatactttttaaaaatccaaggagcactaacaggcttataatgtatcaagtaacactttccttcgtcttcttctcacccaaatctcactgatactcctttttaaagaggattcttttggtattcatattgatgactctaaacatgcttattttgctctcttgtgattcatcggttttaggcattatttactgacttccgctatctgttggtagacgagtatctgctcttctacctggctacttcccctcccctctgagtcacaatttttttgttaaattcacattccatgtttatgatattatgactatgcagatattcttggctgaataaaatatgtattatgaccctgagcccttccttgtacagttttctttttctggagttaataattgcttcatttctatgtcctccaatatatcccctctgataatctgtcagtggcatgtttttttattaaagacctcatccctggagcactttttctgttaatttcaatctggcatagtcgctctttatatctctgtccatggctatcatccgagacctcctgtcctcctcattttgggaccttccttttcctctctccattgttggattttgtctttccccttcttggtttacttatttgtttttctggattgcatcctgtagtaactctttgaggaaaggttccgtggtaacttttgagagcctaaatgtctgaaaatatctctattccacccttccacttccttgacagtttgcacatagaacttgaaagtgttttcccatgggaataatgcatatgtagtagtctgttgtcctctggggtccgtgttttttttttttgagacgttcacaaccacttttgactttctgtccccttcaactgtgacctggtttttctttctggaaggttctaaaatcttctctttatttttgtgttggcatgccttggtaggaatcgtctttccgttatttgtgctaggtattcattgattccagaaagttatgctctttacctggaaactgtcttgtgtcatttaagataatattttcttcttactcattttgtatattctttgtgaaatttctaacagatgttggtctttgggaattgaccctttagttttcttcttcttttttttttgtctattgtccttctctttgtttcacagacatgatatttcatcttctctgcaggtatcaatgatcgctttgatattattattattattttagtttttcctctaatacttgcactgcctctttttctgccaggttttgttttgtttcgtttcgttcctttcctttcctttccttttctttgtgtgtgtgtgtgtatatgtaggtgtgtgtacttcctgttagagaatttccccagtggtttcctggtccttggccgcttgttcctatataaaggtgagaaactgaaagttgattggatgctctgtgtatggctaggcatgttgacgggtggacttcacacttaactgccttttttgttctctttctctctaagactttcaaatgcctttatctgtagaaatttctctgtggcaattcagattctccaggaaaagattttctgatttcataccgaggcaggacacacctgctgctagggctctttgtctgcagcaggaggggctggggtcacagcacgtttcatgtgttctgttacccccagctctccacaggtaccgggtgtccctgaggccggaacatctctcattcagttttgttttgtttgtttgtttgagacagagccttgctgtgtcgcccaggttggagtatagtggcgcaatctcggctcactgcaacctccgcctctggggttcaaagtgatgctcctgcctcagactcctgggattacagatatctgccatcatgcctggctaatttttgtatttttgtagagttggggtttcaccatgttggccaggctggtcttgaactcctgacttcaggtgatccgcccaccttggcctcccaaggtgctgggattacaggcacgagccactgcgcctggcctctcattcagtttttacaggggatgaactttcctgtctcccgtgggagtggagaagggattgttatctggacctgtggagggggtgggtagggatggtggttatttgtcccatctctcaaatttccctgtttcttagcagtctacctctccagtctgtccctaactgggaccaagctacctatatcactttatttctacagttcatttttcagtcccccccattgttgggtatttagcttgtttgctgcttctcccagtttattactgaactttatgtttaatttgtcttgtctttctctttccaaaggaatatatctgataagtgaaattattagatcaaagaattaaaatatttaaaatacttgaagctttttaaaagcttcagctacattctgccaaatcttttttgtttgtttgttttttgagatggagtctcgctctgtcgccaggctggagtacagtggcacagtctgggctcactgcaacctccgtctcctgggttcaagcaattctcctgcctcagcctcttgagtagccgggattacaggcgcccgccaccatgcccggctgatttttgtatttttagtagagaaggggtttcgccaagttggccaggatggtctcaatctcttgaccttgtgatccgcctgccttggcctcccaaagtgctgggattacaggcgtgagccactgtgcccggcccattctgccaaatcttaaattccacttctgctacctaccatcatcatcatctccatcaccatcccatcatcatcatcatcatcattagttgagtacttacagggaccatgctgagcagttttcgttctcatctcatttaatcctcacaggaatcatgcataaagtgtacagttattcctcagattggcagaggagaaaatgaaggcttaaagaagtttaatgacctgtccagagccccagggttagtgggtgcttggagctgggacttatatccaggctcacctaatggcatagtaacgctgatcatatcagctccccactgccagggctatgctgacccatgccaaccaagactcaccttcagggcctttgagagtgaggaagtgtgctctgaatcttaccttttctcctgctgtcagccctgcgagttaagagagagcattgctttttgctaggggtttttgctgtttaggacactctgttttctgtgaaggaaaaaggatgagttcgtgatctcgctttcttcatgctggtccactctgcactgttattagatagaacaatgctctccccaaggtcctggcatatgattaatgctttggtttgctttctagggtggctatggatttgtctttctttgaataattccagtattatttcaaacgggatctgagaggcagaccatactcttgagggccatgccttattacttatgaattgtttccaaaccctgtctttaaaataaatggaaatataattcagtgggtcatattatgttcacttctaggctggggggatatgagagctctcctaggagtcaggtggcctgaaccggcccctgactcagatggtcctttattttctgagccgttgagtaaaagcgtgtgatatgccccgtctctagctgtttcacaggagttccatgagaataagtaagaagatctctaaattcattcttttaccctctaatctgataggatgaagaccaggaatcataattattgccacattaacacacttagttagagcacattagaaatcctttcttcctttctaatctccctttcttccatctgttcctcgcctccatcaggggctcctggcagccctgggctgtgtgtcctcatcttccgcaagcaccaagcccatggcagctcaatgagaccttcatagaggctgtcggtcctcagcatttccctgcctgcaagcagattcccatcatccagtgaggacaaagtatgtgaaatttgccaaaagtgtcttgcacgcttggtgcccttggcagctacgtcgccagcagatgacaccccaagtaatgcccttcctaaagggcttctcaccctacctggagtactgcttgcccaggtgcccatgaagtgcttccatggaaagtcctggaaccgaggagctaattaatccatccttgcttgagcccagtggcttacctaggagccaagttttggaatatgtattcagggtctcagtcccataaataaagtacatgtgctggaatgttttatgattgggactattgatatgtgaaggtttttaaaaaaaatttttgaaatcttattttaaatatagagacaaggtctcactacgttgcccaggctggtcttgaactcctggcctcgagtgatcctcccaccttggcctcccaaagtgctgggattatagacacaagctaccacatccagccagaatgctttatttatttatttattaatagacaggtttttgctctgtcatctgggctggcataaagtggcacaatcacagctcactgcagccttgactgccccaggttaagtgatccttctacctcagcctcttgagtatctgggactacaggcgtgggccaccacgctcagttaatttttaaattatttgtagagatgaggtctcgctctgctgcccagcctggtctccaactcctgtcctcaagcaatcgtcctgtcttggcctcctaccatgctggaattataggtgtgagccactgcttctgggactggccgtgatttttaataccaccaacaatgggcataaaaaatgaaataagagcgagtgataagaatggtttgctattattgtcaagagaggtaacttacttttgtaacaaatgtgttgattacacatttacttgttaagatggatttgggcccttttgggtagatgattattttgttttattaaaatctctctgagattaaatttctgttaaacagcgagaccctgtactttatggatgaagcattgaattcatgacctgtcaaaactgaggctcatcataacagacagtttccctgaccatgctttgtactattttgtacagcacttatcacctccaatttctctgttttatttactgctgtatctccaacatggagaacaaggctaaattgcactcagttaatatttgttgaatgaatgaatgaggcatttttaactttatccttttttcatgctttccacgtttatatactatccttgagttccaaatctttgtttttgttttttgttttctttttctgagacagagtcttgctctcttgcccaggctagagcacagtggtgtgatcttggctcactgcaacctccgcctcccgagttcaagtgattttcccgcctcaactgcccgagtagctgagactacagccgggcaccaccacactcagctaatttatatatttttagtagagacggggtttcaccatgttggccaggctggtctcgaactcctggcctcaagtgatctgcccaccttggcctcccaaagtgctgggattacaggcatgcgccacagctcccggccttaatcatctttgtcatttctgtgtgtaaacaaatatctccttttcactatgtggcatatattatggacattcttatatccatgagaaaaagtgcaaggaagtgtgtcactctgaatcttactaacttgttgttggaaaaggtacaaatgaagtaagaacgcttcaactaggggagagaaactttcatttaaaatagttatggttgagggaagatggactgcaaattgtagaggctggcctgaggctcttctctgcattgaaagacatggcatcatattttcttcctataacacattagatataaaaacagccagaaaggcaacccccatgtgttttataacaaatcaaataatacagaaatgtataaagaaaaagttactgtgttcattggccccacctctgctctgggccaccctggcacccttctcaggagactgatgtgaagaaagtcatctgccctacagcttaaccatcaaaaaacctcataactcaattaacaaatgggcaaaaaacttgaaaagacgtttcttcaaagaagatatgtaaatggccacgagcatatgaaaagattctcagcaccactaagcagtatggaaacgcacaacaaaaccacaatgaaatatcacctcacatccattagaatggctgttatcaaaaacaaaaaacaaaaaccaaaataaatggtcatccaggatgtggagaaattggaactcttgtgctctgctggtgggaatgtaaaatggtgcagtccctatggaaaacattgtggtagttcctccaaaaattaaagatagaattaccatgtgatccagcaattccacttctaggtatatccaaaagaactgaaagcagggtctggaggagatatttttacactcgtgttcatagcagcaccattcacaatagcaaaacatggaagcaacaaaattgtgtacagatgaatggagaaataaaatgtggtctgaccatacaaaggaatattattcagccttaaaaaggaaggaaattctgccgtggtggctcacgcctgtaatcccagcacttcgggaggccaaggcaggcggatcactaggtaaagagattgagaccatcctggctaacacagtgaaaccccgtctctactaaaaatacacaaaattagccgggcgtggtggtgggcacctgtagtcccagctatttgggaggctgaggcaggagaatggcatgaacccgggatgcggagcttgcagtgagccgagatctcgtcactgcactctggcctgggcgacagagtgagactcagtctcaaaaaaaaaaaaaaaaggaaattctgacacatgctacaacatggatgaaccttgaggacgttatgctaagtgaaataagccagacacaaaaaagcactgtgtggttctacttatatgaggtccctagagtagtcagagttaaagggacccaaagtaaaaagggagttaccagggggtgggagtctggagagtgaatggggagttattgctgaatgagtgtagagttacacttttgcaagatgaaagagttctggaggttggttgcactacagtgtgaatatacttaacactactgaactgtacaattgaaaatgctttaagatggtgaatgttatgctatgtttattttacaacaattgaaaattaagaaaaaatactgaagtcatttagcaggtaaaataaaacaagaaaaattgaatctgtttattagttaaaatgaaacaaacatagaaataaattaagaaaaaagtaaaataaaatttaaaaagagggtagtatgtatcctccacactagtcttaatgcttatatgtgccaaatgtgtgtataggctgcttttttttttttttttttttttggacagagtctcactctgtcacccaggctggagtgcaggtggcatgatcttggctcactgcaacctccatctcccaggttcaagtggttttcttgcctcagcctcctgagtagctgggattacaggctcgtgccaccatgcctagctaattttttctatttttattagagacggggtttcgccatgttggccaggctggtctcaaactcctgacctcaggtgatctgcccgtctaggcctgggattacaggcgcaagccaccatgcctgacgttacccatgttttatttttttatttttttaattttaagttttttttttttcgagagagagtctcgctgtgttccccagattggagtgcagtggcgtgatctcagctccctgcaagctccgcctcctgggttcacgccactctcctgcctcagcctcctgagtagctgggactacaggcgcccgccaccacgcccggctaattttttgtatttttagtagaaacggggtttcaccgtgttagccaagatggtctcgatctcctgacttcgtgatccacccgtcttggcctcccaaagtgctgggattacaggcgtgagccaccgcacccggctcctccatgttttaaatccataccatggacatctttccaggtcagcaaatatagatctgactcactttcctttaaaaggtgactaattatctgtgggatgtgtgtaccatgatttatttcacgtttcctttttctgaaccttcaggttatttccagttttgttgccactacagtgttgcaataaacagccttattcatattaccattttattgtggttgttctgacttctgccgaatttcaaaaagtgttgctaggtcaagagtagtgccagattgtttttcaaaaagtccagagcagctcacgttcacaccacatctggtgagaagcctgactgccgacctcccatgagggccaggtactgtaatctgcaggtagaaaatggcttgctgtgatctttcaaacatatagttaggaagttgagtagcttttataaatttattacttgcattttttttggatgtgataaaagatagggagtctaattttgtttttttttcaagcaaatagccaattatacccatgctgtttattaaatcatttgtcctgctaaattaaaatacataattatatgcattttggatattttcttatttgattccattgatttatttttttatttctgtgtcagtgctagattgctttgggtatgtaaaccttatagaaagttccaatgtcttgaaagcaaaatcccttgccatttttcccttctcaaaatgttgtgaactctcagatactttttccttcttatgacgttttaaaccatttgttcagttatttaaaaaagtccaagtgaggttctaatcctatttaaatctaccacatataatctggtgtgtgtatgtatttgtatgtctcattgtgttttatgaataaagatatatcctcatctttgtcaagcaaactacaaagtattagataatactttctctagttttctaagcatccattaataatttatagtatggacatgaagatgtttttctgtgcttttgttgttgttgttgttgtttgtttttttgagacaaggtctctctctgtcacccaggctggagtgcagtggcaggatcatggcctactgcagcctccacctgccaggctccagtgatcctcccacctcagcctcctgagtagctgggaccacagacatgcaccaccacacctggctaactttttgtagagatggagttttgccctgttgctcaggctggtctcaaactcctgggctcaagcgatctgcctgccttggcctcccaaagtgctgggattacaggtgtgcgccaccatgcctggccattttctgtgtttttgaaacacacatttacttatttaatgaaaatagaacatcatatactaagatatttcagcatagttttgttccacttagaaaaagttatggcaattttatcagtaactgtctaacttaatacccatacatgatgcaggataggtgtgtccccaaattggggcttaacctgggagggttcttggcttcacttaggatggagttcaagggtgagccagtggtgttaaacagtgactttgattgaagtggcagtgtacagcagtggcagaggggctgttccttgtggctaccccataggcagtgtgcccacaatggcagctctggttctacagtcatatttataccactttgagttacagacagattaaggggcagagtatgcagtaatttctagaaaaaggattgtagcttctgtgtctttgggttgttgccatgggaagggcagtaacttccatgcgttgccgtggcagtggtaacctgacataaatatgctgaggcaagtctccctttaatttttcattttcaagctattttaaactatttttaaccttttttcacatgtttattcttccagatatattttattaccatttttgtgtcattttctaaaaaccttttttatttcatttggaatttaatttagtctatgttttatttagagaattgaactcttcgtaagattactttttttcctacaggaacatgatgtgtatctattttcttggttcttctttcaatcttttaaacaaaaaaaatttgtgggctgggcacagtgtctcacacctgtaatcccagcactcggggaggccaagacgggaggatcacttgagcccaggagttcaagaccagtctgggcaacgtagtaagacctcatgtctaccaaaaaaaaaaaaaaaaaattgtgatgcaagaattttacactcagttgaacttgaaggcaacgaaaagtcgcagatgcaggaaccagaaagaatgccacacatacgtttcttgacttaaacaaattgcttggagccaggtgcagtggctcacgtctgtaatcgcagcactttgggaggccaaggcaggcagatcacctgaggttaggagtttgagattagcctgaccaacatagtgaaaccccatctctactaaaaatacaaaaattagccgggcatggtgatggtcacctgtaatcccagatactctggaggtgaggcaggagaacctcttgaacccgggaggcagaggttgcggtgagctgagatcttgctactgcactccagcctgggcgacaaagctagactctgtatcaaaaaaaaaaagtgcagttccggtgaatttaagttttcatttcttttaaaattaagtcatagaaatactgatttacctttcttcagactggaagaagaaatgagattgaaaagaatttttcgtttctttgctttgaattgattgcgactaattgtatctcaaaaagaaaattttatttggttgcttacatatatatatgaagaaggaaaatatatcagagggtcattctaaccctctgatatattcatatttaataattcatagacctgaatgtttcatttgtttatttgattgattatcattccttcattgcataaaaggtaattggtcatttgtttttattcctccactgtttttattgttcactgtaaaagtataatttaatacagggtaaaatttattataaagatcactaatgtggcccttgaaaaaaatggttccagcttgctcatcctagactgcttttaattctctatgattttaagcaagctactttattcaggtcatagttttctcgtaagtgaaaactgcaattggatctagaattaccttcaataagaatcagcaagtatagagccagggttggacataaacagtctgagtccagagctggtgtgattaaatattatgtaatactgcagacctcttaatctctcagagattatgtttctttatctgtaaaacgaggactatgagctctttcttctctgctggtttgcatgaggctcacatatagtaatgcaggagttttgcaatgtcatctctgaaccaggagcaccagtggtatctgagaatgtgctacaaacacacattcttgggctgtattcccaacctactgaatcagaaactaggtttgggaccttgcaacctgggttggaggaagcctctcacgtaattccgatgtgtgctaaacgtcgcgaaccactggaataatacctatatgtaggtttgtgttaacgtgccatcaattatgtaaacaggtttccttttgtcattatgatcctctcctgcatacatatataaatatctgtctaactggtttttgttgttttaattaaacattgaatgcatgaagaatatttataccaggctgggcatggtgactcatgcctgtaaccccagcactttgggaggccaaagtgggaggattgcttgagcccaggagtttgagaccagcctggccaacatggtgaaaccttgtctctactaaaaatacaaaaatttgccaggtgtggtggtgcatgcctgtaaccccagttacttgggaggctgaggcaggagaatcacttgaacctgggaaggggaggttgcagtgagccaagatggtgccactgcactctagcctgggtgatgatgtgagactccatctcaaaaataaataaataaataaataaatttacaccatttgcgaagagtatgaagaagaacagtagcaaaagtacctacatatccctgtcaaatgaattgcaaacaacatgattctcagtatattaatcctatactcatgctcttccctaattgtctgacaccttggccccaccctggatgtaaacataccctcgggttagtgtgtttcatttcctccttttttttctgtagttttatcatccatacacatatgtatatgcaaattcatttcacttagttttgtaagacttggtattatatctaaaggcatcatcctgtgtatattttttctataatttttcaattctctctacattctgttagtgtcatgcatgcactcattttccctgccatatagaattctatatctgaatatgccataatttatttctccgttttcctttccatggacattaggggtgaatctcttttcaaagggctatcacacacagtgcttccgtgaactttcttggacatatttcctggtacacttgtgcaagtgtttctctggggcatagtcttcagattactacacttgcacttcgtgggaagaaatgcactttttatcataaccaagcaatttcatattgtttgttgtagtatagagaaatacaatggattcttatacattgaccaaaaaattaggccctgaaacctccctaaaaactcacatattagttgtagtaactttgtttttgcaaatgccttaagattttctatatagataatcatggtatttgctcataaacacaattttatattatcctttgtaattaatatgccttttatttctttttcttgccttattgcattagctagacccacccttaaaatgtgaaatagagcgattcaagcagatatctttgccttgtacctggtattagaggagcacatttaatatttaacagttcattatggtgttttctagatgtgtatgatggattttttttctactttgctgacaggtttttattatgaatagagatcagattttaccaaatgtcttttctatatctattaagatgatcatatttttttccttttttcatcataatatgttgggtgatgttgatattggaatgttcctcgggttatttagaggtgtgtgtttagttttcaaatattttgagagttcctaagtacctttctgatactaattggtaattcaattctattgtattcaaagaaaatgctttgtatgatttgcatccttttaaattaattaggacttgttctgttgcctgatctatgtcatttctgggtctttttctaaaagtctcttttctcctaactatgagtaatatttttcttcttctttggctacttggtaatcttgaaccagatgtcagtcatgaatttaatcctcttgggaggattctgcaatgcagaatgcaatgcaatgcaatgcagatgcaatgcaatgcagaacaaggctgagctaggaaacgtattcaaggtttgcatttaagctttgttatgcaggaccaacacagcctttattctggggccagtttggctacatgtctaagtctatttgggatactataacaaagtctcatagactgggtggctagtaaacaacagaaatagatttctcacagttttggcagctcaaagtccaaggtcaaggttccagcattgtcaggttctggtgagggcagtcaggttctggtgagggcaaccttctgggttgcagactgccaacttatcactgtgtccttgcatggtacaaaaagggcaagtgagctctctggggccttttataagagcacgaatcccattcatgagagctccaccctcatgacttaattacctcccaaaagcccacctcctaatacctaatactatgggcgtagatttcaacataaacatttaggggtacaggagacaaacattcagtctgtaacactgcactaccgagtacttagtacccttctgagctctcagcccagtaccctcatattccaagctttctctactctggttgtgggatctgtaagctgttctcatccatgtgcgtgggttgggaacaatgcctcttgctcttttccagtgatttttttcttagcctcgggtattttcacacacatgcactgaccagtactcagctaaagacttggggaaccttctacacatctctagcactctctctgagcagccctcttctctctggttctctgccctgcacattctagccaccttgacccccctgaattctccactctcctggtctcagagtgaccactggctgcctgcacaatagcctggaaaccctgttcaagcagtaagtgcaggcaggtgtagacttcacttatctgtttctctcctctcaggtatcactccctgcattgcctgctgttcagtgtctgaaaaccaacgtgtcatgtacattttgcctagtttttaatgcttaaagcaggataattcatctggtccctgatgggttgcttccctagtccacctgggcaacaagtagaattgatatatgtattttttaggtagaaaacaaatcccaaattcaaactgatatttccaacccacgtcatcccagaatcagttaacctttttgattgtgtacttgtctttgatgctgaaagatcttggttccaaagacatgaccaatagttgctcgttgtttcttctcattttattcttaaccagaagagttaggtaaaacaccagctcactttactgatgagggaacagaagcctgcaaagattgaatcacttgccctagagtccaggatggtagttttttggccacattatggaaaatatcttcaatggcacagctgtaattttgttcgccttggtctatcacttttctttcttttttaaaattctagatattttttagtgcttcactttttaaaaaattttgttttatttttaatttttataagtacatagtaggtgtatatatttatggggtacacgagatgttttgatgcagacatgcaatgtgaaataatcacatcaggtctgtcactttgaacttcacacacacacctatgtacacatgtcctatccttctgtttcctcactgcaatttcagtagggtgtgattctggagtatataaatacccaggaagttgagattcagttctaaaatcctcctgagtaggatccagaggttaaaggagtcaggccagagcttgtcctcagactggcccagggccggaagctgctgttgtacttgcattttttaggttgttattgtcaaagtaatgacttgtgtagcctggttggggatcattgcttttctcagtgaaatgtgtttgtctcattcatgtacatatagagaggataatcggtgacatcctcaactatcatttaaaagtgctttttctagattccacagtaacctctggcatttatcttcagattctctattccttagtgatgatttctgtctataacagagtcttagctcaacagagtcttagatgtgaccgtcttaatcttagatctgttcaccttttgtttcataaggatgtgtaccaagaagaacctgataaggagactttatttgctttggaaaagatgttctgggctgggtagtgagctgttttccttcattattaaagactgcaatagttgctatcagatttttttctgttttactttttcctattttgtttaataaggaagatattcattgagaaaaatggaggctaatagaactataggcatgaataacattagcatgtgtacctttgatattatatacagcctgagggtcctgtggtgagtacatggctgaggccatctttagtattctggataataccctggtttctcaatgaattgttgcagaaatgcttggaaggggcagcaagaaatggtgaatgtattaaaatactccccgcacctggtgctgtttcttaaaggagctctgtatttagcggcctgcaataaaatggctttgctctaatcaaagacatctgcatttcattgtccatcaaccattgccttggaaggaccattgaggctgatttgttcttgacctctccagtccttcctgattcactgttttcattgaccgactcccactggtttattgatgaggggttagtgtccatctttgaggatgtaggtgtcaccatgccctgaatgggaagctggacacggcgagaaaggggaaggagtggaggggaggagactgctctttactcactgtctgccaggtgttagtcatcattctggccctgcacaaattctcctttttgggcctcacaaaaccataggaagaatgtactgttgcctccctttttcagaggaggaagctgtgggaaaaaactcctatgattatacaccatagactttttgttctgtaattttgtttttgtttgtttgtttgtttgagacaggatcttgctctgtcgcctacgtagtgcagtggtacaatctcagctcactgtagcctcgactgctacaatctcagctcactgaagcctcaacctcctgggctcaagcgatcctcccacctcaccctctcgggtagctaggaccataggcacacaccattatgcctggctaatttttataattttttgagacagggtctccctatgttgcccaggctggtctcaaactcctgaggtcaagcaatcctcccactcagcctcccgaaatgctgggattacaggcgtgagccactatgctgggcctttgttctgtaatttcgaattgccttgtttctgctttcctgctgtaagcatttcatataaatttaatgtcatattcatgtaaatgatgtggcttctaagtcatcacttgctgccagtgaggcaatcaagaaacaatatttgagtttatatctgagaaatacccctccagttcaagatatttatctattcccttcacaaatatatgtaatctttaagatagagatttttttcttttcttttccttttttttttttttttttgaaacggagtctcactgtcgtgcaggctggagtgcagtggcacgatctcagctcactgcaacctccacctcctagattcaagcgattctcatgcctcagcctcccgagtagctaggataacaggtgcgtgctgccatgcctgtctaatttttatatttttagtagagactgggttttaccatgttggccaggctgatcttgaactcctggcctcaagtgagccacctgcctcggcctcccaaaatgctggaatgacagacatgagccactgcacctggccaagatagagatttctaaatagtaatcaatgcattgattatgaaatcctctcttctcctaaactatctagaaaatgaagttaagaatcctgtaagagcctgctcttatggagtactgttggtgagaagtagagctgatgtcctaacctgatagcctccgtcctggatgggtctgagcagagaggtggcgtgatggtcatctcattgtagaaagactgatttggaacctacttgtaattatcatcctaaaaccacagatttgacttcttggtgttatacctattattgaatatgattttcttgtccttatagtacagtgtaattacagagcataagaaaatgaaatctgtttggccctcttggatatcattgcaggaaagccaagatgaagatcaaagatgagttgtgcctctttagtttttatagaatgcatatctgaaactaggcagatcaagatcataatggaaaagaagaattgtaaccatcttttttttattttttttgaaacagagtctcactctgttgcccaggctggagtgcagtggtgcgatgctggctcactgcagcctccgcctcccaggttcaagcgattctcctgcctcagccttctgagtagctgggattacaggcatgagccaccacacccagctagtttttttgtgtggttttttttttgtatttttagtagagatggggttttaccatgttggccaagctggtctcgaactcctgacctcaacttatccacctgcctcggcctcccaaagttctgggatgacaggcataagccactgcgcctggccatagtcatctttggaatattatgaatgatatatgtctccaatgggtatctcattctgtgtttgctggatctttcttttgtagattctatcaggtgactaataaaaaatataatgtagctattcttcaggggattgtaatttgaggattcatgtaataatctcattcattagaaatattcattacttggccggactggatgtcccatgcctgtaatctgagcactttgggaggccaaggtgggtggatcacatgagcccaggagttcgagaccagcctgtccaacatggtgaaactttgtctctacaaaaaaattttaaaaattagccaggtgtggtggcacatgcctgtcgttctaggtacttggggggatgaggcgggaggatcaccagagcctagggaggtcaaggctacagtgacccacgattgtgccactgtactctggcctggttgatagagtgagatcctgtctcaaaaaaataaaaaataaacataaaaaaagaaatatttattactttctagcctacagacttttcattgtcaaaactgatcactcagtttgcagccagtaagtctgttctgttggtttcttattgcataatcccaggacttcagttttcttctctcatgtaagcctggtttaaaagaaagagccaaatcaaagattcagtaaaatgcaaactattttgtcttgtctacttggctctgcaaaattatactttcctgttataaacagtaagctgcttagggaagaattccagcaatttgtctttcccagtgctgttcatggcagccagcgaggcaacgtatgtacagcaactcccggttcttgtttaatttcctcagtcaaaacaagagattgtggtggtgcctgccggttcaaaaatggcacatgtttcttttgcctcttctcattaccccgtgaatcagaaggcgttagaaccagagggctctttaaaggcaatcctgttttacagataagaaactgaggcctaggcttagtagctcattcaaggtcatgcattgtgtaagtggtaaagttgagtcttgaatccgttttgcttaccctgaggtttttcttggtttcccatttctctagctttctctataacagttattcatgttctagaaagaaactatgggcccactaagtgcattagctgtactctcattcttgaaatagcatcagactagcggacaatgtgatcaccagtcactgatgtgtgtgatgagaaagcttggtttgggaagtaggatggtcatttaaagagagaaatctaggctcttctctttgtttctgggctattccagggcatatcttcaccactatggactggcttggtcaaatgtgatgaatagaccagctttataacagctttgctgcttgcaagctgggtttaacccttctgagtctcagcttccgcattaaataatgtgacacctggcatccactgtatacaattactaagatatatatgaaagtaaactatgaaatacgctggaaatgtgaggtatattatgatatggagggcatactaccaaacccaagagttagaatgaatagatgacggcggtgattggaaatcttgtttgtgcttttgcccagagacatgaaacagattgtacaaacatcctctaagcggtgacttttcattccagtgaaaggcattcttgaagggatgtgcttctaacatgaatctctttgaaagcttaggttggagaggcagattctctcttgtgataaaccaaatggatggagaagtgattttagtaaccctttcttgagtgatgggaaaccacagcctctgctctggaggaaagcagaagtgtgtttgagtttggggaagaagtggtgaataactgaattttttgatggattttatagaagagataaaaatatgtgtttttaaaatatattcttttctgacatcgttattataccttgagtactttctttgggactaagcctgtgccttgtaatgagaaagacacaaaagtaatgtgtaacgagggccccaatcatagggatttccttctaattgatggcagacaattacacaagattgtctatgattaaaaacccaaactgcgctggaagggaaaattgttgtggaatgtcagagaagaaagagatccacgcaggtaatcgggagctagtagccatttgttgaattgcattgtggatgtgagatttggattgttacaaatcaagacaggcccttgttctaggcagaaacaaaccatggactgagctcagaatttaggggagaacataggagtcttcactggagagtaggctggaatttcgcagatagtggagacaaagacagataattacgggctgggacaattttggaggtattttgggtcaggcttagagatctaggttttaagcaaaccggtctttggtgtgtgcgtgtatatgtgtgtgtgtgtgtgtgtgtatgtgtgtgtgtgtgtgtgtgtgtgtgtgtttccagcagtccttggtaggtgtttgtgtttggagcttccagtgcaaggtgctgcctttgagagcttctgcttacttttccaatgaccggaaccaggaagaggtgaagcttggtcattacacaatgcattgtgactcagtgacctcactacttcctgttttcatttgagaagggggccaatggaagggaccatttcagtacaaggccatgaatagggagtaggagatgtcaaggatatgaggtctgccaaactagcaggcagagcatttgcgtaaaccagcagacgaatgaaggagttgaactccactggaatagcagcggtggcccagttacccatgagaaagtctaggaattgggaattactcctacttctgaatcgcgtgcgatttctcctaacctatgtcaccagccaatcctggttgtaaattcatagcctagtccataagctcaatagtaaaataaattccaacatactttgtccaggcttctgtgccaggagtgcaggagagcactacttggatgacttcctttatcaaggagaggccactggaaaacaggtggctggacgtgtgctccttcctgctcactgagaggttgactgtgatgtaagccaagctgcaggtgcagggtgcactgcaggcccagggaagagctgggaagagccgggaagacccaccactggcaatgtcaaggacgcctttcttccctgtgggatatactgatggactgagtgactatccattcatcagtgtggatggccactcatcaggcctgcagagatgggagccttatgggttccttggattgtcaagtccatggctagagctgaatctctaagggagttcttttttcctggaaagatgtagttccctcatcagtagagtgagggtaagaagtaaatctacttaaaaaaaaaaaaaaaccagcttccgtcaagtgtaatttatataccataaaatccacccgttttaagcatataattcactgatttttagtaaatttacagagttgtgtaaatatcaccgcaacccagttttaggatgttttcatctccccaagaagctccttagggccttttgtggtcaatcaccattccctcctcacagccccaggcaaccaataatctcctatattgcctttgatagatttgctaaattctggacattttgaataaatggtgtcataaactatgtggtcttttgcatctggcttctttcctttagtgtaatgttttgaggttcattcacgttgcagtatgtgtctgtattccatttcttttcattgctgcatagtattccattgcatggatataccatactttgtgtatcctttcatcagttaataaattatttccattttgggggctattgtgaataatgctactgtagtggatttcagtggctgctgtgacaaattatacacttgatgtctcaagacagtgggggtttattctctcacagttctggagatgggagttaggaagtcaaggtgcaaacagggctgtgctccctccggaggccctcggggaggttctgttccttgcttcttccagcttctggtggatactggccttctctgacttgcagtcacatcagttcaatctcagcctccatctgcatgtcgccttctctcaggtgtgtctctcagctctctctctttctctcttataaagatatatgcgattgcatttaaggccaccctgataattcagggaagagagctcctctcaaaatccttatcattggtcattagaaaaatgcaaataaaaactgcaatgagataccatctcaagccagttagaatggcgatcgttaaaagtcaggaggctgggcacggtggctcacgcctgtaatcccagcactttgggaggctgaggcgggtggatcacgaggttaggagatcgagaccatcctggctaacatggtgaaaccccatctctactaaaaacacaaaaaaaattagctgggcttggtggcgggcacctgtagtcccagctactggggaggctgaggcaggagaatggtgtgaactcaggaggtggaggttgcagtgagccaagatcactccactgcactccagcctgggcaacagagcaagactccgtctcaaaaaaaaaaaaagtcaggaaacaacagatgctggagaggacatggagaaagaggaacacttttacactgtttttgggactgtaaactagttcaatcattgtggaaaacagtgtggtgattcctcaaggatctagaaccacaaataccatttgatccagtaatcccattactgggtatatacccaaaggattataaaacatgctactataaagacacatgcacatgtatgtttattgtggcactattcacaatagcagagacttggaaccaacccaactacccatcaatgatagactggatgaagaaaatgtggcatatatacaccgtggaatactatgcaaccataaaaaaaggatgagttcatgtcctttgcagggacatgggtgaagctggaaaccatcattctcagcaaagtaacacaggaacagaaaaccaaacaccacatgttctcactcataagtgggagttgaacaatgagaacacaaggacacagggaggggaacatcacacactggggccttttggggggtgggggtctaggggagggatagtattagaagaaatacctaatgtagatgacgggttgatgggttcagcaaaccaccatggcacgtgtatacctatgtaacaaacctgcatgttctgcacatatatcccagagcttaaagaataattaaaaaaaaaaccttaacttaatcaactcttttgccttacagggtaagatacacaggttccagggatttgatgtggatttcttttggccggggggcacctttacagcccaccactgcagctctgaacattcacataaggttcttatgtagacacatggcttcatttctctttgtaggtacctaggaatggattgctaggacctatggtaaatttatgtttaactttttgagaagttccccaactgttttcagaaggggctgtatcatgttacattcctaccagcaatgcgggagagttctagtttctccacattcttgccatttgtctgccttttcttttttctttatcatagccattctagtgggtgtggagtggtatctcactgtagttttaatttgtattttcccatgactaatagtgtcgaacatctcttcgtgtgcctgttagctattcatacataatttttggcaaaatatctattcaaagctctggcttgtcttaaaattgggttgtcttctttttttgagttatgagttagtctatcatttttcacaacccggcccagccattgccagccctaaagactgtggtggctgaggtcaccttgattaggaagtgctggggtaacccagttgcccagggtgccctgggctggggccaggcaccatcgttgcaccgtgccctgtgtcagtttgtcactggagggtggatgggcctcacaggtggccttttgccatcagatactgtgccatggaagccaggacatggctcgcctgtgtactagagatcatcagttccgtgttcttgcaggctggctgttgtctgatgaacaagggcactgactaacaaaatcccacaatatattttcattgtaactggattgtttctttcctaacacttatcacaactttaactagttatttctgtgattatatatttgatatctttcttccttccactcaactgttaagttccctggggacaggggccatgtccatgtgatttgcccctctatcactagtctctaacacagttcgtgatgtgtagcaggcaactgatccatatttgttggatgggggaaatgaggatccatttctgtgctttacagtgggcaattcacatgaaattattaaatagagagttgtttgttgaccgaattgttcactgtgacatgcattcttttttttttttttttgagacggagtctcattttatcacccaggctggtgtgcagtggcgtgatctcggctcactgcaatctctgctgcccgggttcaagcagttctcctgcctcagcctcccaagtagctgagattacatgcgcctgccactacgcccagctgatttttgtatttttagtagagatggggtttcaccatcttggccaggctggtcttgaactcctgacctcatgatccacccacctcaccctctcaaagtgctgagattataggcgtgagccaccgtgcccagccaagtgacatgcattctaatttcccttttttatttctcatttccagcgatctataactacaatgcttctcaagatgtggagctctccttgcagatcggtgacacagttcacatcctggagatgtacgagggtaagtctggctggccttctgccagatgagggcaagggaaaaacagtgtaagttacttattaaaaaggcacttagagtaaacatcaacatgcttgacttcctgaaacagtgctagtaaaaattcaggaagtacttgggtgacacaattttgaacagagtgtgatttcaaaacagccagctgagtacatgagcacaaacttgcacagacaccagggtgaaagctcatgcatatgtgaagggtgctggtgtggccaggccacttgggcacagaaggatcagtgacagagctggctcgcgaggagacacttgggatgttgggctggcagtagctcaaaggaagcactgctgattaagggtctctttctgttcagcactaaatgttcccaggttgggggagaaatgagggagagtctttctggtgttgctgagattcttttagaaaattaggtcatgactgcagcaggtccagaaagcctgattgtatatctccttcaactaggtcaggcgagggccgtggttccattaacctgttagtgggctgcggggcagtacttaggactgcctatttgtctgccaagcattggtcatgtctgtacccactccactgcaggcttccaacttcagctcaggttctctaaatcctagaagaagtcttcctccatatatccacatttttaatccaaacctctggagcacaacaaaagcatagccaggccactgaagttgaggaccaaaccaagaactatgtttagggtccagttattctctcagaaggttagggtacaaatgaggtggaaattaggcagatttgacagggaccgtgcattttccgggtctagcccccatgtaaacccttgtgatggtgaaacggcagagatggtccgcgaggaccccgtgcaggttcctagggtgggatgggatgacacaggatgagaaagaagagatgggaaggcaggaggaaaggaagcaggatttggccacagaacagctaaattatctgcatggttgcatggaagactctgctattactgcagcctccctttagtttttggcagagggctggggtttcacattatccttttcccttccacacaactcaatgtaatcatgtagctcccaggggcagagagaagacagagagggctgtgtgaactcttccctttttctttctactgcttattctcaccatctcaggcccagccaaagcatcaattcaaagtctccaagacactagggcagtcgccttatcttttccagaatcttttgcttatggaaaccacagctcttccaatctttttatttatttatttattttttgagacggagtctcgctctgtcgcccaggctggagtgcagtgacacgatctcagctcactgcaagctccaccttccgggttcatgccattctcctgcctcagcctcccaagtagctgggactacaggtgcccaccaccacacccagctaattttttatatttttagtagagacggagtttcaccatgttagccaggatggtctcgatctcctgacctcgtgatccgcctgccttggcttcccaaagtgctgggattacaggtgtgagtcactgcgcccggcctacagctcttccagtcttatcagctcatacctcttttgtcaggaggccaggttaattcactttgtctagcctcaatggatgcatattttcctattgtgcaggtaaaaagcataagttcaatttttctaactcttccatgtgggcttggaaagaatgtatatttaaggattattgggtgcaaagttcttttttttttttttttgagatggagtctcattctgtcgtccaggctggagtgcagtggcacaatctgagctcactgcaacctccacgtcctgggttcaagcgattctcatgcctcagcctcctgagtagctgagattacaggcatatgtcatcacacctcgctaatttttgtattgttagtagagacggggtttcatcatgttggccagcctggtcttgaactcctgagctcaggtgatagccccatcttggcctccccaagtactggaattacaggtgtgagccaccatgcctggtggcaaagttctatatatggtaattaggttctaatttctgagtcatttttcaggtttgctatatgctaacttttttttcctgctttctctgttactgatagaactgtgttaactcttccaccatgattgtagtttgtgtctctttatggtgatgtcagctgtttgctttatgtattctgagacttgtttttaggtgcctgctaatttagaattgttgtgttaaacagttctaacttttaattcctatttattaaacctttatcattgtcttactctgtagtaacatgctatgtcttactctgtgttgtgtaaaattgcagccaactcactggcaagtcccagggcttcaatttttgtcctcctggctccacaaggccatcagaaatgctgctcagcttctcagccactcaggaatcctttctttttgttgttgttgttgttttttgtattttttggagacagagtcttgctctgtcgcccaggtggagtgcagtggctcaatcttggctcactgtgatctccgtctcccgagttcaagcgagtctcctacctcagcctcctgagtagttgggattacagacacccgccgccatgcctggctaatttttgtatttttagtagagacagggtttccccatgttggccaggctggtctcgtggccaactcctgacctcaggtgatccgcccaccttggcctcccagtgttgggattacaggtgtaagccaccgcacctggtcaggaattctttcttaaatcagcagatggatgccccaagcggaaagcagccccagatgctgagctggtctttttaggttttggtctctttcagattttgacctggtaattcttcactgccatgttagtttgtgtgtgtgtgtgtgtgtgtgtgtgtgtgtgtgtgtgtgtgtgtgtgtgtggcgggggcggggtggggcagtgtatatgtttgtgtgtgttgttttgtcaagcttttctaattgtcctacagagtgtgggagggaagaatggagacttggtctgaaataaagtaggtaatgtcttttgttttttgttttttttttctttgagacagggccttgctctgtcaccctagctggagtacagtagtgtgatcataactcactgcagccttgagctcctgggctcaagctatcctcttgcctcagcctcccaagtagctgggattataggcatgtgccaccacacccagctaatttatttatttattttaatggacacaaggtctcaccaagttgctcaggctgatcccaaactcctggcctcaaatgatcctcctgcctcagccttccaaagtgttgggattgtaggcataagccatagcacctggcccaggtgatacctttaaaatatttcttcaaattttttttcatttttatgtgacctcagcgtatttctaagaaatagttaattgaaacactttgtcctgttagggttcatatcaatagtaattttaaggatgagtgtggtggctcactcctgtaatcccagcactttggtaggctgagatgggaggatcccttgaggcctagagttcaagaccagcctgggcaacatagtgagaccttgtctctacaaaaaatttaaaacttagccaagcatggtgacatgcacctgtagtctcagctacttgggaggctaaggtgggaggattgcttgagcctgggaggcagaggctgcagtgagctgactacaccactacactccagcctgggcaacagagtgagtccctgtctcaaaaagaaaaaaaaaagtaattttaagtgtctcactatactttaccaagagttctccagttggcctataaacattcctcaagacagcatccctatggaccaagctaagggggtcactgagcttagttgaatataaatataatcacagatacattcatttcaaataccatgcacttgagtccaaacagtccaaaacccacagtgcttctagtatattacagctcacactacgatatgcttgtaggatgtgctggcccatttgacagtcacacaaaaatggttaacttcttcagttatggtgatccggatgctgtagtcctgcccgcaagaaaccgctcttcttaactgctaccataacatttttgctgcgtcagccgtagaactttttcatctcaaaggacgtcagtgcctgttctttaaaagtaagcgcatgtcaaggcgtgaaggggagggaggttgagaacacttgagcctgcaccgtgagcttactgagttcattaaccaccaaggggcaggtcagcttgacagagagattactatattggattatatttttcattagtgtttattttctgggattaatttttaaaatcgtgcctaccttgccagatgtcccatgataggtccttgtatctgctaagcacttagagttcttggcttgattctcaaattcctttattatttaaggcagctcgaggcaagggccggagtgctttgcaaacatgaaacgcgatgggaatgctgagtaatcacttgtcttctacccctcttctcctagtccctcttaactttagaaaaataaacacaatgaaaacaccgacagtcctgccgggtggaactgaagggtgacactggcactgtattgtggccctgggattcgtgtcttccagcttcctgtcggagctgactttggggcgctccctctgcactctgccccaccctgccctcgagatgtctgcataccagatctgtgtgtgtttttccagcgtggacatgaatccacccagacatgaaacattttttctgcccaccgcccgggacagaatactatttttgattctcctttttctgtttcctgccgtgtggttggctgaaaaatttcagaaagtattggctccttgaaggcaaagcctgttcctccttcatctgcagagcctgtgcctccctagctcctggtatacggcaggtgctcagcaacaatctattgaatgatgaaggtaaaataggagaccaaggcaagctggtgtagagagtaagggggtcaggggtcacctccacaaaaccctgggtattacaaggcagaggtgctgttccttctctatgagggaaatacagggggtgctaatgttttttggtcctctgcaattataggaggatttagtcattgctgaagtttttgtttttattttatttatcttttttttagagacagggtcttgctgtcccccaggctggaatgcagtggcataataacagctcactgtaaccttggccttttggactcaacggatgctcctgcttcagcctcttgagtagttgagactactggtacatgccaccatgcctagctaatgtttttaattttttaggagaggtgaagccttgctgtgttgccctagctggtctggaactcccggcccttagcgatccttccacctcggcctcccagagtatagggattacaggtgtgagccatcgtgcctggccttgtgggtttttttgtttgtttttaataacagctttcttgagatataattcaaataccaatcaatttacttatttaaagtatacaattcaatggatatttactaatgcagagggttgggcaaatatcatcactatctactttcagaacactttcatcatcccataaagaagctctgtacccatcggtagtcatgcctcccctggctctaggcagcttcaaattcatttcatgtaagtggaatcacataatatgtggtcttttgtgactggctgccttcatttggcatcaggacttcatctctctcgccctctctcttgctctgttggtcaggctggagtgcagtggcatgatcacggctcactgcagccttgacctcctgggctcaaggaatcctcctactccagcctcccaggtagctgggactataggtgcacaccgctacacccagctaaatttttattctttgtagagacagggtctcgctatgttactgaggttggtcttgaaatcctgggctcaggcagttctcctgccttggcctcccaagggccaagtgtcccagtgtgttgggattataggcatgagccactgcacctggcccaacttcatctcttttcattgctgagtaatatgtattatgtaggtacattatattttattcattcatcagttggacatttgggtcgtttagatgtttcagctactgtgaataatactgctgcaaacatttgcgtgcaagtttttatgtggacatatgttttcatctctcttgggtaggtacctaggagtggaattgctgggtcatagggtaactcaatgtttaatattttgaggaactgccagactgattgagctttggctccaaaacaggcgaccagagtccagatgaacgagcttctatccatcatcttttttcactcatttgactctctggccttgcccctgaacttcatttgttgctaaatgaaggaaagaagcagaactgactgagaagctatctactgctcatccgttacaggtctccaggaattatttgtctttagagactttatcaggaaacagaattccttaaggactgaagcgagcgttcttgcctttcttcatctttggcactggcttgcccacagtcatttttgtgtctttgcttcttttactgtggaatgtatttggcagcgaggtagctgtttattactgtgaacgttcctttccaccccagatccatggcagaaagtgcactgacttctggagatgcccggccgtgaggtcatttattcattcaacattatttgctgagcaccaagtatgtgccaagtacatttattgagcatgagagatgttctgggtactctgtggtctcttaagtgacaaaatgcaagttcctgctctcatagggtttacattggagggatagacaaaaccaagtaaacaaagtaagtaaacaaaacaattcagatatgtgcttacaaatgctatggggagaagagggtggtattgcagaggccagaggtggaggacagcgatggagagggagacggaagactattgtaggttggtagttttgtccttgtctagattgactgtccctgggcaagatattgcagctgtctttgtgacaaggacatttcatctaaattggagtcactttttgagtcaagagtgatcaaatgtaagtgctttgaaaagtgcatagtaccttgtatgtgtcaggtttcagcatcctgttaccatggagctcccctctcctgtgattaacgtcactccagtcacaagtggttttaggcctggagtctgaggttcctctagtgctggtttcctgtgtttaattcatatccatcgattaactctttttctgctccgtaaaccactcacaagctcacgagaaagggcggctggtatgctggtgttagcagtgatttctggggtaaatacaacacaattgaccgctgttggaacaaacacaacgaaatgtctcaaaggtgagctgaactgtacagaggcaggcacagcacatattatttcagggcaatttgtaaagactcgaaggatagcacaaatgcttggactggaaccagaggaaacaggcaaacctgaaaagttaaaagaaacaaaaagaagggtttgtatacgtacaggagttccccagaatacccatgttatttcttctatatagaagaagtctagtttttgaatgcactttaatcaaaaaatctacttccctctaatatgaaaaggaataaaaatgtattaagacttgagctgtatgtgttttgaatctcatttttataaagcaggcctttgtgagtagggacagtgggcagtgttatgacaggtaagttacatggcaatgaattttgtctgcatgtttgccaaaactttctaacagagatataaaaaagaagagagtgggctgggtgcggtagctcatgcctgcaatcccagtactttaggaggctgaggcgggcagatcacatgaggccaggagtttgagaccagtctggccaacatggcaaaaccctgtctctactaaagatacaaaaattagccgggcatggtggtgtgcacccataatcccagctacttaggagactgaggcacaagaatcgcttgaacccgggaggcagaggttgcagtgagctgagatcacgcgtgccattgcactccaacctgggtgacacagcaagactctatctcaaaaaaaaaaaaaaaagagtgcttttaaaagatttttttcaaacagaggcttaatcatcatcctttagagatgtggtaataggaaccctgcattggattatgatacagtatggtatctaacgttttgagaatgtctgtctgattgtcacattctgttatgctctatgacaattaattctgtaacactgaaatctctttattgttcctcctttctacttgtttctttctctacttggtcatccatgcacagtggtcagaagccaagagagagacaaaagattcaaaattgctgttaaaaatcagttcttaatagaatgtgtaaaagtttactggatataagcttcaataggggtgtccaaggtatttgtaacttccgtttacttttgttacccgctaattaaaataattgaaagtttattgtaattcaaaatctatatagtctccacgatctaggtatagaaatactgcctttctcatacataaatggcagtgagcctaacagcttggattttatgacgctgcgtgcaaatattttggcattagcctggaaagcagataaggccatgtggcattttgttgagtgtgcttggtcacttcccacatctgtttgacctttaccttaagtacagcttgtgagctactactgctggtgacatatgttcctgagatgtgtttttcaaaagatatgtgtggcagtaggagggtgtttaccagagaaattaattaaaaggagtgtcagtgaaaagtcttatctcggatttaatctttaaaaaaagcgaatgccttctatttttccttttcaggtatgtttcagtatgcttctaaaattctaaaattccatctttatttatttttttgagacagagtgttaccctgtctcccaggctggagtgcagtggtgcaatcttggctcactacaacctctgcctgctgggttcaagtgattttcatgcctcagcctcccgagtagctgggattacaggcacgtgccaccacgcccagctaatttttagtagagacgtggttttgccatgttggctaggctggcctcaaactcctggcctcatgtgatctgcccaccttggcctcccaaagtgctgggattgcaggtatgaaccaccaaccctaaaattccatctttaaaaatgtacgtgattcaggtataggcatatatggaattttctactgtagagttcacaactgtttcctgagtggtaccttcattcagttattctgtcatgagtaagtacttggaattacctatttgggcagctcctatgcacctaaggaggcaaactcagtctgaaagcaaatatgcttttgggagtactctggaggaatattcccaggagcttttagcattccacagattttggaccgcaacagatcttggttggatcaagtggttgaaatgggagcagagtccttccatcccatgcacacacatacctgctcacagctgtcttcacacccctgattgctgtagcattcacattatttggtgcataacctttattttttttaaatgcgttaggttatgtccatataacatcacggttgggctggctaagcctcattaaggattagtgtaaggagaaagccttagaggaaagtttaaaattgattgagggcaaatgatcatacttctcctcttgcttatatctggaaaaaaaagttaaatatatgcctctgcttcatccatagtaatataagagtcagttattatctttaaaagcatatattgatgaaagaatttgaaatactaaataaatggaagctatcccatgttcatgggtagggagactcaatgtcaaaatgtcagttcttctgaagttgatttatagattcaaagcaatcccaattaaaatcccagacagttattttgtggatatcgacagatggattctaaagttatgtggagaggcagaggactcagaacaaccaacatgaagttgaagaacaaagttggaggactgacactacctgatttcacaacttactataaagctatagtaatcaagactgtggtattggcagaacactagacaaacaaatctactgaacagaacagagagctcacaaatagacccacacaaatatagtcagctgacctttgacaaagaacaaaggcaatacaatagagaaaagatattctttttaacaaatcgtgctggaacaacctgacaaccacatgccgaaataataatttagacacagacctttcacccttgacaaaaaataagtcaaaataaattcaagacctaaatgtaaaatataaaggtgtaaaactcttagaatataataacatggagaaatgtaaatgacttttgatatgggggtaactttttagatataacactgaaaacacagttatatgaaagaaataagtgataaactggactttattaaaatttaaaacttctgctctgcaaaagataatgtcaagagaatgagaagttaagccacagtatggaagaaaattttgtaaaagagaaatttgagggtgggcccagtggctcacacctgtaatctcagcattttgggaggccgaggtgggcagatcacgaggtcaagagatagagaccatcctggccaacatggtgaaaccccgtctctactaaaaatgctaaaaattagccgggcgtggtggtggccagctgtaatcccagctacttgagaggctgaggcaggagaattgcttgaacctgggaggcagaggttgcagtgagccgagattgtgccactgcactccagcctggcgacaaagcaagactttgtctcaaaaaaaaacaaaacaaaacaaaaaaaaaaaacatttgataaaggactattatctaaaacgtataaagagctttaaaatccaacaataagaaaacaacccacttaaaacatgggcaaagaccttcacagaaacctcgctaaggaagatatatatccatatggcatgtaagtgtgtgaaaagatattcagcatcatatatcattagagaattgaaaattaaagtaatgagatactactgtgcacctattaaaatggccaaactccagaatactgacaacaccaaatgctgccaaggatgtggagcaacaggaactctcattcattgctgatgggaatgcaaaatggtacagccactttgggagacagtttgttagtgtcttagaaagctaaacacactctcatcacacaatgcagcaatttctgtccttggtatttacccaaaggagttgaaaacttacacccacacaaaagcatgcacatagatgtttgtagcagctttattcataattgccaaaatgtgggagtaaacaagatgttcttcagtaggtgaatggataaacacagtgttacatccagacaatggagtatcattcagcgctaaaaagaaatgagttatcaagccataaaaagacatagatatgcatgttactaagtaaaaagagtcaatccacatgattccaactatatgacattctggataaggaaaaactatggagatggtaaaaagattcgtggttgccaggggttagagggaaggagggatgaagaggtagagcacagggaatttttagagcagtaaatctactctgtatgatactgtaatggtggaatcatgtcattatacatttgtccatacccatagaaggcacaacaccaacagtggaccccaatgtaacctatggactttgggtgataatgatgtgtcagtgtaggtttgattgcaataaatgtaccactctggtggggtatgttgatagcagggatgtcttgtcaggggacaagaggtatatgataactttctgtaccttctgctcagttttgctgtggacctaaaattgctctacaaattaaaggctattaaaaatttttaagcatataaggagacttctgtgtcataaatattaactctgtgcttgagtacacccattctgtttcacccatggagttgaatgattcaacagaaatggtcatagtagcaggaaacagactgcctaaaaaacttgtgttttattgatgggtcttagaaacccatgaaaacttcacttctcttccttgcctcatctccaggtataattcaagctacaaataagaatggacaaggcaacacaggaaagtttctagttacagaaagattcttagtcttactattatattctgtgtatctgttcctaatgtttgtcatgcaaccaagaatattagatatgtgtgtgtgtgtttaacttttccaataggaatataggattttaaacaactgtatctagcaatttggttaatcttctaaatggcaggaacaatgagtattacattactaaccttgaatacttgtttagttttcaccaatgccagtgtaagaatctgttacaggccgggtgcaatggctcaagcctgtaatcccaacactttgggaggctgaggcgggtggatcacttgaggttaggagttcaagaccagcctggccaacatggcgaaaacccgtctctactaaaaatacaaaaattagctgggtgtggtggagtgtgcctgtaatcctaactacttgggagactgaggcaagagaatcacttgaacctgggaaggagaggttgcagtgagccaatattgcaccactgcactgcagcctggtcgacagagcgaatctccatctcaaaaaaaaaaaaaaaaaaaaagaatctgttatagttggaattgaaagatacaaagggtgaaattttttcttagtgtcactttcattgctgacactaagtgtttaatcaggccttagataaccaatttgggtaacttttgagtttggccccatttggtctctgccaaggccctggttactcagtgccatgtttctcgattattctagccacagtcttagggtttttctatcactcaaattgtttcttcttgacttttttttttttggtcctctttcttttaaagtcatcttttctaccattttcttggagtagggaagttatgctggaaaataaaattatgtcttcatatcaggtactatagtctggacacccctagcatggtattctagctgttttgtgtgtctcagctttggttgttggcagtaatttaagtagttgagagaggttctgttctttttgaggagcacagacacattcttcaaaaaaataagtaaaaaagaactccaaatagagccccccacagcacaggaaccagaagacagacctaagcactgccgttggtccctgaactgtgccattgtgtaccttccgtgtctgacattttacatccctctctatgccaggcatcgagctacggcctttcatgtactgcctctcagttcttacaatcctgggagaccagaattattgatgctcttttaatcaatgtggagatttaggttaagaaacttgaagaaattcatgcagctattaaatggcagagctgtgattcccactggggtcctgtggaatcctagtatattgttctttccacaacatgcagccctttagcaaatgacgtttatacttttggacacgacataaagttttccaaaggggttagggttgttttgcttttgaaatagccacctgaaaagttcagcagcaccccaaatgtgtctgtattgcggtgagctctttctgaacttagctcccctccatggctcttggcacacaaacttgccactcttacccagtggtctcgttgctgtcctggagggagatcagggattggggttatactctcaaattccttgaggtcccatagcctctagcataactctttataaaaagtgggcctcatgttggttgattaattgtacatctctctcattcgtctttcgaagtcatgctgatgataacaaaaccagcataagagtgagttgcagcaaattcattgctcctactgacaaaaccacatgctacctcctgtcatctcagctttcttgactgcttggataagctagagaaatgcaccacagaagaggaaagttagacttttagcaagaaggactaaccgctggcaagattactttgctttaaaaaggaaagaaagaaaaaccacatccagaaaatataaagcgaattggccaaaaagtagatgatgttgtccaggctacaggaagtgttatttccttcctctcactgagcttccagggctctgtgaaggcacagagggaggtttccttgttttgcagtggaaatttggatatatcatctctctattttgctgactgtgatttggtcctcttcctcatccctcactgcctggaccaggtctctctgcttgtctcagaaggtatttactggttgcaaatagaaatctctgctatcaccctctgtgataggcaaccagaataaaccttcttggcattctttgctacagatgttatggggtaacaagattaaaaatattgtaatgtttttgtggaatgaaatttaagagatttaaactgtaattacttaaaattgacaagggaaaaaaatggagtcccccagagctggttactgtggagctaggatggagaaccaggccttttggtgtcacacaagctctctttataaagaagcaatggctcctctattctgggcattctggccgtgtaggcagggtgctttagcgctgcctgtctctgcccactgggcatgggatcccaggagaacaaagaagggtcactcagaccctgctatccaagtgtgtcttgtgggtgcaggtttcattgcatattccttacagcagtctattctatacctagccagtggctcaagaacacctgtctttctcattgctatattcatcagatgtttactcagtgcctgctgcatgccaggcactgcgaaggacagttccctgttttgatcattaaaaaaattaaatagaccggacacagtggctcacgcttgtaatcccagcactttgggaggctgaggtgagtggatcacttgaggtcaagagtttaagaccagcctggccaatatggtgaaatcctgtctctactaaaaatacaaaaattagctgggcttggtggtgcatgcctgtaatcccagctactcaggatgctgaggcaggagaattgcttgagcccgggggggcggaggttgcagtgaggtgaaatcatgccactgtacgccagtctgggtgacagagcgagactctgtctcaaagaatgaataaatgaatgaatgcatgaatgaataaataaagccagaagacttatctcctttttcacttagatggtgtgcctatgcgtgtgtgttttatactgatagaattccatggccaagctcacctgacctgaggggtggcgcattgagaaagtgtcctgtctactgtgccccagcagggccgtgggctagcttggtataaggtaaagcaatgagctggcaggtaggaggcctgtgtttgtatccccagcttaggtagtaagtagctgggtgatatgggacaaaccttttcagttccttaactatgttttctttctttaattaatttatttactttttattttatgttttaagaggcagtcttgctctatcacctagggtagaacacagtggcaccatcatgacttactgcaggctcaacttcctgagctcaagtgatcctcccgcctcagcttcctgagtagttgggactacaggcatacatcatcaccaggcctggctgatttaaaaaaaatttttttagagacaaggtcttactatgttgcccaggctggtcttgaactcctgtcctcaagcgatcctcctgccttggcctcccaaagtggtgggattacaggtgtgagccaccgcacctggcctcctttgttttaagtaaggttgttatattttagtgagctgtgagttctttccaatatctggctatctcaaatccacaaaattgagctcagataattaacctggaagactcatttgtctcaccaagaagtacaaaagaatagaatcatcttttaccatctttgcatcccttgactttctgcctttgaacttattttcaaaagccccagtgagttccatgtggagtgcggacatcttgagacctgaggctcaggaaggcggtgagtgtgctgtgcacagggagaggtgcagccactgtctgtaaggaaggattttagacccagccctttgtctgtcctgtgacgagtttgcacccagcagtttctgctcactggcttcccaagagacaatcagcttctattggaaggacagctcaccggggatgggaggacaggatatgcccgtggaaacctgacgagcttacctggcccacaggggatggagcctttgcccttggcctcatttactgtgttttatccagtaagataccagaccagcaacacttaaaggaaaaacaacaggatttagcacctgctccttctctggggtgccgcccacccccgcccagtccccacaaacacacacataatgcaggtgtatagaaacatagctcttttatgtgtgtacgtggggtaaaactaatttatcttgtgatcagaaagtagggagagattttataaaacactccataatttcagcatctgaatgatgcttttcttgttgggaaatcatgcgtccctctcagtaattgcttctgagtcttcagcatattcatgactttctcttttgtgtgccagagtctacaagcattaccattaaaagcccttttgtatttagttatttgtttacagatctgtttccttcctccttgaagacaatgtctggcacactggtgttcaataaatgttttcatgtataatgaatgaatgaccacattagtaatgtaaatcctcagcctaaatgtacatcctcagagagacaattttctttctttctttcttttttttttttttaaacggacagaatcttgctctgttgcccaggctggagtgcagtggcgcgatcatagctgactgcagcctccaacttctgggctcaagagatcctctgaccttggcttccctagtagctaggactatgaatgtgtgccacctcacctggctagttattttatttttagttttttgtggagacaggattttggctatgttccccaggctggtctcccacctcagcctcccaaagtgctggaattatggatgtgagccaccacgcccagagagaattttctaaccatgttttctaaagtagctccatcctcaggagttggcctttcccaggttagcctcttttattcctttataacttttagccctatatgaagttacttttcttgtttatatgcttgtgtgtttacatatatatttttttctttccattattaagtaagatttaggacacggagacattgaataccctgctttcctaacatctgtaactaattgctcactggagaaattaatctccaatctgcagttgaacttctggaaatagcaaaacttgttcagaatgaattttggagcatgcagtagtaattaagatgaataatgtctttgggaagacaaaataccacgtaaagtaatggagaaatagttctgtgctttttcacacatgactcaaacttgtttcagaggcatttccaaacaaaaatattcagtcatatttcagcaatgcaattccatgttactttgaggtggttactttatagagtaatattcatctgacggtgtcaatttttacattaaagaaaaagtgcagtaaaatttacaagcaacaaaaggcattcatcttaggtttacaattcaatgtgttttatcaaatgaatgcagcttgtatgcctaacattccgatcaagataaaacacatttcccttaccccagaaaattccgcggtatctttatccacacagttcccaccctcagtaaacagccaccgatctggtttagatcactgcgagttagttttacctgtgagtcaacttcatatcagtggaattagatgtgtctattgtgtttgggctctttcacttattgtaatggtttttgggttcatccatgatgttgcacatccgtagttcattcctgtgtattgccaggtataactatattacgtattatatatcatagttatagtatagtaagtaatatatacatataacactgtcagtactcccattgatgtacattttgatgtattccagcttttgactattaaaaataaagcattcacaaacattcttataaagcactggagtgaggatgtggccaggtcataggataagtgtacgtttaactttataagaaaccaccagcaatgagagagagttccagttgctccatctccttaccagtgattggcacagtcaatctttttaactttagccattgcagtgggtggatagtatttcactgtcttttttttttagagttataatttgcatagagtaaaattcaccgtttttagtgtacaattctgcaggttttgacaaatgcatacaatcttgaaacacaaccgtggtcaagctacagaaccattccgtcagcccccaagttctcctgtgtcccttttcagtcatccccatgccaccctgagcacttggcaactactcatgtgttttgtatccctataattttgcctttgcctagttctggcctaccagggtttatcagcggtatattttttaaaatgttatcagtcatatatgtttataaatttaaacatcaagaccatttctacaaggtttataacgaaaaacaggagacccttcttaactcctctcgaattctgaggagtttcaactttttcagaagtctttcaactctttcagccaatgttttatgccataaatctcttcatttctaaattcatttcttactatggaagataaggatttcactcttctgtacaccccaccaacgatgcagatacccattaatccctcatagaaaagcaaatatagatacaatttttttttttttttgagaccgagtctggctctgtctctcaggctggaatgcagcggcatgatctcagctcactgcaacccccacctccaggttcaagtgattctcctgcctccacctcctgagttttttttaaacacttaggatttgggttattatgcctatgtagtgtaagcagcagaggctgtgggatttaccttgattacatttcctttcttgaataatatgtttttctagagctaattcctttttttcttcattctctgtgaatttacctctatttcatactcaaggttgctgacaggagtattgactgccttttaatatgttgagacaaataagatcatttatcagtttcttttttttcttggattcattcctcatgggaccgtctgtcctcctcccttgtttgggacgttgtgctttcccagtgacagctctttttctgagggctctctttatcatctgtcttggggacagaaaaataggaactaactaggtaattcaacagagctaggggtagtatgcatttgtataaatacagattaatacctgttaattttgactgatccacatgtataaaaagtcatgaattcatgtggataccttcaatcccaatccggcagcacagggttcattcgagatttttcccttctggggcttataactccattctataatagtaagaaacctagcttcccatatttttaatagatttagctatttgatcagttccctggtatgtaactgatcactcatcctcattagcatgctgtctcccatgggaacacccccctcaccccgttttagctcagctatccgaggccagtgcaccacccccaagtcctatgtgcggataccccctcgccccacttaggctctgacaccccgtctgctcccttacacggatgcccacctcggtccccctgggctctgacatgccatgccagtctggacccctctgcggatgtgcagccttcccccactgcgaatgcccaggtcactctgctccaccccatggctcagtactcagctgcccaggagggacggcagaaggggcaggatccatctcctgattctgtcctgattcccattccccaaggttttcctttcttcaatcttcctataccaaagactactgtcctcctatttgcttaagcccaaaatacaaatacctttgagaatttgcctttactcccccattcatggccacccccagcaaaatcatgagcaactcctgttgattcatatatatcattcgtctgggtgcggtggctcatgcctataatcctagcactttgggaggtctaggcaggcgaaccgcttgagtccaggagtccgagaccagcctgacagcatggggagatgccatctctataaaaaatgcaaaaaatagccgggcatggtggcatgcacctgtattcccagctaccaggggtcggggttgggtgctgaggtgggatccatggagctggggtggcggaggttgcagtgagccatgattgtgccactgcactccagtctgggtgacagagtgagatcctgccacaagaaaaaaacaacaaaaaaaacctcatcaatgtatatatcctacatttttttcatctctcttcctcttcactgcacccaccactcccctttggtgttcctcttgctactacacctcacatcccacaatccattcccatatagcagcaaggatgctcttttaaaagcctaaggcagccaggcacagtggctcacgcctgtaatcccagcactttgggaggccgaggctggtggatcaattgaggtcaggagttcaagaccagtctggccaacgtggtgaaaccctgtctctacttaaaatacaaaaaataagctaggcatggtggcacacctctgtaatcccagctactgagaaggatgaaccatgagaatttcttgaacctgggaggaggaggttgcagtgaaccaacattgcaccactgcactccagcctgggtgacagagcaggactgtctcaaaaaacaaaaaacaacaacaacaaaaaaaacataaggcatgatgacatttgaaaccctccaacgcttcctgctgtacttagaataaaacttgaatttctccatggcatataatacctgtgtctgataattaatcttggctacacattagcatcaccatctccatggcatataatacctgtgtctggtaattaatcttggctacacattggcatcaccatctccatggcatataatacctgtgtctgataattaatcttggctacacattggcatcaccatctccatggcatataatacctgtgtctggtaattaatcttggctacacattagcatcaccaggggaccttttagaagcattaagtctgggcctcaccccagaccagttaaatcagaatatttggtggtgtggactaggcatcagtgtttgtaaaagttcctggtgggtctcacgggtgcccagggttgagaaccaggcctcctctaactaccttcgtattgcctctccccatttcagtctcttgcgctgaactctggcaatgacatttttcttctttctttgaacttcaggcttattcttgcctcacaacttcctcgcttgatttgtttctgtctggaagtttctttgcccagatctgttaatggctcattccttttagcttcttagagtaatctgtccttggtcaccgtatctaaaataatgtgccatgttaccaaccattctctgccatattacttttcttgagcacttcttcctcttagcactgtcattatctcaggtcattctacttgtgtatatttttaacattagagtgtaatcttcatgtgaactcttgctttccattatgtcatggttcttaattagtgtttaataaagatttgtagaatgactgcatgtagcgaggagaagaatcagggaagagatctgttggacagaaagtgtgcaggagccagagagacatttggataggtgaagtgaaatggagcagataagagtcctgactgatggagattacttgagaagccagatttaaagtaaataattttgacagtggaattagcaactctctgttattttcagttggagaggacagatttttattctggattagagcaatcccaagaaagcagaaaagacttgtgagcctagcgaaagagcaaccctcagcatagaatacgttggtgttcaccatggttgccatgaatttgctttttgcaactgtcatttcccctaaatgtaggcaagagtggccctctggactcattatcccctcacgattccctttattttaatggtgtaataacttaaagcatctgagatcctgcggaccacttcacaccacccaccgattgcagctactgatatgcccatcacttcctctttgcattatgccttcttttttttttttgagatggagtctcgctctttcacccaggccagagtgcagtggcactatctcggctcactgcaagctccgcctcctgggttcaccccattctcctgcctcagcctccctagtagctgggactacaggcacccgccaccacgcccggctaattttttgtatttttagtagagacggggtttcaccgtgatagccaggatggtctcgatctcctgacctcgtgatccgcccgcctcagcctcccaaagtgctgggattacagcattatgccttcttaagtctaatatcaagctatatttaattatgattgtcttactgtaaatacgcgggattaattggaaaactggattcttgcttgtatgacaacccaggtatgtaatgtggaaatgagcaaacatatttgtgaactattaccatattctgtgcagttattaaaattgaatttatggagttctgacagtatacgcttaaaactccagagatagatctgttctctcatacctgatgcaaggaaaatgaacattcacgtttacaaattcagcatgataattttgtgcctttaggtagggcttacacacacaccacaattctagagaagacataggaggttaaaaaaaaaagttttttcaacaatgacaggcttaggaagcataattccgtgatgaatggttgtgcaaaatactgtttacaaacgtacagataaattcttctttgaaagtggaatgaagtttgtattgtgacagcttggctttatagggcacagaacgatgaaaactgtttggaaaagatgaatatcttgtttctcagcctgcccgcctcccactctgcccttttcccagggtgaattcgaagccatttattcatgcaaaagcccattttcatgttttcacagaaccaagcaagtatatacagatgggtacagaccttgagacctggggagaaatgcttagcttagtatccttcttattcctgaatctcttacaccttggcatcctaaatcgggggaagtgtttcctgtttagatatctttttctcagccatgtgccttgatgcaagccacaattccacagcatagtaccccacgcctccctgtaaaatgtagcaaatcctttcaatgtctgaatgccacagtttaaaatatttatgaaatactacttttacaatatttgtgaaaatattattgaatatatgcccaaagaagataagttcagttttctacccataacatgcacgaagtagagtatgtgtctattttttggttgatttcatgtagaacaaattacaagagagttctaggatcctattggcagatgccagaagttttaattacagtttgcatctactcactgtgtatatatggctaccttatacgtgtatgccgttactttcagtggcaaaaactgcagtttcttttgcaccaacctgataccacaaggtttacctgggcaagatgaccacactgatgctttagttgatgggcatggggaatgagggaaattattacagtgaacttcctacagtaggtgttcagcaaatagttaatataaaaaatctgtttatggacagagtaaattgtctactctccacaagatagagggttggaaaacatctataggggtgtgtacctttattggaatttttttttttttggaaacggagtctcgctctgttgcctaggctggagtgcagtggtataatctcggctcactgcaacctccgcctcccaggtgcaagagattctcctgcctcagcctcctgagtagctgggattacaggggcacaccaccacacctggctaatctttatatttttagtagagacggggtttcactatgttggccaggctggtcttaaacttctgacgtcatgatccacctgcctcagcctcccaaagtgctgggattacaagcgtgagccaccgtgcccggctggaatttttaaaaagaagttaaagcctttacctaaagcctcagcaaacaaacgcataagatctttttatgggggtggcggggggatgttgcttttagcattaccaagaattgcacgtaattttgttttattatttcattatttggattatttttaaagtgcaaatatttgtcttcataagatctgctagttcaatttaaaatttttccagaatagtggttcttaacctgggaactcagaagagttacagcaaatataatttatttaaaaatatatattttaatagtataaggtgacatgtagaaagcatgtatacaatgaaagtccatatttattcatgcaaaaacatttattaaatgactgtaaggtattagggtgataagaaacgggctgtcttgttggttttttttgctattgttctattcttcctccaaaggagtagagatgaggctaggttctaagtgaattttaaatccaattgttattaagagaatacagctctaaaatacagttagatttttcttgtgtaataaactaaaacattcatcttctaacgtactgttaattgtctctgtcaactgttgtatcccagtattgctaatagaacatgagagtatatattgctaataactttatgatatcccagaaaacataaaatattttgtgttctcttttgctctgacaggttggtacagaggatataccctccaaaataaatctaaaaaggtatgacttatcattcactttttaatttcatttgaaatctgtctgctagttttgtattgtgctatgtgaccctctcctctgctctctgctgtctctagacctagtttgctttctctttgatggctcttctttggatttgaaagcaaattctctgacctcagtgcctaaatgtaatagtgtaaatcccattgactgtatttcctaccagccaattcaaggagaaaatcctggaagacttcttgcttcctgtccctcaagttaagcaagttggtaacacattcattgccctagtgggatctcttttgcagggaggggtggacccacccttctccctttgtcctttacttccaatgctacaattccaaactaaaggatctccccatttccacttgatcctttccttcattgtaaattggataaacaagagtggttttcatattatgagcctcacatcccaataatacattatgaaatcaatatggtggattataaccaattttttccaaaaaatgaaaccgaaaagtagagaacatgagatgcaatggtaagtactgtttcacgaaacttttattttaggtatatacttttatttattgtttttattatattttatgtatttgatatgtaatattggttgccataagaatgtatcttttactgtgcaacaaaggcacagtttgaaaaatactgacctaaatggttccttttgccagtgccaaaactactaatcgtcaggctaaagaaaatctattaattatgttaatacctccctcagtttcttttaggtcttgtcagcacttttcctttgatactgctcgctggggcagcatgacatgtcagcactttcttttgaaagagcagagttgatagggccttattatttcacaattagttcacatgccaaatagcaaattaggaaagggatgagagaaacgttttagaatttatcaaaagaggagtgaaaaaacaaaaccagacccacggttcttacacttcacggacagcatgagaaagacgtaatcctgcacagataggctgatgttacacacccaactctccaaagagtacggggcccaggaaaacacctttctacaaggtatagttcattagaaaccaggactgcttctgcattgttgatgcttaagtcacactcagtatttgcacatgtatgtgtacacatacacattttgttaactttgacagtttattcatctagcaaaataaaggaatgtttgcttttaatgcaattcccacagttttggtccttttttctcacctcaagccagagaatgaatttttctacccacagttattctagtgtcgcatgtctttatttcaaaccaaattattttcatttaatctcttgctgacttcagtttctctgggccgtcaaataggggtccaagacagcaggcatgccagagtaaatgagaacatgacagaactaaagtgaaagcttttcttctgggatcctcagtgacacagagtacttgattatggccactcttgcttttttagccctattggtgttaattttactcatagttatggaagtggtagttacttcaaagcaccattagagttaacaattttgatgttctgaatttgttaaacagtaagaatacttatgtcacttaattcccaatccttttttaagaaaaaaaaagttaatttaaaaacaataaacaaaaagccattctcaaacaaaattatgtgatgaacttaaggaacaaacgaaactcttggatttttcactgcgaaattcaattacgttcaaccaaggtcctagatcaggtcttctttttcatagactacagtatgtaaggatccttttgaacatggcagaccttgctttctaaagtatcctatgattttttaatatagtcatttcctcatttccacaggcaattggttccaggacccccacaataccgaaatccatggatgctcaagtctctgatataaaatggcatagtatttgcatataacctctgcatttcctcccgtgtactttaaatcatgtctagattatttataatacctaatacaatgtaaatgctatgtaagtagttattataccgtattgtttagggaataatgacaaggaaataaacctctgcttactttttttttctatatttttaatcatcagttggttgaacccatgatatggagggccttgtgtatataaaaatcagtctagctaatagtgccattgttgttggctttgaacagtagatagatagggttcccccaggatctaaatgataaattctggattttttttaaatttttttgtgttcattaaagagtgcttaaaacctttaagcttaaaatctcacccttcagaagaaatctttcggtaagagtttctctttgttctcttggtaagtaaagaaaaactttctaattcaatgaaatgatgacacagacaagggacatgcatttatttgatgattgttttaagccgaaatatccttcttgtggagagattcagggaaaatacaggcaaatcaaattcagttgccatgaattctgctctgcttttgacaccccgtcattaagagatcagctcattagaaacgctctcctgtgctgtgtccctcatttctccgtctttaaggggaagagctacttgaaaggcctgttgttttaatggaaattcttggtgtcatttataagctgacccagccatttagagtgatgataaaaggagctagttgatgataaaaggagctagtggttttacaaattgaagaagccaagcgcttttccgaaactgattattgatcctggtggaattgtgggagtgtggataagggcaacatctagaaaatcattagtttatttttctactcaagtgagtgggttacaatgaggaaggagaagcagaactgagagacaggctgtaaatcagaaacacatgacctaggtttactctgactttctgtgtgtcatcatggcataggagtcattctataagcatcagatttgccagagcaattctatgactgtaaatggccaagtgtcatcatggaaaggtgaagcctactgatgacaaatacacacatactatgtaacaaatacacacatactgtataacaaatacatgctatataactaatacatacatacatatatacatacatacatacatatttgagacaggatctcagtctgttgcccaggctggagtacagtggcgtgatcacagttcactgcagccttgaccttctgggctcaagcaatcctcctgcctcagcctcccgtgtagctgggaccattggcatgtgccaccatgctgtgctaattttttaaatttttgtagagacggtgtctcagtttgttgcccaggctggtcttgaacttctgggctcaagcgatcctcttgtcttggcttcctaaagtgctgggattacaagcatgatccactgtgccttgcctcaaatattctcctaatatgaaaatcatcatgtctgaacatccagtgtaaattgtctgcttatgatctgcttagatgtcacaagattcatcactctgcatttatgtttctgaatacttctatcttgaatgttttccacttattaggagcgactagtcaccagattgtgaatgcatgaaaattttaattggtcctttaccttctgatttcaaaaaccttcagcagggatgttcctttgtagtagcagtgttacattttacttttgacttccagaattggatccttgtaactaaacagtttatccgtgcccagcgcctccgcaaccccactcctgcttttttatgagttttggactttttttattgtggtaaaaatatatataacataaaatttaccatcttaaccatttgtaagtgtactttccagtggcactaagtacattctcattgttgtgcaaccatcaacaccatccatctccagaagtctttcatctttccaaactaaaattctgtcccctttagatactaacttcctattgttccctatcccccgcaagcccctcagaacccccattgtactttctgtctttatgaatttgactactccaggtgtaagtggagccgtacagtatttgtccttttgtgactggcttatttcacttagtgtaatgtcttcaaggttagttcccaacatcccagtttagttccccacagagatgatagtcagcaaatcatttgccgtggcgcagtggcacagtggcacagcggcacagcaggcagaagaaacacccagagttccttaggcctcctagggacaggcctagagcttccgaactgcagaaatcaggccccagaggaatcacacgcagtttttgaactgaacaccctcctttctcattgctatattcatcagatgtttactcagtgcctgctgcatgcctggcactgcaaaggacagttccctgttttgatcattaaaaaaattaaatagaccaggcacatggctcatacctgtaatcccagcactttgggaggctgaggtgagctgatcacttgaggttaagagttgaagaccagcctggcctggccaatatggtgaaatcctgtctctactaaaaatacaaaaattagccgggcatggtggtgcatacctgtaatcccagctacttgggatgctgaggcaggagaactgcttgagcccggagggcggaggttgcagtgagccgaaattgtgcgactgtactccagtctgggcaacagagcaagactctgtctcaaagaatgaataaatgaatgaacgcatgaatgaataaatagtcagaagacttatctccttctttttcacttcgatggtgtgcctatgcgtgtatgttttatactgatagaattccatggccaaactcacctgacctgaggggtggcgcattgagaaagtgtcctgtctactgtgccccacagtagacacacatttaatttttgttttcaattatttgatcagttttccaaaatggttctgaatcccacctccataatgaaagaggtcattgtcaccttgtgtctgtgtgtgttcttggtctcatcagtaacgggattagaattcacactcatattccccacgcctgcccccgtctcaaagcgaggaggagaagggatgtactttttatttggggctttgtgtctggtggggaagcacatgcaggatccactctgtcatcaccaatgctaggggcagtttaatctcaaatgttcttgctgtttcctgttttattggcaacggattaaaagagagaaagcagagtgttgtacagacaaatatagcacatgcaactggacacaagaacaaccctgtcaatgttcactggtttcctgtctgagtggagtaaggatcagtgggtatatatgcctccgggcactgggacatcccctcccacctttatgatcagccacccctgacatgtcatgttcatggagttcacaccaactcttccaggaatagggctgggagcagttagccaacagtgccaggtataagctccatgtaagataccatgaaacagatcagcatcactgtctccggatgacatctcctctgtgtgtgagcatatcacacagtaaacagcagaagctttggtacacataacactcacatctgggacttgcttcctgttggttagatctggtcctctgttctctgatttctatccaccagtttctcctctttctcttaggtctttccaggcctaagtcttccccatgggcagtgttacaatactgatgtagaactgcctcttagggatatagaatggagagcagtttgacactgtgaggtgctgaaaataaccaggtaactaacacccgttgattttgagtgcatttggtttaagtgggagtgctgagaggaactactttagaaaaatcactatgtagttgacccgtgaaaaatatgagtttgaactctgcagcacttccacatggattttttttttttagccaaatgcaaatcaaaattacaatattcttgggacatgaaacctgtgtaaaagtatatgcgggttgtgcagggctgcgtgccatacttgagtatgtgtggatttgggtatatgctttgtgggaaggaggtttctggaaccaaccccttgcatattctgagggatgacttattttatgggctactgagtactgcatagtttccatgtcaccccttatgtgaaacttatgggaagcatctcatggcaagtagcatctgaggggtttaggagttcacaattacactccttcccattatgttatctctgagctgacacagcatgtttgcctcttcattcacaaaatatcctatgctctctgaacccaaattttaatttctacctttttgatgtttccaccatgcttttgtggaggtagccagtcaacgtaagtggtgtcctgccaacctgatctcaggagtttagctattgcctgggtgttcccatttattctctttactttgggctgaggtgtttttgtttggtttttgttttgtttttatggccatataaccaaaattcttttctctgtagggcattttccctgaaacatatatccatttgaaagaggcaactgtggaagacctggggtaagttccaagctaggaagattccccaaaaatgatgaagatgtaacattatcattaatgataatctttaggcattaatgccttatgtacgttaatagttctctcatctcaggccaggcgtggtggctcacgcctgtaatcccagcactttgggagaccgaggtgggcagatcatttgaggtcaggagttcgaaaccagcctggccaacatggtaaaacccccatctctactaaaaatacaaaagttagctgggcttggtggtgggtgcctgtaatcccagctactggggaggctgaggcaggagaatcactcgagcccaggaggcagagctcgcagtgagctgagatcataccactacactctaacctgggtgacagagcaagactctctctcaaaaaaaaataaaattaaaaaatttctctcatctcatcagttctacttctcctatgagagagaaatgaagaaaaacttttcactcatacaattccttcctctgtcttctctttctataattgttcctcctttccattacttctccagaatactaaacacagaagtagcaaaaactgagggcttttgcctctacattacatttattatctgttcactgattgtgtgtgtgtgcgtgtgtgtatgtttgcacacatgaacatttgggactctgactgataagatctgagaagcccccaattcaggatccttgagagagagatgattaagcaacagcctgcatttaccagctctgagccttggatgaatcacttaaacttaagtggatcctgggtttttcacagcatattaggggaaacaatctgaccctactttgatcatgagcttgtcatgagattcgaatgaggtaatgtatgcaaatgtgccctgaagataagatctgctatattttgggtattcatatttcttgcccacctcatcttgcccacctcatttgtcctgggaagtactgcctctgtgacagctaagaagagtgagctacttagtctaagtgggagagagagaggtgacttaggtgatggtgagtctctggacaggagaattctggaggcagtacggagaggctggggtaggactggaatcctggggctgatggagaggagagtggggccgaggagagagtggacagctgggtcacagaaccatgcagcctcacagctagaaagagcattcccagttgtagttcagcaccatcatttcttttcttttgttttcttttctttttttaattatgatgggcaagctttattttgtatgaacttgatttcacaaaattagaatggcaattccacttaaaattaactgtttaaaaagtgtaaatgtcacggtatagatctgttatccaaaactccaaaaggcagtgaaattggtaacagatattcctcctcatctttggacccatacaacagcagaattgatgaaactggttcccaggcaagtatgtgccacttgctcccgtgcctcagggaggagaggatgttatgacacaggcgtttttgttgcagtgacttgtggataattgctccttattaacactgctaaaattatgttcacatgttttactttgtgtgggagccgatgactcttgtcctttcgttttttgagtattatctttcaaatgagcgttggcctcaaacccgctcattccaaaatgcatcacagatgggaatttaagcctcttcacaaagcaaaccactggaaattcataggtagtatgcaacattggtctgtaactgataatagggcaacatcatttctttggaacgtaattttcttgattccacaagaagtgacaggataagaaaactcatagttaaatgagaacagtcttgttacaggacagttatctcccaggtgtatgtcatcaattctaatttccgtgttgttaccaaagggccttattttcattctgactaacaaccaatcatcagaacacattgaaactgttgctgggtcaagttcaaaaggattccaaaacagtaaaaaaaaagaggaagggcccaccaagagcacagaggtcttcatcgctccagactcccagatacagcacagggaacaagaaatggcagaaccatcatttcatagacaagtggtcaagatgtcctcaaagccgtacagctctttggtggcagaaccaggaccaaaaaccaggtctcctgccctgctggagaagtcctctttccggtgggccgtgggctgcctccactgccacccaccatgttggaggaaacgtaggtggggaggcacattcacaccaattagggttatacaggatgcccagttacattggcaattcaaatagtaagtaatttttcatagtaagcatttcccagatatttcatgggtcacacttattctaaaaaatcttactataccagaaattcaaacttaactaggtctcctatatttttcctcattgagcctggcagtcctaccaccagttccaatttgtttgcttgctcttgctttctccttttttctttttgctaatcataaaaatgccagagaggatttctgtgaataaatgtagtacctacctttatgagagtcttctgtgagtaagcaaggattttgttaagtgtacgttttctgtgttgtgaaactgcagatgagaagaaaacatgggactattccagaaaggggtgctgcctccgtatcccccacctctaccctggcctctgccccaaccaggtcctgggtggagtcacagccccaggacactcgtgccacacacacctttccatccagcctcccaaatgaaacagctgcttggtggaaccagctaaaatgctgcatattttgcttccatctttgagaatcactgaagccagcctggctcagtaatcgagtctcctggagaaatctacactggggaggtcgaggctgggccgcaggctcattcagttgcaggaacggagcccattttgaggactgtgctgccttactctccttctcttctcccagatgcttggatgcgataaagtcccctgcacaactcctgcccccaggcctaaccagcttcattctcaaccttgaacgttgggaagtctgatccccatcaagtaaagcagtgctgatcagcctagaagaaagtgaccctcgtttggttctttgtaggcagcatgaaaccgtgattcctggcgagctccccctggtgcaggagctcacgtccactctgcgagaatgggctgtcatctggcgaaagctctacgtggtgagtttccccttgtggcttggagccccagggtcactctgggtcctcagcctgtaggtcctttgcagggtgttggccccttattgctgacttcatggagtgggatgcattctccctggatcacacaaaggctgataagcagcagattctcatttccccagagctgggtcactgatagcgggtagtggagtaactgggcgtaatcattctagcagtcttttctcaaatgataaacatgctgattgtgaaagtactaatgataataatcactgcaaacacttctgcagtctttcctaagtgccagaaactatgaatcctcacaacattcctataaagtaggtgcaattattattaatttgttaataaggaacctgagtcatgctcttagcctcttcatgtataccagtgaactgaaatttatcgatatttcagggctcagctgcatgaggatgacattctttaccttggcccacataccttacagactcagaaacttgaatagtgttaagttgtggtctgagagtcacctttttgggcagactcacagtattctttctcccaacactggtttgacctcataatgctaatacagtgtgtcagttcacagggaaattacaaggagccagcacatcctctccgtaataaacaataagctcaagttgtgtgcaggaatcagcaccaagtaaatctagcatttaacatgatgaaactgagaacagctgtcttgcaagagaccaaggatgctcaaagtctattggcagcaagtctgcctcatctccagtgtagaaagctctttccttaatgtttttttttttttttgagacggagtctcactctttcgcccaagctggactgcagtggcgctgtcccggctcactgcaagctccgcctcttgggttcatgccattctcctccttaatgttaacattggaatccacaaagactttttattttatttatttatttttttgagatggagtctcgctctgtcactcaggctggagtgcagtgacaccatctcagctcactgcaacctccgcctcccaagttcaagcaattctgcctcagcctcccaagtagctgggactataggcgtgtgccaccccgcctggctaatttttttttttttttgtatttttaatagagacaaggtttcaccatgttggccaggctggtcttgaactcctgacctcaagtgatctatgtgtcttggcctcccaaagtgttgagattacaggagtgagccaccatggccggctaattttgtgtgtgtgtttttagtagagatggggttttaccatgctgggcaggctggtcttgaactcctgacctcaagtgatccaactgtcttggcctcccaaagtgttgggattacgggcgtgagccactgtgccccgcccacaaagactgtttattctaaagttgcttctttgcctatagcccttgtagttcagcatcactgggtcttgcctctgttagtgggttccagccttctgtggctgaccagaaattcctatggcgaatgtatattctctcgttagatgtgtgtacaagttcagggaggttgtagaccagacttgatggcctgggaaccctcctcttttctttatgtggctttgtttgtctcaatttttgttcagtcatgtgttgattcattttaactctgaaaagccaatcttaataagttactgggaatacctcactctagaccctaaatactgaaggcagtaatcaaaagctaattttggcataacttataagagttcatggaagatatttcattttcattcagggctgttgtttcccttggttaatcacagcagtagaaatcaccaacccctttggtggaaaagcacatggtatttctctacttggtcatccttcaagaccttgtttagacgctttcttcttcatattgtattttctaaacatagcaatctataacgtttccctctggacaatagaagcacttactgctaaactcatcatctgacccttggggcacactgcttcataataaaggtgatcttttgatctctttatgtttagttgaagagagaatgcacattaagttgctaaatcacaaggaggatggagacactgctgtcagccccgtggccttcattgatcatcttgcacttatattgagagtactctctggttctggtttattgattagttagttgggtggatgtaacaaggttgatggatgaggaattgcgtgtacgtgggttggttccttaacatgttctttctggaaattgatgagtgttgaaatgcattagataatcagtattgggaaaggagtttttttttttttttttaaagatgtatgagactggagagtatgagtgaggccgactttttttcttgctaaaacacaactggtgtgcccagtttattacctatgtcttctacacatccacaagtaattgtgccaggtctaccattgaatagaatgaagaaagaagtgaatgggggccaggtgcagtggctcgtgcctgtaatcccagcactttgggaggctgaggacggcggatcacttgaggtcacgagttcaaaaccagcccgtcccaatatggtaaaaccccttctctactaaaaatacaaaaattagctgggtgtagtggcttgtgcctgtaatcccagctactcgggaggctgaggcaggagaatcgcaggagaatcgcttgaactggggaggcagaggttgcagtgagccaagatcacactgttgcacttcagcctgggggaaaagagtgaaactccgtctcaaaaaaaaaaaaaaagtgaacggggatgaagaattaggactcatgtattttggctgccaaaatctcttagtagttaaaggtgataaggtcttgttgaacatttccttggtgggagagtttcatgttgtagtagcagaatttggttaaaaaaaaaaaaaaggccaggcgcagtggttcacgcctgtaatcccagcactttgggaggctgaggtgggcggatcacaaggacaggagttcaagaccagcctggctaatatggtgaaaccctgtctctactaaaaatacaaaaattagctgcgcatggttgtggccacctgtagtcccagctactcgggaggctgaggcagaagaatcacttgaacccgagaggcggaggttgcagtgagccaagattgtgccattgcactccagactgggagacagagggagactccgtttaaaaaaaaaaagaaaaaaaaaaaaaaaaaagccatcccctcttcgagggcagcacatttctcattttaatttagatatctaataacataattattttggtatttgtgaataatttaaaatgtcttatagccgctgttgattgactaaaagacattctttgtagaaattctcagtcagtcgataggactgagaaacctgcttctgctcttgatacatgctcatccagtaaggaacaatccactaagatttgttattatggttagtgcaaaagtaattgtggctttcaccgttactttaaatggcaaaacccacaattatttttgtaccatcctagtattaattgtggctttctcttttttttttttcctgtcccttcctaaagcattgacagttaacttgaggcagaacttctgaacttcttactgaaacgtttctgtatcaaagtagcaaacatcaatattatgtttcactaggaaacaagtaaaaacccaaatctctggttttcgtgtcccatctcctttcacctgctgtatgctgttattgatgtttttgctttctgattctgtaagttccttcagtccatgtaaagataaatacagattttactagtatgtagcaatacttgtattatttctctcttgcatttccccctgtagattacaacaccagacgctctgtttgatgtctttaaagacacctgtggccagctagtggctcacgcctgtaatcccatccctttgggaggtcaagcctgggggattgtttgagtccagcagtttgagaccagcctgggtgacatagcaagaccctatctctacaaaaattagctgggcacagtggcacatacctgtaatctaggctactcagaaggctgaggtgggaggattgcttgagctcgggtggttgaagctgcagtgagccatgattataccactgcattccagcctgggtgacacagtaagaccctttctcaaaaaaaaaaaaaaaaaaaaaaaaaaaaaaagatacctgtgatgtcttagaaatcccacatttctatagtacatttccttgttcttttcttttcagtctcagttcaccagaaatgtacgttgtggatccacagtctcatatgaggggaaaatgcagtccactaaccagattaaccccagccatgtagacgctggtgattattctagaaaagaaaaatatttgcctagctgtgatttatttttagcagttatacggtaaccatgtagaataatcataaatatgtcttaaaggggaggggagtatgtacacagaacagaggtgaacccacttatccaaaatggagagaacagatgactccccccgtggtctctctgttccttaggtatattattattgttttctgttggattatcttccccagtgggtgttggccttatgctcaggagaggaagcgggttttaggagacagacactggcccaggaattgggaagctgagtatcctgtgcgggtcctgttctgaccagttctgtggccttgggcaagtcacttgaacacttcaagtctgctggatgttgttcctctgcaaaagttgatgtaaaagctgccgtgttgaccgcgtagaactctgagagtatggaaagagagagtggctgtgatctgtgctgctgacagaccacaaggactccgccaatgggagcatgtgcttttgatgttatcttagctggaagcagtagccatctggacaccctccctctgggaagccttggcatagcttctctcttacccgactgcctgcccaagactctgaagctcccttctgtatggccccttatccaaggtcgcttcctttggaacaattatcttaggcaaagtggccttgagcactcagcagccaagctaaatttctcaccatacatagagaacctgcttggtttaaattcaagtccaggaggcccgggtcattccaaaatacagagaaactgcaaatgtatggcagtttctgatggtctttccctatactgctgtgcctcagttggaactagtcactgggtgtgttttcattggttgttcaggaaaggagggaacattgtgatcaaggagacctcctggtgacgtaccaagaccttggacattggagtcagacagactgcctagttcttaagttctggcttctcccttactgggtatgtactattatattcagaaaaaaatgacaaacccagtaatagttactgaaaataaaccaaaacagaaagaacttggatgcagaaggctactagctgatcctgctgcctaagacaagtcccttgatctccttaagttttcttttcttctcttaagtggggattttatgtgctatatgccttgcaaatttattgtaaggattcagcgggatagtctgtataaaaccccagggtagtacctgtcacactgtggtcaatacatgacagcccctgactaacccctcacaactctgctcctagaaagagctgattgataatgagaagtgtaagagaagagctggatcacactagaagatttagtgacgtttgccttgaggtcatgtaagggtgcagttgcccacctactgtggttattccccatcttccagcttcgggcagaaggggtgggcagataatgtctagcctccctccagccccgtagtaacttaactaggtcgatgggtttcagattttctatccactattcttcccagccttggaaagcagctccagcgagctgatctttggcctcttttcctttctgtcaacacctcttcctgcttccacacggctgaggtggaatcagggcagatccccgtgctagatgggcggatgcccatgcagtgacttagacacggtcggattcgtgtaatgtctaacttttatcttgtcgataacaactcagttatactttttgaatataaacaattctacatctcaagtcaaaggatcatactttttcaactaaaaatctggtcttgaaactgaagaattgcagtgtattcgtggacacagtagggcaagagttttcaaatacaggactgtcctgtaaattctaaggtgtttggatgccataaacatgctgtgcaccatctcaccctaagatttagtttcgtgctattcctcatcttcccatgggagaaagggttcagtgaattgtggtcaatcgggctgttttgttcgtgtaactttggaagactggatctaatcctactccttatggaaaagagatagaagatcttttttggtgatagaaggtattgaaggcatagtgttgaatcaagtgaatttattattatttttttttttgagatgtagtttcattattctcgcccaggctggagtgcagtagtgagatcttggcgcactgcaacctctgcctccagggttcaagcgattctcatgcctcagtctccggagtagctgggattacaggtgcgcatcaccacgcctggctaatttttgtattttcagtagagaaggggtttcaccatgttggccaggctggtctcaaactcctgatctcaggtgatctgctcgccttggcctcccaaagtgctgggatacaggtgtgagccactatgcccagccaatcaagtgaatttaattgctaacatgtagtttgtacaaaggactgatctcccctcacttaaaatttgccagcaataaagaaccctgtggcagtctatagttctggaaaaatcaggagcagaaaaagtgcctataactgggaagagggggtaggggaacttgcagaacatactgaatggccctttcttcccatcatcgcatatccaggcagtttaaagctgctggattctaatctctttgaaccggtggttattactggctgctggaacgtaatctctgaagtacaattaagctggtctcatggtttgaaaccagcatcttattccttattaccaagaacagaaaattcccatagcaaactttgtcctcttgtcagggcattttatctgggagttgcaagccctgcttcagtgtggctctaacaagagagccaagatgtggcgtgggactgactgatgggcaccagacatgggtggtgctttgggtatttttccagttttgatttcctctgacctggttgcctggctgtcaggatttcttttccttcaggaggcaaaaaatggcctttaacttgaatggtttctttaaaaatcagacctttgctggtcagactgcacttttatctgacacagagaaaaggcactagaatggataggaagcgtgtttggggcagtgggaattctcttcttcccggggtccctggagtcagtgtagctcaagaacacagaaggacccaaacaccccatctggacccaggtgttacagctacgtggaaaaggcatgagattgattgcaatgagctcgacaccgggaaaatttgattcaacgccaactgagtgtgcaagcaagtgagatgatcagagtcagatgcagttaatcaggaagctgcctgggaggagtaattgagtttaatgtctcagtcatagactcaaagacgcttatccttgggaatggattttagttccagtctctttattttacatgtgagtttaccctagagggaatatgcccgaagccacatagcaagttaatgatagaattcgagatagaagccaagtacccatactttcagccaagcctgtttccccctaagtcataaaatctgcatggaagaggaaaggttggtgaacagagtgaatattgattcttttatacatggaatggtagaagaccagagaaagggtttttgactgtggtctgcattgtttttctcttttttgttttttttttgttttcagagatagggtctcgttctgccacccaggcaggagggcagtggtgcagtcacagttcactggtgcctcaaactcccaggctcaagcaatcctcccacctcagcctccttggtagctgggaccacaggcgtgcaccaccacatctggctaattttttattttttgtagagacagagtcttaccattttgtagagacagagtctttagcccatgcaggtctcaaactcctaggctcaagcagtcttcctaccccagcctcccaaagtgctaagattataggcatgaaccattctacccatccctgtggtctgcattctttgggaaaatgaagaatagagtccaggttttctaatacccattgcagctgggccatcatctaaatggcccctcaaatttctataatactcctgctttcctgtgagtattgaaggcaaagctattttttcttgtgactttgtgtttatctctagacattctaaaaaaagaaaaaaaagttataaacatcgggaggccgaggtgggaggatcacctaaggtcagaagttcgaggccagcctggccagtatggcaaaacactgtctctactaaaaataagaaaattatctcattgtgtggtgtgtgcctgtgatcccagctacttgggaggctgaggcaggagaattgtttgaacccaggaggtggaggttgctgtgagccaagattgcactactgcactccagcttgggtgacagagcgagactccattaaaaaaaaaagttataaatatttggactaaaactacaaaaagtgaggcttcaggtatctccgtatctccaagtagaagagggagaaattttaagcaaatgcaggaatatctttgctatcttgaaaaaaatttagattgttttattttgtggacacattcttcattcacattgaaagcagagtattacagagtgttattttaaatttaagctgtcaaagtttgtttttgagtccctattgtgttccaggattgtgctcttttgtggagagggtcacagaaattcttggatgatgtgacagtggcggataatgcagaaaaggctgaagtgagtgatgacgagagataaccgagaaggcttctacaacaggcgggcctgggcagtatgggattcaggaaagaaagagctggaaggagagcaactggagagagaaaatagagcctcagaggagcttagcatatgctcttttttttttttttttgagatggagtttctttcttgtcacccagactagagtgcaatggtgtgatctcggcttgcagcaacctctgcctcctgggttcaagcaattctcctgcctcagcctcttgagtagctgggattataggtacccgccaccacacccagctaatttttgtatttttagtagagacggggtttcaccgtgttggtcaggctggtctcgaactcctgacctcaggtgatccacctgcctcggcctcccaaagtgctgggattacaggcgtgagccactgcgcccggccagcccgtgctcttttggtgagtgtttggttttctcttcacctgtcctcatatgcttcccccaaaacccatgaagtgtcagggaccaactattatgtgaaacatcttgcttagaacgctcttaggaatgtagcaacaaagtccatctccttgaagtgaatggggaaattgtttcctttggtgtgttatagcttgtctattcagaattcacttggcacagtatatcagagaagaatgactgtcttcatccttccttgggggacaaagttggcagacaaggctggtatggacgggcaataattaaattgccacggatagtgtctaatgtaactgagactaagaacttgtgcacatgtaccccaaacaaagcactgtgtcacacagaggatccccggagcctttgaaccctttctttaccatattatgagaagcaatatcttaacattagaaaacactttgaatagctaaaagtggacaaatgcgttgcaagaaagaaaacaagagtctctttctgcttagcagttttgaaaagcaaaaactgacaggcttaatttctcacttctttttccaattttgaagaaaatgaaatggaaacattttatataagattgaaggaaaaaagcagggtttttacctttgcttattaaaaatagtatcttaaaagccctcatttttatgttttgctaaggactgggggatgaggaagaggcaattcagaaaatgctaaaagcagtaaatgtaggtagtttcaaaattttaaacaggctttgccttctgtgtttttttaagatcagtggtgttaacagagcatattgcaatcacagataaatgggttgttcatctctttcctttgtgttgccacagaactttgaacttgtgttagggtttcaacacactctgctaatctcagttttgttcattgccccctactttacaccaaggcctctttcctcctcatttattctttgttaaggagtattttggatgttttcagccctgtttctagtctacacctggtccaggaatctgtgtccttaggatcgtcatagaaggacatcactagagaatattgtgtgctgtcaacatctctctctgtgtgtgcattgttttttggggggttttttgtttgtttgtttgtttgtttattttacagaaacaaggtctcgctatgttgcccaggctggtctcaaactctgagactcaagtgatcctcttgcctcggcctcccaaagtgctgggattacagatgtgagccaccacgcccagccagtgtgagttgtttttacagcagataagaagaatgttttcttataatttcagaagtatatggttatataactatatcatgactttcaactataaagaagaaagaaatggggctgggcgtggtggctcacgcctataatcccagcactttgggagactgaggcaggcggatcatctgaggtcgggagtttgagaccagcctgaccaacatggagaaaccccatctctaccaaaaatacaaaattagctgggcgtggtggcgcatgcctgtaatcccagctacttgggaggctgaggcaggagaatcacttgaacgcgggatggggaggttgtcgtgagctgagatcacgccattgcactctagcctgggcaacaagagcaaaactccgtttccaaaaaaaagaaagaaggaaatagattcatagtatatgtggattcagtggaattctgtggggttttatttaactaacatttcaaaagtgatacacagaagacttttctctgaacgcagtacctaaagtaacatccttcccctatatacgcaagatcatattgtcctatttattcttcttatacttttcatcatcagaaattatctcatgtgtgtatatatattatgatataatatatggcgtatatatttactttcttattgctgtcttaccttctctggaatgttagatccttgagggcagaaactttattaccagcacatagtggatgctcattaacttaaaaaaaattaaaatgaagacatcaatcatttaggtcaggggtgtccaatcttttggcttccctaggccacattggaagaagaattgtccacatatgagatacactaacatgaatgatagctgatgagctaaaaaacaaaaattgcaaaaaaaatatgataatgttttaagaacgtttatgaagttgcattgggctgcattcaaagccatccagggccacaggttggacaagcttgatttagaagtttgtgatggcttaggtgtcaagtatttgattcttaaaatgattgaaaaacaaatgattagttagttgtaaggtaatttagtttggttacagtaagttactagtgaaaccaagattaacagtttaatatgtggatggtctaacaattggggaaatggggactttaaaataatatttaaaattatattttctagtatttcttatctctgaaattataattatttctccattcataattcactcatttagtacatttgctagagtgcctacttataccagctatattctagggacacacaaatgaacaaactctctgtcctataaaggcctaccagctaagcagggaggcagatgagccagtgtaacccagggttctccatgctatcatgggaacaaattctgggcactgtgggtgggaccgctaacatgaagttgaagtttcaaggtagagacatctaagttgagactgaagaaatcagaattaccagttggcagagggtgtagtgtgagtcagaaaaggataggggtggggtagatttggaggaagaggacaaaagaagaaataacatattgagaggatctggagccttggagagaaatggatgtgactttgcatggaagggaacatagattgttggggtggagactggtatgaaatgcagctgggaatgtgtggaagagtcaagatatggaaggatcaagatatgtgtctggaggacattgagactcactggagggctttaaacccaggaggggcatggctagagttttagggtacatggatgatttgatatgtttgtgagtatgacccactgtttaccctacaatcaccagtttccacagttgcaagaggggagggtgtagaaatggctcgggagaaagccattcctattaatatattttcttaaaatccctggatgcatgcagcttactctatgacacgattgattaaataacaccttataaagaatcaggctaggcgcagtggctcatgcctctaatcccagcactttgggaggccaaggcgggcagatcacttgaggtcaggagttcgagaccagcctggccaacgtgatgaaaccccatctctactaaaaatgcaaaaattagctgggtgtggtggcatgctcctgtagtcccagctattcaggaggctgaggcaggagaatcacttcaacctgggaggtggaggttacagttagccgagtttgtgccactgcactccagcctgggcaacagagcaagactccgtctcaaaaaaaaaaaaaaaatcaaccaggccaggcgtggtggctcaagcttataatcccagcactttgggaggccgaggcgggtagatccatggtgagaccctgtctctacttgaacccaggaggcagaggttgtagtgagccaagatagtgctactgcactccagcctgggtgacagagcaagactccatcacaaaaaaaaaaaaaaaaagaatcggccaaaagatgttccctctcatctgtctgacattcccgttaaaaacaaacaaataaaaaaaggatgttcccatcctctgtcacacctttttctaagaatcttttcttcatcatattttctcatcttagaacaacaagctcaccctcttccgccagctgcagcagatgacgtacagcctgatcgagtggcggtcccagatcctgtctgggacgctccccaaggatgaactggcagagctcaagaagaaagtcacagccaaaattgatcatgggaacaggtaggtaaaccagggatggcttttcactgaaaacttggcgaacagtgggcatgttcacgctaatgacactgtttgcagcgacctttgatcttagagttgccaaagaataatgcttactgctctcattttgtctttgaagacatttaattttgttgaaaaaaatgtcacagttccctccatggccaggctctgtgttggatctctgatcccatggaggtgacagatgatcaggaaagatgggtcttggactgaggctgctccactccaaataaagaaaacaaaaacaaaaaacctggctgggcacagtggctcacacttgtaatcccagtactttgtgaggatgaggctcgaggatcacttgagcccagtagtttggaaccagcccagacaacatagcgaggccccatctctacaataaatatttggaaattagctgggtgtggtggtgcacacctgtcatcccacctactcgggaggatcacttgaacctggaggttcaaggctgcagtgagccatgattgcatgcctgcactccagcctgggcaacagagtgagaccctgtctcacaaactaaactaaactaaaatccctgaaaatgaccaagcctctgaagttgacattttcagatacttgggactgtatctatttttattctaacagtggattccaaatcaataccagactcattctctttatttctcttcatctccccctaaccgggaccattgtctatggtgtgtgaaaagcagacttgcaggagtagtaaaacatgtttgtagcctgttgattatggctacaatcacctctacagagttaatcacttcattaatcttctgattaactcaggcacatatccaggctccagatatcactgcctttaggaaaatgagaaattcagtcctatatccaaattggtggtggcctggggtttttgcctcctgaccagcacttttttaaaaggcaaaagtggttcctcggttagctgttattggtgattcttttggaattagtttcattttctaaatttcttcaacttgtgcatatgtgatttttttcctcctcctctaccttgcttttctagtgtcggaattcttggatatccctcagagacctattaaaatatagatcattatgccacttatttaaatgtcatagactctgacaactatattctgaagtagccgaagtgaacatgccatgcaggattcagattcaagcagtatttaggaaacaccttctatgtacatttcatatacattacttgattataatcttaaaacatagggttgaggtagctgttattatttacatcttatggataaagaaacagaccaagtgagcttaagtgatttatttcccagtcacatagataataaatgggaaaggttaaatttgaacccaagacttttgactccatgtctaatgctgccttcttagggttaagaattaatagtgcccttccctattacttgaccacccagaagaccatacctacagtggctgcactgccaggcttgtggtgtcagaggacttattaaaaggccaattaggccaggtgaggttgctcatgcctttaatcccagcagtttgggaggctgaggtgggcagatcaccagaggtcaggagttcgagaccaacctggccaacatgatgaaaccccatctctactaaaaatataaaaattagctgggcatggtggcatatgcctgtaatcccagctacttgggaggctgaggcacaagaatcgctggaactcaggaggtggaggttgcggtgagccaagatcatgccactgcactccagcctgggtgatagagtgagaatccctctcaaattaattaattaattaataaaaggccaattgggtaggataaggaaactccattgcacataggacacctctgtcatttggtgtcttgccatgacattggcctggaggtcccgtgatctctggcacaggatgttcacaccccacaaacggcagaacatgacttctttcccgttccagctcttggaagtcgctcaggaaatggagctgctgtgtcagtgccttcctgatccagtctccgagcagccagcatggccattgttcatgagtctgggtggcctgtgggtctggccgccatggaaaggaacctgccagatcaaatcacttgatagagatgctgtaaaacagggaggagggagaggaggcatttttgctttcttcccaaagacttggcacattgcagtgttatccctgagcggtcttgctctttggtaccgggaatgcatgctgggtattcggatagcagtatcctatttccaccacagtcctcaacttcttgagcctaagcaaaattttttctacttctgtgtgcactttgggcacaaaagccttgaggggagggattgcacccacgatatggccgttagtattcccaagcatatgcagagctacaacttcacacacagccaggtgtttgcttctactagttgctgcgataagagctgtgttagtccattctcacactgctataaagaaatacctgagactgggtaatttataagaaaagtggtttaattgactcatggtctgttggctgtacaggcagcataccagcttctgcctctggggaggcctcaggaaacacaatcatggcagaaggggaagcaagcacgtcttacatggccagagcaggagtaagagagagagaggtgggaggggctacagacttttaaacaaccagatctcgtgagaactctatcacgagaacagcaccaaagggatggtgttaaaccatttatgaaggatccacccccatgatccaatcacctcccaccaggccccacttccaacattggggtgaatgtgagatttgggtgggaacatagatccaaaccatatcaagagctaacatttatgcttaagctgagagtttactgtatgctacatatagtattaggtactgtacatgcattatcttattaaattctcacaacagggccaggtgcaatggcttatgcctataatcccagcactttgggagaccgaagtgggaggctcacttgaagccaggagttcaagactagcctgggcaacatagcaagaccccatctctacaatttttttttttttaattagctgagcatggtaatataagcctgtagtcccagctacttggaaggctgagacagggactgcttgagcccaggagtttaaggctgtctctaaaaaaaataaaaataaataaattctcacaacaaccttgaagggtaaggaatgtatacaaatgaagaaaccaaagttgtgcagaattaagtaaattctccagggtcataatgttagcaagtattcaagccaagattcaaatcctggtctaaatgacaccagagcccatgctctgggcatgagatagcagcaagccaggacttacttcactcgtctcctttatgaccatcttaagttaaggaaatcaaggcaagccctcaaataattgttcattggtccttcatagcaatgtaataaacagtgagaccacgcccacttggtctgttcctttactcataaaatggaaataataacatttacctccaccctacctcatggcattataatcaatcaatgtttgtgaagtgtatataggaggtatgtgtgtatgtatttatttatttatttattgtttcagacagggtcttgctttctcatgcaggctagagtgcagtggtgcaatcctgactcattgcagcctcaacttcctgggctcaagccatcctcacacctcagccccccaagtagttgagactacaggcgtgtgctactacacctggctaatttttgtatttttagcagagacagggtttcaacatgttgcccaggctggtcttgacctcctggtctcaagtaatccgcccacctcagcctcccaaagtgctaggattacagacgtgaaccacgacgcctggcaaaggaggtgtttattaaacacaggttgaatcttaattttgtttgctctatttacttcatagttcctcttcataataacagaagattacaggcaagaagcattggccagaggaatttagtcagaatcagtgccaattttacttttctcttcagggtctatggaccatatttgcatatccttctacgactttggctaatatcatctcatgagttttctaacagtgttgaaaggtggcagaaactgaaatgagaaaagtcaatgaggtgtgcttccctgggcttgtccagcatctccctttctaactatggatcctctgggctccttgacaaggactcctcagtaaaaagtctgcccctggtgaggagaaccagctgactactcctttctctccagaatgctggggttagatctggtggtgcgagatgacaatgggaacatcctagaccctgacgaaaccagcaccattgccctcttcaaggcccatgaggtggcctccaaaaggattgaggaaaagatccaagaagagaaggtacagttcctcaaatgtgaaattctgcccactgaggttccatttttgccttggtttttaatgaaagaaagggaaatcattgagaacaaaactacttctgtagttttcgtcctcattttaaaagtgaaacatagcagaaaggatgaggcaggtatatatatatatatgttctgatatggaaagatcgcaaagatacgtattaagtgaaaagatcaggatccataatggtatatatgaaatgctattatttgtgtttcaaaaaatgtatataaatctatgcttgcatatacatagactaactctgaaataatagacaagaaataattattaatggatgcatctgggaaggaaaacggggtgggagggagacttcttaaatgtgtaatctcttgcattcattgcatatattgcaatttcaaaataaatagtatttatttttattttttatttatatgtttatttttgagacggagtcttgctctgttgcccaggctggagtgcagtggtgcagtctcagctcactgcaacctctgcttcccgggttcaagcaattctcctgcctcagcctcccgagtagctgggattacaggcacccaccaccacacccggctaatttttgtaatttttttttttttttagatggagtcttgctctgttgccctggagtggccagatctcagctcactgcaacctctgcctcctgggttcaagctgttctcctgcctcagccttccgagtagctgggattacaggcgcccaccaccacgcctggctaatttttgtatttttagtagagactttcaccatgttggccaggctagtcttgaactcctgacctcctgtgatccacctgccttggcctcccaaagtgctgggattacaggcgtgagccaccaagcctggccaatttttgtatttttagtagagatggagtttcaccatattggtcaggccggtctcaaactcctgacctcaggtgatccaccctcctcggcctcctgaagtgctgggattataggcatgatccactgcacccaggctaaaataaataatatttaaaaataaagtgtttgaaagacttcaaaggtaataattggacattaaagaaaaattagaatccatgcatggtgcctcatgcctataatcctagccctttgggaggctgaggtgggcggatcatttgaggccaggagttcaagaccaactgggcaaatagtgacatagtgagaccccatttctacaaaaaattttttaaaaaattagctggacgtggtagtgcatgactgtagtcccagctacccaggaggctgaggcaggaggatcacttgagactgggaatttaaggctgtagtgaactatgatcataccactgcactccagcctgggcaacaaagcaagaccctgcctcttaaaaaaaaaaaaaaaaaaaacttactcatattttgatttctcagacccaaacatattgacattttaatatgttttttttccagtctttctgttctaatgagtaaagatttgtgtcaattttctttggtttgttggtttgtagtgtttacttctttagcatggtcatgataatatttgtgttctgaatccaatggcaaaccacacctgaaggtaaagcctttctagtggaatattttgtttttaatgagagttatttctttatccaggataatggatcatgatgtttgtgcttttgagcttcattcagaagctattgtgtaagacaagcacctcttggagctaccaaaaccctggaattatcacctttagacagcatttgtttgaatgtctgggattcaaggccctgaacaggacagtcttgatcactgaaaatataatgattatattttgctcactgcatttgtccacttacatacactttttcttagcaaatgcacttcctctcgggtgttatctgtgttttgttttttgttatttattgattaatcaactgattgattgagacagggtctcactttgttgcccaggctggagttcagtgactccatcataactcactcactgcagcctcctctgttcccaggtagctgggactacaggcacagctaattaaaaaaaaatttttttgtagagacagaggcttgctgtgttgcccaggctgttctcaaattcctgggcctctagtagcactgggattacaggaatgagccactgtgcccaggctttgtctgccatttgcaggcttatttatttatttatttatttttgccaacatttcccatttgccaaaatcaagatgtttttctctgttccctctttgttcagtcaatcctgcagaacctcgatttgcggggccagtccatcttcagtaccatccacacctatggcctctatgtgaacttcaagaactttgtctgcaacatcggggaagatgcagagttgtttatggccctctacgacccagaccagtccacttttatcaggtagcagagacccacatcccctgctgctgacctaacaaagatacccagccttcccctgacccctacccgggcagctctttgccagatttgagaagagaaaatagggaagcatggaagatttctaagcagtagaatgtaaaatcatatggtctatgaagccttcatatgtcactactagaacaatgaggccagtttgtatactctctgggatttagagatcacataaaactcattagggcttggagatgggaacaaagaattcaaaacagtgtgtgggagggtgagaaagggatgaataggcagagcacagaggatttttagagcaacggcagtattctgtatgatgctatagtggtggatgcatgtcattatgaatttgtctaaatgcacaggacgttcgatgccaggagggaacccttatgtaaactgtgggctttgggtacatgatgtgtcaatgtagcttcatcagttttaactaatgttactactatggtcgggggaatgttggtagcaaaggaggttgtgtctgaggggagagaatatgttatgggactctattttcagctcaactttgctgcaaagccaaaactgctctaagaaaataatgtctattaaaaaacattttttttaagactctaaggagtgtgatgggcattgttcagccctacagtggtactactgtttagcagctaagaaaatggagaatttatttttgagaagatagttaaaagtaattgctgacaatttgtttctttaaaaaaaattttttaatgtcaatgtggattacaggggatagatttggaatgactgttataaaattaaattctttttttatcttttatttattgtttattttttgagacagagtttagctcttgtcgtacaggcccgcatcctgggtccaagcgattctcctgcctcagcctcccaagtagctgggattacaggcacctgccaccatgcccaaccaatttttgtatttttagtagagatggagttttaccatgttggccagcctggtcttgaactcctgacctcaggcgatccgcccgccttgacctcccaaagtgctgggattacaggcgtgagccactgcgccctgcctaaaattaaattattaatttagcaaagctgaaacttttattcaaagattttgagatggaaggacaacccagaccgtagcatcccataagctctaccatgtctgtgcccaccaggagcagtgggtttcctgcatctgtgtggggcatgtcttgcggagccacagcagggacgcttctctaatgccaggacacccagcagtggccatctgtgtggtcccagttcccaactcagctgttttcacaccggcctgttgaatttcactgagcatttctggcctttcctccttcccttgtaagtctatactgagggtagcctcatctccaaccccagttagcctctcattaagagcaatttttttttcctttgccagtgagaactatctaattcgttggggcagtaacgggatgcccaaggaaatagagaagctcaataacctccaagcagtgtttacagtaagtcctcccttctgtttaatcattctctttgtttgtgatatgagcatattcacataatgaatatgtggaaaacatacaaaatgaaaagatgaaaggaaaaatcatcaatctgcctagcaggaataacccacccatttattcaacatgtacttcaatgccaggcactgatttagacacttgagatacatccgtgaaaaatcggggaaaaaaaagcagcttttgtcctgattggtaagacacataataaacaataatcaatccaggcacaggggctcacgcctgtaatcccaggactttgggaggccaaggtgggaggatcacttgagctcaggagttcgagaccagtctgtgcaacatggtaaaaccctgtctctactaaagaatttaaaaaaggaaaaatgaccttaaagtacaagaggagtgatgctggcaattcggatatgccaaagagaagcgtgctccctttaagtgaaaaggtaaaactttataaatacttatgtataggaaaaaacagcacatatagagttcggtactgtctttggtttcaggtatccaccaggggtctcagagcatattcatcacagacaagggggggctactctatcaatgtgccacaatatatgtaactagtcacctggagtctttatttttccattaacagaagccttgcagacctagagtagaaatgcagggtggacgttatcattgatgtatatcttggagacctgagttaactaaattacaggggctggatttggaatgattatgttaaaagtgattcttgcttcagtaaagagagcttgggcagctgtttcatataaccaatttgagatgtgattagttttttttctgaagtcgaactgaatgagagatatcagctcattcctgggtttactcacccatccttaagaaaacaaataatggctgggcgcggtggctcatgtctgtaatcccagcactttgggaggccaaggaggctggatcccttgagcctagacgttcaaggccaaggccagcctggataacatagggagaccttgtcaaaaaaaaaaaaaatacaaacaagtgtagaaccctagctgcaagagaaataggtatttcattgacacatctgtcatgattcagtatacactgataagctctcaatagagacctctcataaatcaggtgaatagtcccataaagcagtgcctgtctcatagttgcctcatgggcttgttttgaagaggaaatgaaatgtcacagacttgtgtggatacccaataaatgtcagtgttacacaagtttttacttcatttgatgttgaaatgcatcctgtgctgagatacgtccaaagatatacaatcgcaatgatgagggccctgatttttcaataccctgcttaagctgatgaactggagacttccaacgggctgtgatctgatttgtaaatttgaagtaggaactggggaacaaaaaagcacttgtttacaagcacaaagtcatgttttctgatgccataatagctcttggatggagatgggggagaagagagtcgttctaatacttcagcattgagaaataaggtcggaacaggattttgttgtagagggtaaagaaaaaagagacacaggtgacacagtggtccagccccacctcctctcacactttctctgcccctttaggaccttagcagcatggacctcatccggccccgcgtcagccttgtgtgccagattgtccgcgtgggccatatggagctgaaggaaggcaagaagcacacctgtggactccgaagaccttttggagtggcaggtacaagagagacccagagacaaatgtgaaatagtgcagtgctgtggaaaatagcatggcgatttctcaaaaaattaaacatggaactagcaaatgatccagctgccctgcttcaaaacaatcaaaagcaaggtctggaggagatatttgtgcatccatgtttgtagcagtattattcacaataggcaaaagatggaagtaacctaggtgcccatcagtgcataaatggactaagaaactgtggtgtgtacgcacaatggaataatactcgccttaaacaggacgggaattttgactcatgctacacactgcgtggatgaaccttgaggactttacactaagtaaataagtgagacacaaaaggacaaatattgtatgatcccacctatatgaggcacctagagtagtcaaattctcagagacagtatagagtggtgagtgtcaggggctggagagggggaatggggagttagtgtttaatgggtacggagtttccatttgggaagatgagaaagttctagagatggaaggtgatgatggttgcacaacaatgtgaatacacgtaatgccactgaacggaatactttaaaatgggcaagatggtacattttatgttatgtgtgttttaccacaattttgaaaatagaggaagagaaggaggaaaggaggaagaaaggtggaagaaggcacagagatagtaagagatggatcacgttgtcattgtcagtatcagacacgcagcatttactgcctggcactgcccgttttctttgcatgggttctgtgtcctcacctggcccacgctcctttctttcccccttagtgcccaacactgtgtcttatacacaatagaacctaagttgtgactattggaatcctccctgtctgggtctgcgtattgattttagtggaataaaatactcgctgggaagtggtttgccggtctaggaaatttactcttcgaagacaatgttgtgtttgtttctaaatgctttcagagatcctccttggcttacatcaaaccccagaacctgcttaaacgcccagcatcttcctctgtagtttgttcaattgaggaaatacattttgggccttacattgacattttggttgctcatagattgaaagcgatcaaggaaatgttataattctgctcctggacctttggttccatacttactaaaaagtaacctgatgttaaatttctcaagaatttagcaactcgggcggggcacgatggctcatccctgtaatcccagcactttgggaggccgaggcaggcagatcatctgaggtcaggagttcaagaccagcctggccaacatggtgaaactctgtctatactaaaaaaatacaaaagttagccaagcgtggtggcatgtgctgtagtagtcccagctacttgggaggctgaggcaggagaattgcttgaacaggggaggtggaggttgcaatgagccaagattgtgccactgcactccaacctgggcaaaggagcaagactgtcttttaataaaaagcaaaagaatttagcaactcgatcttgtagagtttttaaagtgggtagtctgcaaaattgatccagtaaaacccagaccccttccttagcacctcatgagtcacttttttgctgggctaggtacactgggaatcaccattggcaaagaaattttaaaaaagtccctgcttagtacctttcttcctgcagtgtttgatgtttgctgatactgtccttttccatagtaacttactgaggcatgaagcaattagtttctttaatgaagtttatctttttcctagtgatggatattactgatatcatacatgggaaggtggatgatgaagaaaagcagcattttattccctttcagcagtaagtactttggcatgtgtcccaggtgacttgagacctggattagccattcaattgtcttttaacacagaaacaggtgttagaaaccattttctcagagaaggaaagattctaagctgcaagattgtcagataggagctgaacagaagactttattcaaagtccttgatgttggactcccattgaagagggtaaactgaactttcctgattctatagaaagcatcaaaggaatataaaagggcacatatctgtctgctctggaatgcagagagggtgccgtccttgtgtcagcaatgccaaaatatatgtgcagtctattgcatgaaacaggcatcatggatgacacggaatcacgtgggctagcatagggcttctcagactgcatcatgcatatgaatcaggggaacttgttaggctgcaggggagttctgcctctgacaagctcccaggtgatgctgatgtagctggtctgagggccacactgtctgtagcgagggtttaggagatgagagagtgaagggctgacccacccatgggccagtgttcctgcatgttgggggaaagccagcctgggagcatgtgaaaggatccttgcagagctttactgaggccctccatattgagctgcaggagctggagccatgggtaggccattgaggagctgttgggagcagattcaagccgtgtcactctgaagaagtgcaggtgtgaacgtcatgacctgctccagcacctgcacaggcagtggaggcctagtggaggccaagagcattgccgggaccaagtcccaccaggggccatcgtgccagtcagagggcatcatctcagctcacttgcagctgccactgcagacaagtagaacaaactgagaattccacaaaccagccagagtcatatatttgagttaatatatcactttttacaaatgatatcacaaattagtggagaaagatacattatgcaaaaaaaaaaaaaaaaggtttttggagaaagttagctagccatttaagatcccgaagttagattccagtctcacaacttatgccagtgtaaattttagatgattaaacatacaactgtaagagctagaatcttaaaatattaacgggaaaatagaagttttatgtggtagtcatgggagggaggccgttttaaagattcagccaaaaaaagaaaaattgataggtttaaccacccaaaaactgtaaagaacttaatacatagaaaaaaatcgatacagtctttgcactgtgtttgagaaaggatgaatatttgtaatatataaagaattaatagaaattaataaggacatgaagggaatacacacacatacagaaatggtgttgtacatttattgaggatgagtgaaatgcaaatcgaaacatcaaggtttattttttatcttgaccacactttagtgtttgggtagatataaggagacatacattacttatagagaatatgaattgttacaatgcattagaagtcttaaaatttagatatttcaaaaaatgtactccatgattaacagtgattatttctgttgatgtaactcttggtgattttgctcctgtttttgttttcctgttgtctgttttttatacaaaaaatatgtattatatgtaatatataaaatataacaattttaatctttcaatgttaagtccacaccttcggaccagtttctaaacataatagtgcaaatagcccatgctaagtagtacttgtctcttttatccagaggctgctatgaattatttttttaaaatatggccattgcactccatcctgggtgacagagccatacgctgtctcagataaaataaaatataaggtaaaaatagataaaataaaatagttaaaaaataaaatgcacttaccttgtatgctaccacctatatattgaccttccaagacgagacaaatattttatgtagcacagtgctaaagttaattatgtgataactttcatctccatgaatgctgctcttgttttgtgcataatataaaacactgcatgcacatacctatataaatatgtattgtataatatataaatatgtttaagtatatttaataaacatgttgaatttaggtccgggcgcataggcttacgcctgtaatcccagcactttgggaggccaaggcgggcagatcacaaggtcaggagatcgagaccacggtgaaaccctgtctctactaaaaatacaaaaaattatctgggcacagtggcgggcgcctgtagtcccagctactcgggaggctgaggcaggagaatggcatgaacctggaaggtggagcttgcagtgagccaagatcacgccactgcactccagcctcggcgacagagcgagactccgtctgaaaaaaaaataaataaataaaataaaataaataaataaatatgttgaatgtaatacaatgttaatttgttaattacatttataaatatgctaaataaaatacaatcatgcatcacttaatggcagtgatacgttctgagaaacatgtcactaggctctcttgtcattgtgtagacaacatagagtgtacttacacaaacccggaatatatagactactacacacctacgctgtatggtatagcctattgctcctagactgtaaacctgtccagcaagctactgtactgaatactgcaggcagttgtaacacagtgctatttgtgtctttaaacatatttaaacatagaaaaggtaatgagttgggctgagatgttaaaacagctataatatcactaggcaatagaaatgtttcagctccattaataatcttttttttttttttgagacggagatttgctcttgttgcccaggctggaatgcagtggcgtgatctccgctcactgcaacctcacctcctgggttcaagcaattctcctgcctcagcctcctgagtagctgagattacaggtgcatgccattacacccagctaatttttctatttttagtagagacggggtttcaccatgttggtcaggcttgtgtcaaactcctgacctcaggtgatccacctgcctcggcctcccaaagtgctgggattacaggtgtgagccatcatgcctggccagctccgttataatcttatgggaccatggtcatctaggcagtctgtcattgacagaaacattgttaggaatatgactgtatattgaataaatataaatgtaccatatatattatagtactatgaatgtgttatatttgtatttaagattatatgtacataataggagtgaccttcatggatatgaaaggtgtctgaaacagccatctgtatatttgctggtggtgatgtgcctcctgcttaatttctgaaccagctttcctccagcaaccatatcacagtacttagtcctgagattgtccccactgtataatccgtgccttgagtccctgacgaaccctgccttaatttcattactgctcactgtgcagccaacagccgcagtggagtattcatgatgcagactgcagcctctggcattgaatgcctaagatttatggcaagcgctactataatctacttcaaaaactttacagtgttttccagtaggagagtgttgtatgtatattctgcaagtccatttagagagaatcatttgtaaaaaacaggaactcaagactatagcaatcccatttgccagtcacatattgcagtgtgttttattgtcagggtacagggaaccctgcagagaaaactggcctacatgcagtggacagaggagacaggagactattgtactgcaccaggccgatgtgcagttgcttatagtgcttctgccttcagtagaatggaggctgtatttggttctttgatcgccctttacaagccgcagcctgataaggtcactcaagtggagcttgtttggcagcacctatgccaagatctagcttgtcatcacatggaaatctgagaacatctaccagacaccaggcatatacactgtgcttatatatagggggttgacactagacaggagccttaacaggcatgcgatcccagcccatctcttacagatggagaaactgaggcccaaagggagcctcttgcagagctcactatcaagcagaagtagacctgggggctcctgccccttccgtgggtgctctgtcttcaattctattgcagcagcctcttctgcctctgaaagagcatggagtgttgcctctgattttagttgctaaccgttggtcaccagttttgtgtactcttgggtttttttcctccctctttgcctcaagtcatttccaaggtgaatttagtatttaagatgacacaaaatggaaaaataaaggaaagatagaaagataggggtacttagtgttgatatctccaaattattcctatatgactcaccattatctgaggttgtgctgcagagacttcctttctccccctcccaccttacctcttatttctctttcccaagaattgcgatggaaacctacatccgccagaggcagctcatcatgtcgcctttgataacatcacacgtgattggggagaatgagccactcacttcagtcttgaataaagtgattgcagcaaaggaagtgaatcacaaagggcaaggtacagtccagtgccagagctgggagggactctgctgagggtgggggacattcacagctgggtccttggactcctgccctttattatctttctctgatacaaaacagcctctgctggggaccatccccctcagcttccaaccacaggcttttaatactgaactgcattgagatgcacccagcggtgatttgatcacagttgtgttttgtaaattctttggaacaaatttttatcccatgagtctttactctttattcatttatttatttatttatttttgagactgtctcatgttgtcacccaggctggagtgcaattgcatggtcttggctcactgtagcctccacttcctgggctcaagcatcctcctacctcagccttccaagtagctgggactacagacatgtaccaccatgctcagctaacttttaaattttttgtagagatggagtctcactatattgcccaggctggtctcaacttctggccttaagtgatcctcccaccttggcctcccaaatccctggaactttaggtatgagccaccgcccctggcctccatgtttttgcctacccttcattcccaatgtcgaccctagataataattatgctctattctgaataagtttatcccatcacattttttaaaattgagaggaaggaaaccaaagtaatacagatgaatatgtattaatacaaaataatgtaaaaattgtagtttttagtatctccatatcatgttctgttgatagagtgtgttggtgcacacctgtaatcccagctactgggaaggctaaggcatgagaattgcttgaactcgggaggcaaaagtttcagtgagccgaggtgatgccactgcattccagtctgggcaacaaagtgagactctgtctaaaataaaaaaaaaagaaagaaagacagaaaaatggtttgttctcagaggtttaatagctatacacttcttttttcttttaacattctgccttctttttctatgtaattcattattgggaatttaatgaaaatacaagatgggaaattaaattttcttaagtagcaagaaaataatcccagcatattcatgtaattattggatttttttcatgatttgttatgcctcttttgccatatattaaattgctatatactatagtgtttcattgtttcatgtatatatcttttttacccctaggatcacagatggttgtagctttactatatattctggtatctggtagggtctatctttaccccttttttcccccaaagttagcatctgttcacatctctgtcaaattctcaaagaggtcctgttgtgattttaatggaagtgtcattaaaattataagtcaactgggggagaatttacatctttacagtaaggttgtgactatacaactcaaatgttcttctcaccagttacgcatgtgttttatacatcatacaaagaactaaacgtttatcttttatttcttttaaggcctttgggtatccttgaagctcttgcccggtgacctcacccaggttcagaagaatttttcacacttggttgatagatcaacagcaatagcccggaagatgggctttcctgaaatcatactgccaggtaagcactttgcatggctcacctgtttgcttcctcctgttcagcgattatttcttattggacggtggaggcaacttggatccagaagacttggttatttacattcattggtcctgagacacctgggacacaaacagagacacctgcaatacttaaacacttaggtgcttcctaatttgtcattattacaaatataaaaacctctgctctgactatccttaccatgaagtcttttccacgtttaagactatctccccgagaaaattcctggaagttggatatacagtgtgcaagtacagtacactgatatacggtgtgcaagcccaagataatgcttttaaacataactcaaattttcttactctctcttttacgcagactctctcaaatagcacagggtgctctgttcaggagactaattggcctcatttgtgtgtccctttcttgttatgacatccccagcatgtgggcgccttgctctctccattctctgaagctccaaaagcgctctggctctccctgttcttgttgtgacaagaatgtcagcattttcctgtttcatcttctttctagtgatctgcatatgtgtgtgttctctggaatttgctgacttcgcccatttaattttaatctccatactaagaaaagggaattggtcccttgaattttatacatattgctataaactaattgatattaatagaaattctagaaaaacaaccatggcttggccgagcagggtggctcacgcctgtaaaatcagcactttgggaggctgaggtgggcggatcatgaggtcaagagatcgagaccatcctggcaaagatggtgaaaccccatctctactaaaaatacaaaaaattagctgggtgtggtggcacgtgcctgtagtcccagctactcgggaggctgaggcaggagaatcgctgaaaaccggaaggtggaggttgcagtgggccgagatcgcaccactgcactccagcctgggcaacaagagcaaaactctgtctcaaaaaaaaaaaaaagaaaaaagaaaaacaaccataccatgttagaaaaattctagaaaaccaacttacctattgcacaaaaattcaggttattttaggccaggcatggtggctcacgtctgtaatcccagaactttaggaggctgaggcaggcagatcacatgaggtcaggacttcgagtccagcctgaccaacgtggtgaaaccctgtctctatcaaaaatacaaaaattagctgggcgtggtggctggtgcctgtagtcccagctactcaggaggctgaggcaggagaatcgcttgagcctgagaggcagaggtttcagtgagctatgatcgcaccactgcaacccagcctgggcaacagagcaagactctgcctccaaaaaaaaaaaaaaattaggttattttaaagtaatacaaaatcttatttctcctttgagaaattaaggggcagtgataacttgttgctgcccacattgtctacatgtagtgggtcttaaatgagtatttgtggaaggaatgaataaaaatgttataaaatggagatcactcttttttccttttctcataaaagaagatagttttttgcttattttgtccattacatagctattttaccctgatatacattcatcaacattctgggaaaatgttttgtcttcttgttaaggaaaaaaaaaattagtagtaatattctctacctgaaggttgttttactactacaacaagacacaaatctgaaaaaataaagtagagaagtttattctttgatcaaggtgacagcagggttggcttctcctgaggcctttgaataaggtgagtttaccttttaaatctggcttgtaaaagaacatttagttttgttttgttttttaagtcaataggattggttcataggatgccaagggctacattggttttaaaattcatctagaatacggccaggccagatggctcacatcggtaatcccagcactttgggaagctgaggtgggtggatcacttgaggtcaggagttcaagaccagcctggccaacatggtgaaaccccatctctattcaaaatacaaaaatcagctgggcgagttgacgtgtacctgtagtcccagttactcaggaggctgaggcaggagaattgcttgaacccgggaggcggtggttgcagtgagctgagattgcaccaccgcgctccagcatggcgacagaacaagactccgtctcaaaaaaaaaaaaaaaaaaattagctgggagtggtggcgcatgcctgtaatcccagctacttgaaaggctgaagcgggagcatcacttgaacctggaaggcagagtttgtagtgaggtgagatcatgccgctgcactccagcctgggcaacagagtaagactccatctcaaaaaagagaaaaaaattcatctagaacaatcgtttccagtgctagtatgtggatcagctaatcaagatctccttgaagatctccttgaaaatacagattcccagatttctagagaccgattcagagctcccaaggtgatctggtggtgagtcaggtctgagaaattcaggtctagacccaactccctgggctcagaactccttcctgttgtcccatcaccacgtgaactcgttccagttgcctcctaaactcttccctgtacccccttgccctctagcaaggagctttgactctcgtcttcagcatcgcaggagtgattctgtccacgctctttctctgttctcacctctgccagccccactccagcctctcaagagtagctctcatgagagtcacccatgatcatggtatcgctacatctgatgggagttttctagcctagcgatcaactctgacctctcagcagcatctgacattgttgaaatatttccttcccttctcattggtgacccctcacttttctctgcttctccatttccctggggcttctgctagaacccctttgccaccttctcatattctgcttcacctctaaatgttgaagttccttgttatttggtcctgagaccctgtgtgagtgtgcttgggctgccatagcaaaataccacggactgggtggcgtcaacaacgtttattttctcacaacaaaggacagggactggaaattcaacaccaaggtgacagcagggatggcttcttgtgaggcctgtctccttggcttgcagatggccatcttctcccttcgtcttcacttggttgtccctctgtgcatgtctgtgtcttaatctctttgtatgaggacaccagtcatattggattagggcccacctatatgacctcattttaccttacttactcttttaaaggccctatctccaaatacagtcatattctgcgttactaggggttgtggcttcagcatatgaatttggggaggacacagttctgcccagaacagccctctttctgtctcacctgtgttttctccctaggggtatcatccactcacttggctttcatctgcctgtcaccttcaaatctgtagctccaggaccaagacctctttaatgaattctaggaccctatagccagctatttcctgcctcaggactcccctcttttttttttttttttttttgaggcaaggtcttgctctgtagcgcaggctggagtatagttgtgtgatgatagctcactgtaagcctcgatctccgaggctcaagcagtcctcccacctcagcctcccaggtagccaggactacaagcatgagccaccacatctggctaatttaattttttttttttttttgtagagatcaagtttcattatgttgcccaggctaatcttgaactcctgggctcaagcagtcctcttgcctctgcctcccaaagtgctgagattacaggcatgagccacaacactcagcccctccttgctttaattggctaattcttactcagcatccccatttggacctcataattctgtgcatctaggcctgaggcacctctcttgtgttttatctaagaaaatagcacctccatccattcatccatccatccatccacccacccacccacccatctatcatccatccacccacccatccacctacccatccacctacccatccaaccgtccacctatctatctaaccgtccacctatccaacctctatccatccatgtatctatccatccatccatccatccatccacgtacccaacctctatccacccatccatccctccctccacccacccacccatccatccacccacctatccatccactgcacaagcaagaagccagaaagtcacccttgatatctccttttcctttataactcacataaattagtagataagacctgtcagcattacctttgaaaggactctcaagtctctctctcccttctctccatctgcattgtcactacccaaattggagctacgatgacctcttccctggacaactgccgtagcttcctacctggttttcatgtttctgttctttctttgctcattttctcttctccttactgcatcctgaatgttctattctgtaagcacacctgatctcatcccgctcctccctcgctgaaaacatcttactgactttcatttatgttgagggtaaatattaaaattcttaatttgcccaccggcctcagggggatctgacttatatctgtctctgcagcctcatctcacaccagacaccccctcactgtgaggatgtcagtcaggttgtctcctacctctgggcctttgcacaggccactctccctgactgtgctaacagctgaaaggaaagattcccataccctgcagacgaggtcaggacctggtattgtgcattcacagagcctggcacattcctccattgctaatggtgggtttacttgtgcagattatttgactggtgcttctctctggcactagactgtaacctgagttggggcaaggctggtgagtggctcaccatagccacccagacacccagcacacgcctgctgcagagtaggagctcaagcactttttaaaatgaatgttacctccattacgtgattataccataatttattcaactaattccctgtgcttggaaatcgagactgtttccatgtttccacttttataaacaccgcaatgaatatccttacagataaattattgcccacatttttaatactttgagacaaatattaccagtgggattgctgtattaagacttttgacacattttcagtttctccattgacaaagagtgtgtcaagtaagatttcaaactgtgctgtgtgaataagcccctttttcttcatcctcagcaagtgataagcagtatcttatttttttccagttgaggaaatgatgaaaacgatcagtgctctaaatatgcactcctgttttcttatagtgttaaaaggttttgttttttacattgggtggcagtttaatatagtgcaggtgttggaatcattttttcaatacttttttcatctaggagtttaatatacttcacatttattccaagtttcttttatgtacctcaataacatttaatatttttcttcaatatgtgggccacacatttattaattaaaattttttttgctgggtaacaaaaaagaaaaagagcagcagaaagcattctttcattgataaaatcaagtaaactgatttaaagaaataaaaagtactctaggctgggcatggtggctcacacctgtgatcccagcactttgggaggctgaggtgggcagattgcttgagtccaggagtttgagaccagtctgggcaatgtagtgagaccccttctctacaaaaaatacaaaacattagccaggtgtggtgatgtgtgcttgtaattccagctacttgggaggctgaggtgagagaatcacttgagcccaagaggccaatgttgcagtgagccgagattgcaccactgcactccagcctgggcaacagagcaagatcatgtatcaaaaaaaagaaaaacatactctataggctttcagaaagagtgtctacctcatcaggttgttctgtagattaacaagttagtctataatcgattacattaatacatataagacattttgaccattgcctggcacagcatataataagcactcaatagacaattgccttcattattatcagatgtattcaaaatatcacactctccaaggcactattgaaaaaccgtctgccactgtaacctaacaatatatactatgtatttattattagatagaaatttttaatagagaaagaattactacttaattttctgtaaaactacagtgcaaagacatcttggtatgcatggaaaggtaaaatgtgataagctgaagacagcaaacgcatatgaaagccttttgtcggatgagtagttcagtataaaaccagaccatttcgtgttgtctttaccttttatgtcgtatgacattctgaaacttagaatgacttctctcagcaacactcacagcatgcttatcatgttgcaggagatgttcggaatgacatttatgtcaccctgatccacggtgagtttgacaaagggaagaagaagacgccaaagaatgtggaggtgacgatgtctgtgcacgatgaggagggcaagctcttggaggtgcgcggcatggcccagaaatcctgctaccatcgcatccgtctttacaatcacgatagaatcttggccgtattttaattcttctttgcatcaggatgggtttgatttttcctgagaaaagaaatataaagcctgttaaatttgtgattagcagtgagcagtttcactaaggaagctatctagactcttctagactcttatttttatatttctcctgtgctaagaaatagctccagccactaatgattttatgtgtaagcttccaatgcagatgttatttatcgttttcaacttagttagccactttcaagcttgatcagttcctcttaggcttgagctaagtggcctgggtgctcgaatagcatcagaaagcatgtttccttccctgggtgagcagaaccaaaggagatgtgctcatcagagactgaaactggaagagccctggggtaggcatccgctaccactgctctttagtttgtttgtttgtttgtttttttgagacggagtcttgctctgtcgcccaggctggagtgcagtggcacgatctccactcactgcaagctccgcctcccgggtgcaccccattctccagccttagcctcccaagtagctgggactacaagcgcccaccaccacgcccggctaatttttttgtatttttattagagacggggtttcaccatgttagccaggatggtctcgatctcctgaccttgtgatccacctaccttggcctcccagagtgctgggattacaggcgtgagccactgtgcccagcctactctttagttttaatgaacaggaaactgtaagaaactttaaaaggatgagttattgtctctgggaaacacaggagttagtggcagagctgggagggtatctaagtatcctgaattccagtccagtgttcctccaactctggcagctttttcttttcttttcttttctttcttttgttgctgttgttgttgttgtttgatggagtcttgcactgtcacccaggatgaagtgcagtggcacaatctctgcctgctgcaacctctgcctcccaggttcaagcaattctcctgcctcagcctctggagagctgagattacaggtgctcgccaccatgctcgactgattttttttatatttttagtagagacggggtttcactatgttagccaggctggtctcgaactcctgacctcatgatctgcctgcctcagcctcccaaagtgctgggattacaggcatgagccaccatgtgctgcctgctttgctttgctttactttactttcttctttcttttcttttctttttttttctctgtctttccgctcccttcccttctctcctctccactcccctcccccacttttcctctcctcccccacttcccctcccctcccttctcctccccttccccctccacttcccttcttctattttcctttcttttccattttctttccttctttttttttttttttttttttaattaagacaagatctaatgcaggtatctgccagctttctgcccacataaagaagtgagtcccaattctgacatcaaagaggataggcaggaggtggtcacaggaggctgcatggcctctgctgaactccacctcttctcgtatgagccgtagttaactgctttggtaaccaaggaccaagctcttgattgacttgactcactgagtgtcctgttgcatagttgtttgaggctacaatgaaatacaatttcatcacttgccatggatgttataatctattaaggaagcagatagctaggcagtttactaaggcaagtcgtattctgcatgagagggagaaactgaatgctatgagccactgtatgaaagtgctttatttgtgctgttgataagagcacatgagctcatttcacgtagacaccttctcctggttggtcatttcgtttgatagtgccccaccaaggcctggttctactaagctcagtggttcatgaccaggaaaagatgcagccctgagttgagtgaatatgctgtgccaataccctaagtccctaaaacagaatgtagacaggaaaagagaaatgcttttctgcaaatagcggcgcgtctgcagttgtcacctaacttctcgtcatcgtcatgttccctgagagagaagaggaaagaatcagaggagaatgcatgcctggggagggaagagaaaatacaagttacaggaaagaagaatatttaggcggtgctgggttccttagctgctaccaaattgatattatagacccttgaataaagtggtggaaattcagtcttctctgttcttcatcccccaaacttaatcagccgatcagtgccagtgtagggcatgtgtggacgtgtttgggggtgaggggcttgtgcatggtatatggggtcctcttacttttctaaacaaaattattcccttctaattttttccttccatctgaagaaagcaattcaccctggtgctggatatgaaggcatttcagaatacaaatcagtagtctattaccaagtcaagcagccctgttggtatgagactgtcaaggtgagaatgagtcatttgtaacccctgttatctgttaaacctcagttagattcctatcttctgtttacccccaaattattcctactttattttgaaatttttagataagttgcctatggtgtgcagtaagaaatgaatcagtaattataattctgtattaagagcatttatcattaagaaactcagtgatgtatgagaatttgaatagcaaagcttgtggttgacgtgatggatataatagactgccaagatggtacaaaaccaaacagaaattttcacactgtgcaaacagtttcctaacatttttttatttttggcctctcaccaagtgttctgggcctcttttcaacttcaatatgtgtattacacattccaaagtgcttttcagatcagtcatctcctttgagccccacaagggctctgcaactagaacaagcaggtgttgtaacgccatctttcatattaggtactgaagttcaaagttcagtgacttcccaggatcctagagctgactggtatcagggcccaaactagagtccacttcttctgaatcccgggctccatcagctctttctggttgtcgaagtcacacgagttcttcatagaaaaaaaaattttttaattgcattcatatatctcaatttagaattaaccattttcaacagttttctatagttcatatgttttgaatgatgctgttgatacaaatttatattgtgctttttaaaactacttatctcaatgcatataaattcttcagatatgtattttagatacttgcataaggttccaaagtataatcatgccatgatttgactgcacaccacaaatctctgctcgtttgagtgccctaaggctctgtttcttctctcccctgtagataggtaagcagcagaaaactgctttatgagccctaattattacctttccccctctttatggaataatcaggtcttatagatccaattattactatatttatacacatcttgcagtctgaaagatcctgtgtggacctcaaaataccagtatttcccctctgaagtattactgtttcttacttcagaaaatgctagaaattcacagtatccctatgctcagaatctatgataaacagcaagatgatctgagattcttttgatttgaaaatagctcagtctcctttgaatgaaacctataccaaatctcactctctagtaatttgtgctgtggaaagtataaaattgagcctaattccatgaaataaaccatgcttgcaaagtactgtgtgtctgtaaactattaatttcttactatgacacaggtatccattgctatagaagaagtcacacgctgtcatataagatttaccttccgacacaggtcatctcaggaaagtaagtattaagacgtctatgacatatttccacttaaaaaaaatttgctctggcttgacagccatcttgtgaagctggagaacaagatatttggaaactagagacttggcagctgtattttgtaactcactggtgctaaggaaatcagcataatgaattttgctgggcgtgcaaggtctgtgttgtcactctatattaggatttcctcaaaatgtgttttgtgaacactaatattctcaaagacagcagtcctcaatctttggcaccagagactggttttgtgaaagccagtttttccaaggaccaggggtggggtgatggtttcagggtaattcaagcacattacatttattgttttctttattcttattacattgtaatatataatgaaataattatacaactcaccataatgtagaatcagtgggagccctgagcttgttttcctgcaacgagacagttcagatcatcaggcattagatttccacaaggaatgtgcaacctagatcccttgcatgcacaggtcacaatagggttcggctcctgtgagaatctaacgctgctgctgatccaacaggaggcggagctcaggtgataatgcgagcagtggggagcagctgtgaagacagatgaagctttgcttgctcctccgccgcttacctcctgctgtgtagcccagttcctaacaggccacagactggtatgggtttatggcttggggtttgaggtcccctgctctaagatgctactagatgctctataacaaaaagtgttgtatttcacaatcaaataggtataggaaaggctatatatacattgtatctccctcctagacgttcacaatgcgtgttgccatgttgcagtagcaagaaaactctttattcacttgtctccccaaattatcatttttctcatgaaaaaactctttcaagtcttaggtcacagttcttgaaatggctacactaaagtgtaagcagagaagaaaattgattgttttcagattgatcacaaaatttctggaatcgtcttattctcatttcgcactgcataaaaatgtaacccctccttccaaaaatgcatgtgttgaacaccatctacacaacaggctgcaggcgaggccctggtctatgacagccagctggacactcccacgcagagtctttgtggtctggttaggaagatgaacgaaaaagtgggtggttatgtacggaatagtatgatatgtacattacaaggggcaaagacttgtaatggaagcgtagcacagcaccttacccagtctgggggatttatgcatatgacctcctacatcttagctgagacttgaaggtgagtagaaattagcccagtgaagggtgatgggagaagtgtgtttggagaaccaaatgaactcagtatggctaaagcaggaccagtggagcaataatagtatcaggttgaatcgtgtgaaattggcattttttaggtctaaatggccaaatatcagccatttcatatggttctgcataataactaacaattgtcaattaacaattaacaaaggtcaagtttgtatgaagtattatgtgaagctatatttgtacatggtcctgtttagtatccacaataatataacaaggtacattctacttttatctacatttatacacaaagaaactaaggcatggagaggttaggcacttgcctgtggtcacaaggctagcatatgaccaggctgggttagcacccagacaatctgattctagctgggctggagccggatcatgaaggctgaagatgtttttcagccatgttaaggaggtgcaattcaagggtggtttctggttttgaggttttgggaggggttggtctatgttcataacagcttcacccatagtactccaacactagaatagcctaaatccccatcaataggagaatggataaacaaattgaggtatgatcatacaatggatgactactccaccactgtggggacccaaggggcacagcagaccacagagccgtgcctatgataaaaacaggccacaggttaccctactcagagccactgaagcaggggacccggtgagttcagagactggccccgaagaccaagagagaggagctctgcctcctcatgaagctgcaccctcctcccagctgccacagggcatgcagatcttctttcctggcactggagctggtattctggggaggaagggtaaagaaactttgggcagcaccataaaccctagagtagaataaatatcttgcagagcctgttttagagcaacataaattgagatctctcattcaagtgttttgaagcagcgtggttgacatgattggattggactttggaaacctcattccaacatagagaatgtgtttggtgggagagcctagagacagagagatgcgctgggaaggtcttgtagaaataaagagaagaggtgagtgtggcctgaagtcaggaaggacagcaagatggagagagaagagacaggctccagagctgtttaggacatggagttgacgtggggtggagttggtgtcaacacccacatttctgatttggatgactgggcagatgctagtctcatttattaggggatgtaggaagaggagagcatacttgggggtgccaggcagtttcagtggcacatggtacgtggcttattgcagtttgctcagttgtgcttattagaatatggttgaacgctgcacccccgagcaaaatgtgaaatcgtgtcatagccatcgcctcctggtgtctctctgcactgctcagacatgtctttctgccttttcagccagagataaatcggagcgagcatttggggtggccttcgtgaagctgatgaacccggatggcaccactctgcaggatgggaggcacgatctggtggtttataaggtggtgctaacagaaaatggctgagaaaaatactccctttcaaatgagcatttaagactcctttcatatttatttgtacaaacatcagaaacctttctagagctttctgtacttgcccattaacatctagaaacccagagggctctgggccctccagctttgtggtttcccacctgctttctggagagagtgagttgcattattactgagtcttctaaggaggctctcacctccttagacctctcacgggagaggtcctgtgaatggtgttccctagcagtgaatggtaaggggtcggcctctcatgatctgctcttttcatcatcctgcatggcacatggacaggtgcactgttgggcttcagtagtgtgtggtggatatggttttcccatcaccatgagccacatactatttctgtgctctgggggccttatttccttccctgaaagttttgtctttgttcttgccttccaactgatgctgagctcccacttctactgagattttagagtataaagtagatgctggaagatctcatttagccaacaatatctggggatttccccacagttggctgctcttttgagatgcatctacctgaggaatatttttcttaacatcttagtttatgaatcattttggaagggatggcaagctaattcttcttccatcaacccaataaagtataattgtccccattttttaattacacttcaagttttagggtacatgtgcacaacgtgcaggtttgttacagatgtatacatgtgccatgttggtgtgctgcacccattaacttgccatttaacattaggtatatctcctaatgctatccctcccccctccccgcccccgccacaacaggccctggtgtgtgatgttccccttcctgtgtccatgtgttctcattgttcaattcccacctatgagtgagaacatgcggtgtttggttttttgtccttgtgatagtttgctgagaatgatggtttccagcttcatccatgtccctacaaaggacatgaactcatccttttttatggctgcatagtattccatggtgtatatgtgccatattttcttaatccagtctatcattgttggaattgtccccatttagagactgaagaaaatgaaatttaaccttattctgaaatatgtgtatttactctaacagagactaggatattctggtttctagttcacaacttattctgtttccattcaatcatgaaattatttctgggctcaatgtttacagaaagatatcagagtatctcagaggtggaagggatcttcaggataaattgataagtccacgcttctcatgctgaaaatgcatgatagaaattgtttttatttgcatataagagattttggccatcatttggtgttcctaacatgcttccttttagggtgacaacaaaaaaatggaagatgctaaattctacctgaccctgcctggaaccaagatggagatggaagaaaaagagcttcaagcatccaaaaacctggtcaccttcaccccaagcaaggatagcactaaagacagctttcagattgccaccctcatctgctccacaaagctcacccagaatggtaggagtggtgaatacactgacacaaataagcttcttgctcagcctttctgggctccttggttaggctcacagggctggactatatggggctgggtcttattaggtaggatgttggccaattggattctgctctctgcttttcaagtggtattctgggtagtgctgatcacattgcacagcctcttctgaagtttcatcgtccactttagagcaggatgaaaaacattttagtatttaatatcttaaaacctataaatgcatttattaacagcaactgtaaaattcaaaagccgtatgttccctgatagtgcattctgtgtagtatgtgcaggaagagatgttggtagtaagaggaggagcttggcaaagaaatataatcagtttcctgtccaaacaggtatggcagggcttcctgtttgagttctgtccttccctcctatattctcttctttcccatttttttccaagcagtcagggattttccataaattcagctgaatagttcaaagagggattcatttggtttttccttcaaatctctgatatcaattttaacctctcttgtgtagattatgacatgtgctagccaatatcaacttcttatttatttaacttaagtaatgtgtaaggaaccctactggatgtagtaaaccaagaatgagctgcctaggggacttgcgctagaaattctgtctcccatatgccgtgtagagactgttgcctttggccttgtagacagtttgagtgaggtacaggcaagagctctgccttaaggggtgccaagatagacaaaaaagtgtagttatagggtaaacccagggatcagatccctgatctttagaagggctcagtgttaggtttgtttcaacaagtcgtggttgacaaaaagataaggattgtatttcaacttggacaagtggctagactccacagagtgaagtttagggctaatccgtatgtgcaagtaaaagcatcctcaccaaaaatgaagccagaaacataaaagacgtgacaaaaccgtcagcaacataccccgtgttatggacaaagcgaatccattaacaatgaactgctggtaggttaatgggtacaacatttatggaagataatttagaaggcatatcaaggagtttaactgtcttcagaccctttgagcctgtgatttgattcctggaagttgcacttaagtaaacaatgagagatggacacgaagatttatgtacaaggatgttgtttccctattatttgtaacagggaaatactggaaacaacccaaatgtctgatagtcagggtcagtttaaccacgttttataatataattaagtgatgaaatatatgcagctgctaaatatggtatttcaaaacatagtgaaggacacggtgaactttttaacactatatacagtatgatcccagttttatttaagtatatgtgagcaacctgcaggcagattgcctggcttcaaatcccagctctgccatttactagctgtttcatcttgggcaagtgacttgatatctctgtgaattggtttccttgtctttcaaatgggagcaataatagtatctatttcaaagaatgcagtaaattaaaacacgtaaaaactcacattcgatctatatagtgaacactataatgtcagctatcacgatcatcatcactatttgtacacagaaaacgatgaataggactaacccaaagtttgataattcttgttttctttattctttttggtattttccaaatttttaactatgaaatgtcaaaatgttattttttaaactaagtatggtagtatactatataaagcattaatgttcttttaaaactatcaagggatatttgagagggataacacttattgaacatctagtagattatcctttctggactacagattaaagaagaataaagaaaacaagaataaaagtttgtgaaattaactagtaatgaaaagcaaaaggaatttctgttagagataaccatattgttacattgtttgttatctccctgtcaaaaatgtagggtttcctgacaacccgcagttctcaatgtagacccttcgtttgctgatacatctacttcaccccatcttctgaatgttcttaactagcctgtactgtcccgatatggtagcccccagacacatgtagcttgtaaaatttaaattaattaaaattggagggtggggagattggggagaagttggacaaaaggtacaaaagctcaattagacaagagggataagttcaagagatctgttatatatcctcgtgtctatagttaatagtatagtgtatacttgaaaattggtaagagagtagattttaagtgttctcaccaccaaacaataagtgagataatgtgtgtgttaattaccttgatttacccttctaccgtgtgtgtgtgtgtgtcagaacatcatgttgtacactgcaaatacatacaatttttatttgttaattaaattttattaataaaattaaattataaatcagtccgctagttgccctagtcgcatttcaagcattctggtcttctgcagctggtgagttttgtgttgggcagacggatatacattttcatcatcacagaatgttcctttggatgacactgtatgctttattttgtcatccttattcctgatgttttgattaaaaaaaaagacaaactcatcataacacatacaaaaaaagtcagaagtaatatcttattacaaagaagggttaaaaaggcaaaccttgtctgagtcagagaggagtgagctgccatccaaacagactgcgagcagggagagggaacagggtacagagagggaaagacggagacttggcaaaggcatcacgagcatcagggaaaatggggtattccagggacaaatgattgcagattattcatgcatttgctttcttctgacttgatggaaattataaagaatgaatttgatttaataaaaagctgaagaacattaataagccatcagctaattctgtgagggtgttgactgagtagagagggtagcagtgttctcactgagagggtgaacaaaggcatttctccttcgcctgaggagagttattcagactcaaaaggttaaaagccactggagttttaacaaacagatcttggagactcttttgtttacttgatttgttttttagaaactaaaacagaccaatttgtgtgggatcattggtttctgggcccactggaaggtaagaatagatttgtttcccaggaaaaagagaggaatgtgcaggtccccagaggtgcgtggccttgggccaggaggttcatactcagtcagtcattgcaccctccagcaccaactttgccagatcatctccagcttattgatcagaaaattgagttttaaagtggcaaaaaatctttcttaagctcctaagtcgtggacttgtattttgaaagcagctctttgtagctccaaacagtttatagtttatcgttttgcagttacagagtctccaagatctgtttgttacgaactccagtgacttttaaccttttgagtctgaatagctttgtctttcttttctctttaaaagtatgtgttcttaaattctctcctttagggtagaaggcagttactaccctaaatgtggggattgttattctcttgcttctctttatagttttgccacatctgtagcccttaaggtatattgtttcattttgcattttttaattttatgttaataaattaaattatgagtcagtcccttagttgccctagccacatttcaagtgctcagtaatctcctgcagctggcaacttttgcatgccaccttacttatttttcggtggtgagaacactcaaaatctattctcttagcaattttcaagtatacagtatacagtactatacagtctacagtattaatgtagttaataattgaactgtctaattgaagtcttgtgtcacgtgtgaaatcatgtaacttgcgcttttactcagcattactgaagatttgaaatatcctgaattcttacacatttctgacaagaatgtaaaatgaggacagtgactttgcataatatttaatatggttgaagatattcttcctgatgccccagaaatcccaccttagttttctatcccagagaagctgctctacctgtataccaggagacgtatgagaatgttcatggcggaattgcttatgatagcaaaaaaactagagacaacccacgtgtttatcagcagcagagtggataaacaaattgtgtacacccatacaattgaatagacactatacagcgagaaaaaaaattaactagagctacatggataaacctgtataaatcttagaaacacagcaagcatggggctctttctgtaaccccgtgtcactgctctcctggccctaagaccttaacaattcaccagatgccaaaatattttcctatgtgagcagtgatctggcatgcagatatcactaggaaataaacctctgggctgatagatgggtactttgccagagctgaagctgctgggtgaatattcacccctggtgaagggactaaatccttttcctccagcagctatgagtcaagtgatggaatgagtgataccttcgactagcctgtgacagaaataagagctggagaatatggaagtagatggtgcctagtggatgaatgaatatattaatgattgggttgagcatattatcagtttccttagggctactggttccctttccgttcattcatttattccttcatcaaacatgtattgaacacctaatagatggctagtactaaggcaagataaaagaatgaatactatatgattcctgccttcaaatggctgagaactatgggaagagtcaaggagataccaagtacatcttaccaaatacatagtatttctgggtatttcaggcaaagggaagaatatacacaaagacacagagatatttcagaacctgccatggttgggctgtagtgattggatttctctgactgctaaagggtaaaagagaatggtggtggttggaagtatgcaggagtgatataggtggggccttattacattctctatgtggcattggaagtttatcctgtagacacgaggaatccctaggcactaggttttggagggtgttgataaacaccctcaagaaggactttgactatttatgaaaaatacatgtgtaactacttatatatttctacaaattcattgattgaaaaatatcagccgggcgcagtggctcacacttgtaatccctttgggagggatttgggaggcactctgggaggccgaggcaggaggcttgcttttgaagctcaggagttcaagaccagcctgggcaacatggtgaaagcccttctctacaaaaaatacaaaaattagccaggtgtggtggtgcacctgtagtcccagctactctggaggctgaggtgggaggaatgcttgatcctgggaggtggaggttgcaggttgcaatgagctgagattgtgtgattgcaccactgcatgagattgcactactgcaccccagcccgggtgacagagcgaccttgtctctcaaagaaaaaaaaagtatgtattgctacatttactagatagtgctctgaatagaaatagtagcttgatgtactaaactaggtgataatacagtaacagtccagataactgcagtttctctgtgacacacacacacacacacacacacacacacacacacacacatatatgtgtatttcttaatagagacagggtctctctatgttgcccaggctggtcttgaattcctgagctcaagtaatcctcctgtcttggcttcctaaagtgttgggattacaggtgttagccactgtgcccagcccctttgacatttttaatagctcaacatttattaaacctgtaagtggcttaaagtttcaaaattctccattgtaagtcaaaaaatgtcttaagatttttatcccagacttatgctaagggttatgaatctgttccaccttttgtttgaaatagccacctgtctgatttgcttgtctatttcttcaaagaactctggggaaaacagtatgatagagtagcaaggagttggtttttcaaatcagataaatatgtaataaaattccatttctacctctcctaagacatgtaatttaacttcacaaagcctcagtttcctcatctaaaagatgaaaaaaataaaatctgtgcagtcatgatgttgaaataaattaatgcatatatatatatatatatatagagagagagagagagagagagagagagagagagagagagatacacacatacctatgttcctctttccctctgaatccacccagacataggtagtgataagggacaatttaaataaggcagcaaattaaaagtaggaaggttacattagcatgcttcttagctttacttcttatgaccatgatgtcattatttgagaaatgttagtttcagtcagatattctaagttcttatgcattaatagttaatttttttctctttgaagaatgaaagaggaccacaaggttttctctgacttagataggagatagtaaattaaaagaatatataaggcatcttgaattagccactattgagagcaattacctgttctagagaattctttagctatgtcctgaaatggtctgggttgttctcacctgtatctaatgtttgtggttgttcttcctagttgacctgttaggcttgttaaattggcgttccaactcccagaacattaaacacaacctaaagaagttaatggaagtggatggaggagagattgttaaggtatgtttatatattcatagttagaaatacacatacctacatatatatacctatctaattatacctaattggttcaccatttaaaattaaatcattcattgtaaatataaaatctacgttgttaaacaagtgtgctagttttttaaaaaatgctattttaaacctctttgatttaaactagttgtacccagatttctgtggtgtggggctgaatgaaagcatcaaaataacctctccgtttttcttatcttcagtttttgcaagatacactagatgcactctttaacataatgatggaaatgtcagacagtgaaacctatgacttccttgtgtttgacgcactggtaagcagttaaacatattaactagtgtttattgttgcaactttgtagttttcaatatttcactattataagtgattgtgtgaatatcttctcacataaatatttgtttacatctctctggttattgttttaggctgaattcctagaagtactattagaaacaaatgacttatatttcaggcctttgtttgtttcctgttaggtctcattttttgatatgctctttctcattagagaagataagatgttttatttttattagaaatcaggaatcattttaactcacattaccatgatctggagcattgttacatgttggatttgtgtgtgcactggtgtgtttatgcaagggagactgaattcacaagtcagaggtgaatctgagcctcattaggcagaatattcaacccagcagaaaattgaatttgtcgcacaaagcacttaaacctacaacccattgcaagaattgaaatcagatcagggataagtgatatcagaatctgggaaagccagaggtgagggtggaggggaagaagctgaaaggctcaaagcaagcatcgttttcaccttggtggggtgaaatttcaggacaggattttacctgaatgccacagctgaggaggaaggtcagttgcagctttaggcgatttaccagctttgagaaactagtcagtttaggaaatgattagggtattaaagctaaggtttaagataaagaaagaaaaggccacctacttgagatccaactggttggacttgggtttatgggaaagagagacagtggttatggttgctgtgggacaaggtctggaaacagattcctgagggacatagcagctggcagtgggcatagatggaaatcccaaatgcctctttcttctgacccctctgtcttaaacagggtagtgtggctgattttaggtcatgtgcctgatagcagtgcaagagaatatacaagaggtaattgggagataaaactctggtgcagttgttactgggggcactcatagtgtacacaggagaaaaatgtcatggaatgtttcattagctgcatccttggattagagaaaacacctttccagagcctccttcctcctgcccgttaggttacctgggcatcgactcccctgtctttgagatagtcagctccctgaggccaaggatgctggcttgagttggtttcttcacagcatttaacatagtgcctgacacataatagtctctctatttatgctaaataaatacaatcctcaagacttgacatcagctctggaatagtagagtgggaatgctgcagaaaagatccagagaggaaagaaggcaccgagatgttaaaatgcggcttgttgacagaatacttgggattgtgcagtgctgctatttctatttttcacttttggcaggtatttattatttcactgataggagacatcaagttccagcattttaatcctgtacttgaaacctacatttacaagcacttcagcgccactttggcatatgtgtaagtatgatctgaaggaactacatgttgttggatctttggatttgtactcttaggactggattgttgagaaacgagacggacctattactattcagtaaatacgcctgttaaggcagaactcttattctaagcttccgggtggaaaaagggaaccatctaagtattctaactctggaaagggggctaagatcagggccttcattctggatcaggcgaaatttccttaaggatccagaataggccaggcgtggttgctcatacctgcaattccagcactttgtggggaggattgcttgaggccaggaattcaagaccagcctaggcaacataacaagaacctatctttacaaaaaattaaaaagttagccaggtgtggtgacacacacctgtagtcctagctactcgagaggcttaggtgagaggattgcttaagcccagggaagtcaaggctgcagtgagctgtgatcatgccattgcactccagcctaagtgacagagcaagacttagtatctaaaaaaaaaaaaaaaatcgagcaaaatcaataacaaatgactcaacccaggatctcagaggttgaatgtcagtgggattggcgtgggacatcaaggagatcaaaccatgaattaaacaagaccaagtttgatagaagaaaaggtcatgccctcaaccctgtaccacaaatgctttgtaaaatgtattgcttacaggatatgagaagatttcgttttcccatcttttgcataagaggcagtggtctctaccttttttgtagtgcagcctgccttctatcattggtttatgggcccctgactaaggaaagcaactgatgtccactccgcattcctccccagagcactcagctcaccatggcattgtgtgtgcctgccacacccacccgttgccttccagttattgtgcagaatgtgataaatagtgaaaggaatgtagctggattggtccatgatcttcttatgacagtggcttaagccacatcctgtagattgctgcccactgacttgtcagcaagaacaccagtgacagtggccgttccacccaggagcctcacatccaggtgggcaatagctacaaatgaggaaatcccatcactgtgatcataccgagccaaatgcagcactccaggtggtagtaatctgggtttacttgcaagacttgatcaattctatatgtttcctttttaaaaaataataattcggccgagtgcttgaacccaggaggcagagatcacgccactgcactccatcctgggtgacagaatgagactccatctaaataataataataataataattataagtgactattattatattattatgtatgactattattgtatataactattattattattctaggaaagctcaaggatccccagaaggaaagtttaagtttaaaatatcagtgccctccaaagtctaagggatagcacaaaatgaagaccattcctagcccaaaaactctagaaagacacaaagagcaacctataaccccagaacagctttatctgttgaatgcttagaaccatgaatgttctggagagtgagctcctctttcttcactccataaagtttctatctggctccatattgatggatcccaatgggttgaggcagaataaaaggaattaggcttcttttaagtcaactcctgtaggcaggcataatccctcatttatgggagcatctgaagatgtcagaattgcataccagagattaaaatatcctagcaatttgggtcacttcaaccatttcatttcataaccctccggtttaatcccacaaagggaaagaaaccttttctagtatttctcagcagaaggtagttccaaacctagatggcagatgaggaaacttaattggaaaagagttaattttgctgttcagggcatattctagaagatataattagttatgacttctacttccaggatgccatgttcccctcttagataacttacccaagcctcagagtatcctgttgctcattggcttaatttttctttctcattcttctaaggaaactctccaaggtactgaacttctatgtggctaatgcagatgactccagcaagactgaactgctttttgctgcgttgaaagccttgaagtacttgtttagattcatcatccaatcccgagtgctctacttgaggtaatgttaactgcagtgaagatgtttagattatcagctgtcactctgtgtgctttttccctcactctgcacagtggtgttcagctctgtgagcagttagttcttagaattgccttatttcagaactgcagggctgaagatggatttgggctgcgtgtctgttggagaagactcatgagaagtttttgtagatcagcaaaattctggggcagtaatgacctcaggacttggggaagcagattcctgtggaaagattgtacctaatacagcagatgacttcatgacaatattgagtgtgcaaatctaggatcatgatctgctgtcgctagcagaagcagcagtcatctcaggggaggtgttgcctgagatgagtgtttccttgttgacactgtgcttagctacctgggcaactaagcactagagacaggattattccctgtttggatttctagcataacagttccatcaaaaacagaagaaactgcaaaagagcaagtacctttgcagggaacattcacaaccccagtgactttcctacccttcagaaatagctgtatttccaaactgttaaaatttttttctaaggaagaaagaaaaggtttgtagaattgagcatatgtatttttaaaagaaactttattgaaaaaaataaaattaaaggcaaacaacctgcaaaaaggttacatatagtacagatgaaagtttaatagcttttctcagttaaagcttttataaatcaataaaagaatgataaatagccctaatggaaaacaaaaacaggtaatttacaaaagaaaaacttaaatggtcaataaactttttaaaaaatttcatactatcaaaagaattttgatacagacgcacacacatgcatgcacacacacaccatcttttacctatacatttgaaaaagattagacatctttgtccttgatgagattgggcaaaaattggtcctgtatttcagttttgatgctaatggagatataaattcttcaggatagaaatagatagtctgaataaaaacaaaaaagaagatttttaagggaaaggaaaaagtgtcacatttgtccagtaatacctcatctagaaatttatctaatggaaaaaaaaaatcttatcaggtatgacaaaaatgaatgtgaaagtatgtacattcagtcatttcaaatgtagggtatgttaatgaggaaagacgaccatgatagattcttttttttttttttttttgagatggagtcttgctctgtcgcccaggctggagtgcagtggtgtaatcttggctcactgcagcctccaccttacaggttcaagcgattctcgtgcctcagcctcccgagtagctgggactacaggtgcataccaccatgcccagctaatttttttgtatttttagtagcgatggggtttgacatgttagccaggatggtctcgatctcctgacctcgtgatccccccgcctcggcctccgaaagtgctggaattacaggcatgagccactgcgcctggcccgatacattcttaaatgataaaacaaaggtattaagcatgagtacagtatgatcttccttttaaaataatacagatttgaaatatgtatagtaaagaagactggatagatcacatgctaaagtgtttttttgttgttgtttctttagagttttttagggttttttgtttttgtttttgagacagggtctggctctgtcacccaggcgagagttcagtggcatgatgttgggtcactgcactctgcttcccgggctcaagcgatcctccaaccttagccccccaagtagctgggaccaaagggcacgtcaccatgcccagctaatgtttatattttttgtagagacagggtctctctatgttacccagtctggtctcaaactcctgggctcaagggatctgcccacctccgcctcccaaagtgctggaattacaggcgtgagccaccgtgcctggtctgaaatgtcaatagtatgaaaacttcatgtgacagggttgtaatttattttttcattctttatgtttttattctttcagcatttgatttacatttattattctatttttatttgctattttttatatttttttgaatttttaaatgaatatgtacctttctgattgtttttaaaaaatgtttaatgacttgaaacccatctggctgaatgactgtccctcctttccaggtggaagtgggcagtgttttccccacacataatttatgctcagtctctgtatttgctttcttttcagaaggtcttcttttaaagttgtttcattatattttccagttatggtacatttccatgtattcagaatggttggggcatggagtgttcgaccaagggaatattctcttacccaaaagtttgtatgtatagtaaaccctgatgtccaaaaatcagtatcaactttaaaccacagaaagaaaacctgagtgtgaaattaaaatatattttcttatggatggttcactagttcatttcctcttcatttgttgaggcacatcagagtcctcattctagacaccagataggacagtaaaggatggtgagtgtggaaaacaaaaggttagggcgacagaggacccatgaaattgactaggagagttgcttcattacacactgtctgtgatggcctgcgtgtggttacttttcccttatatgttattaaagaagaacctgagctggggaagagactggcaatgtgcgtcccctggttgcttagatttaatggtcacttcagtgcactggccatgtctggaggctgcagtggaatgtcacctggtccctgggccccctgttgccttccgcagagcttaaatctctcttatgagctcattacctggctggatttcacctcaatcagcaaaacaccaagaaaaaattgtaaattgctcccaataggatgttgagaagcttgatcttaatcccttagccccctatcattagtacttaaaaaaaaaatcaagtcacatacgtagagtgccaagtgttctgcattggtgcagggcttttgcagcatatgtgaccaggctcccactatgatggtgtgtgtgggttccatggagttcagggaggcaaggagtaaagaaatcaacccctaaatgaaggcagtgttggagtggtggaaccagcagggaaggctgcctgagctgagctgggtggaggaggaggtggtatcatgtgagctgagactgaaagatgaagaagcagcctccagagatgtcaggtaagggttagtgggagcaggacctgccccaggcagggacctatagggcaccaaatgtggatgcgtgaggagtaacgagaacccagtgtcgggagagagagcgggagtggccagcaaatagtaaatgatgtggggccttgtaggccatagtgaggagcttggattttattccaagtgtagtgggaagccgttgggggacaactagagaagtaataaaatctggcttatattttaaatgatcatctcatctcccacatggaaaatggattatcgaaggctacaggtagaagccagtgaccactttaagaggccattgtggtttaaatgtgagatactccagccccatctcagaggcagatggagagaatggactgattcgagctcgtaggatttgctgttgggtttgatggggcaatgagagaaagagaagaaacatagataacatctaggtttggggtggatctaggttcgaggtgatgctgtttgctgacatttgtaatacttagagttgagcagggaaatcaagcgaattctgttgtaggtgtgttaattttgagatactttggggactacattgcaaataaagttcttttctagttctgtaaaatgggtgaattgagaattaccattaaccctctgattaacgatctcagtgaagttcatattctttgggtactatataaggtataggtgaatggaggagatgaatttaaatgtacatgtgtgtatttgagtgtgtgcatgaaattttgaattcaagccatcctattcttgaccagttagtggtgaaattgccacctattatatgtgcatatgcactttcatttgggacttttgtgtgtcttggaaagtgcccaaatatctcttgatttctacttatgagaaagaacccacttttgagttggtggacagatcttttggagacaagtagagtactttaattaaggcaagcatgtatcagcgaagactaaggggtcttgtcctggaaggcccttatggtagagcaggccagcatcggcacgggcagttcagtggctaaagtggaacaaatggttttgtaggctgggttggggatcagagcctttccgggttgagcggcttctctaacccattgcctgaaacttcagatgactggggcttaattaggtgagtcagaatgattagggtgatacgatgaaggagaagtgagggaggcaacaaatctattttaaaatttcttttaacaatggaaagtccaactgcttttgtctttttcctattaagattttatgggcagagcaaagatggagatgagtttaataattcaattcgccagttatttcttgctttcaatatgctgatggacaggcctctggaggaagccgtcaagatcaaggtcagcctggcagcatcatgggtaactcttcttaggctgtggtaaggatgttctgggaccgcttagaattggccatcatgagggagaaacaaagtgaatcatggttcatgcatagcttatgaattttagtatgatttacagaaaataaaggaaaaaaaatccattttaacttctacagagcttgtattttcaagtgtcaacttgccaaagacaagctacccaattagacatcccttgaaaggccattgtgaaccctgtttgaccccatgatttcagcaaactgatcccaatgcactacaggtgacaaatttttattttttgtccctcattttacccagaagtgcaaagtcaccatctttattatcataatttttttaaaaaatatgaaatatataatccctgaaggctcaaatgtgaactttactattaatatttattttttgctctttatggccatgttgcaagagaggcttcaagaatttaaccacctccttaggcagagaaatgaactccaagtggacagagcctgctggcagtagaaaccagaaagctgtaccccctggcatcttcaggaaaagcattttaggagatcgtgtagagcaatgccagctttcctttttattgtaagggtatctgtgtccagttccctatataagttccaagcacagccttttcttcctgggatcaagcagtaaatactgtatttgtcttgcctggcaactgaatttgcctttggtgtttttcttacagggggcagctttgaagtaccttcctagcataattaatgatgtcaaacttgtatttgatcctgttgagctcaggtaaatagcaaaacaaaattttgttccttaactctaacagaaacagctcccctgcttggctggagcctgggctgctacacctggcttttatttttctaagaagtattaactgaatacctttttgtgctcagttctgtggaagatgcaaaagaacatccaaaacctgccctgagagaggtttgcactttctctgggaaaacaagacatgcagacataaaatcgattacaaaagatagtgtataatgacatgcttccagccctacccctaagtatcccagcagtgcaaagtcagactgcaatcaacatgagagtggagttgccaagaaagccattttcataaaggcgggtctggaaagtgatgatggacgtgggtgttctttggcaatttaaatactcagctctaaggcagagccctccagtaagtgaggataaaatctcccttgctgccatgtcataaactctcaggtcattttgtagttttccaggtaaatctctccatgcccaaatctcagagtggaggagaaaagtttataatgatgccttcaatttggcagaacgaagacactactaaccctgaggtttctctcccagcgtgctcttctgcaaattcattcaaagcattcctgacaaccagctggttcggcagaaacttaactgcatgaccaagatagtagagagcactctttttcgacagtcaggtaagtctccttcaaaacttgctgcatgaggttgcagtgagctgagattgcaccattgcactccagcctgggtgacagaacaagactccatctcaaaaagctaaaacaagctgctgcatgctgaaatgacagccccatttctgcagctaacacttgggttttgttgtttgtttgttttttcttgtttttttttttttttttttttttttgagacggagtctcattctgtcacccaggctggagtgcagtggcgcaatctcggctcactgcaacctcggcctcccaggttcaagcaattctcctgcctcagcctcccaagtagctgggactacaaggacctgccaccaagcccagctaatttttttttatttttatttttagtaaagacggggtttcaccacgttagccaggatggtcttgatctcctgacctcgtgatccacccgcctcggcctcccaaagtgttgggattacaggcgtgagccaccgcgtccggcttgtttgttttttaagacggaatctcactccctcacctaggctggagttctgtggcactgtctctgctccctctaacctctgcttcccaggttcaagtgattctcctgcctcagccccctgagtagctgggattacaggtgtacatcaccacacccagctaatttttttttttttttgtatttttgggagagggggggtttcacaatgttggccaggctggcctcaaactcctgacctcaagtgatctgcccaacttggcctcccaaagtactgggattacaggcataattaccgtgcccagtcagcacttgacttttcttttttaaaaatgtcattaatattcttgccagttgtttgttggcaacattaatattgttgccagttgtatgtaaggacctcctgggagagcggttttaaggagaatctaaagtcagctcggtatttccaacagttcctaaaagagcaaaatcatgtgttccttaatctttaattagaacaatctgcaagtggttcattaattagagaattttgtctttaaaacaggaacctcaggaagtaacaagcaagtaggaaaagatgacccttttaaaagaaattattcttctttagtctatacttattgcatgaccttaaaaaccaggggacagggaaacagcaatgtgttggatcccacaggagagctggttacatgcatcccttctcaaccccacgttcagtgatatcacattagtagctggaaattgaccatggtggaagtctttacaccagggtaactggcaaacatgataaagcaagcgtttttttgttttgttttgttttgagatggagtctcactctttcgcccaggctggaatgcagcagcatgaacttggctcactgcaacctccacctcccaggttcaagcaattctcctgcctcagcctcccaagtagctgggattacaggtgtgcaccaccatgcccagctaattttttttgtaatcttagtaaagccagggtttcaccatgttggccagcttgtctcaagctcctgacctcaggtgatccacccaccttggcctcccagagtgctgggattataggcatgagccactgcacctggccaagctgttttctttagggggtaggctggcagaagccagattactagtattctgctgggagaggagtggggcatggaggggaaaaactcttacactgataaaatacttttcattttgtaagtagagtctagcaaatagccaccaagtgtttctgtcccaaagctgatataaacaggaggtccagcacctgggccttcccaataaactcaagacttgctagagtgaggcagccacggagacttcttctggggctaactacctggtcaggggctcccagagtgtaacctcattttatgtatgtatattgcctggagatctgaagaccagcaggactcctcaacgttaaacaagttgagtggattgttggtgggagagccttcctggctttgcccctggctagttatgtaactggacaaatgagtggccttctctaagtctcagcctccagttctgtggaaggaaggacttgagctagatcgtatcagtagcctccttgggctctgatattttctgaccctatgaatttgcactttgaaattgcaaatgttcctaagacacaattggaggtagaggtaatgcctgcaaaaggttagtgaatgctcataagtagaaaacatttattactaaagcaaattattactaaacattttaatatgctttgatcactttttaaggatacagaaaaggtaattgagatagtaaagataaggtgtttgagcagaagagcaagcatgcactggatagttctacttagagtgtgatcacggttaacagtcatttctgtagcattcagagtacctgaactcattataaaatgtgttacaatagcaaagatctcagaagacataataggtcataccttactttctgaaatccacacgcctgcacagacatgagcagaatgtcattgacatgtactagggaagctcagtatttataggaactttatttataggaacttctttcagtaaattttctccattaggtgaaaaaatttttgaaaaaaaaaatgtataacttgcttggttttatttgtttcatatgaccctcaatttcgtgcattaggttggcgttttgaaaagctagagaaattgttaaataatttaaacattttgctaagttcccaccttcacctgtgagaagggtcattttttttttttttaattcattcatctgcgcattgaacaagggtaaagttccgtgcctaaaaccaggtgttcctgggtggcctggaggggctgcatccctgcagggctgattgcagagcttagagctactggtactggtcgaggaagagttgcaggaaggagacaggcagttcaggaggtggcactgctgtgtgtgagctgtctgtgttttccttctcagagtgcagagaagtgctgctgccactgctgacagaccagctcagcggccagttagatgacaactccaacaagcctgaccacgaggcaagctcgcagcttctgagcaacatcctggaggtgctggacaggaaggatgtggtgagttgagtcatcactgatgctgcacagagttcacactgtcccctttgcaccagacaggagtgactccgtggccttcctattctcaggtagtttccagctccggtattagggcaggctgtgcccattttagagataattagggaggccagagcctccagtgcaaagtcagattactgctggggccttctgcaggctgattttcctggcttgcccagtgtgcgcactattgagatccctgtgactttttttttttgagagggagtctcgctctgtcgcccaggctggagtgcagtggcgcgatctcggctcactgcaagctccgcctcccgggttcacgccattctcctgtcccagcctcccgagtagctgggactacaggcgcccgccaccacgcccggctaatttttttgtatttttagtagagacggggtttcactgtgttagccaggatagtctcgatctcctgacctcgtgatccacccatctcggcctcccaaagtggtgggattacaggcatgagccatcgcgcccagcccctgtgactattcttaagaatcaaagacctgactgggcatggtggctcaggcctgtaatcccagcactttgggaggccaagtcaggaggatcacttgagtccaggagttcaagactgaccagcctgggcaacttagtaagactttgtctctctaaaaaataataataataataaaaaataaagaatcaaaggcctttctgtttttatgcagacacctcttccttcttatcctctgatgcctaacaacctgatatttctgagctgctgagaagttctcatttccatatcctcttggacactgatactttctctggaacctaatggaaattatgttttctcatcttgcgttttctctgtgacctggcccccatccctcttgaaaacacagggctaaggccgggcgtggtggctcacgcctgtaaccccagcactttgggaggccgaggtggatggatcacgaggtcaggagatcgagaccatcctggctaacacagtgaaaccctgtctctactaaaaataccaaaattagctgggcgtggtggcacgcgcctatagtcccagctactcgggaggccgaggcaggagaatcccttgaacctgggaggcggaggttgcagtgagccaagattgtgccactgcactccagcctgggtaatagattgagactccaactccaaaaaaaaaaaaaagaaaacatagggctgaacctgtctggattcaccatgtcctagaaatagtgcagcccacaggcctagcagagcccccacacaggaagctggagaactttgcagaatgtgttcactcgaacagttgagggctgagaaaaaaaaagcatcttaccacaaattatagttaccacgtctatggtggtttcatggcacaggtgttcccacagaacaggaaaaccactctttgtcatcacctaaagtctttatctttccagtatcttgggattctgtcctaccaaaggatatgaatactacaccttttcccatagctaaaccgttagttcacttgtcagggtccaccaccgtttgactacagcccaccttttctcctgctcatggtttgcactgggatgtctacatttctgtgaatccacattgcagcctcagaagtatgtgagggtaccattgccatctctagctgctccgccaatctctgtccctccacttccctaagcccctgtagcccacttactctttgcactgcttacttgatatttattcattatagatcattccccctttttttcattaagtatgtttatagaaaccacattataaaatggaatacattttctcaaagcatgttgcgattggagatttggttcctaaccaaggactttgcaccaaatacgtaaatgtgaccaatcacgtcataaactcaatacttttttaaaagtaactcttataattcaataattccttaaaataataaagtaaagctccacgccctataaatttggcagcaatgtacctggcacattggtttagccagggatcagtgttctagaaatcatatgtttatgatccaaagttaatgtaaaacacaagaatcagagcattggattctagtcccaatattaccactctgcagctatttgtccttagtcaaatatctcagtgcctcagtctcctaacccagtccattgtatgtaggaattgttctagacgacctctttagtctcttccacttctgaccctattgtttaatacatcacatctctaccaaccttctcaccacccagaaagactctttggaaatgacttgaatgtatttaaatcctgtgcaaggagatttaagttagctttttattttggtattcccaatattatgttccctgtaatgagcagagacattcaaaattatcgatcttggagctctggtaaagtagtaagtccaatcgttttttgtccatcatgatggtacctttttttcttcataaacattttgaaatatgtgcactagttcaatatctcttctcttatcctctcatctccttagttaactcaaagctctaattactgatatttgttcttcctgccttttgttttatttttttaaacattgcaggattccctcctctccccacagctctgttttggaattgtcctggttctttcaagtccagctgcagtaagcacctctgtgaagttgtctctggtgtggtcctgccaaattctactcattcttttcatgctccctttgagtttcttttgaggattttatcactttgtacattgagttaggaatgcagctcacaaatccttgggaagctgctcttatgctccaggcactgggatcagctagggctatgacagtgaactagagaagcaagcaccctacccccaggagcccaccttctagggagattcttgtgttatgcttatttaaatgtatgtcccagctgggtgcagtggctcaggcctgtaatcccagcactttgggaggctgagacaggtagatcacgagatcaggagttcgagaccagcctgaccaacatgataaaaccccatctctactaaaaatacaaaaattagctgggcgtggtggtgcgcacctgtaaccccagctactctggaggctgaggcgggagaatcacttgaacccgggaggcagaggttgcagtgagccaagatcacaccactgcactccagcttgggcaacagagcgagactctgtctcaaaaaaaaaaaaaaaaatttatgtaccactcacccgcacccccacaatagaaatctctaaaggctcagaggagccttattcatttcataccctccccacaaggcacagcgtgtaacttgcacaactatttagggccacactaaggaaatgttatgtaaatggaagtgaaagcagcatctcctggagaggctgattttatgaatcactttcattcagggaaatgggaaacaagtaaatgactaataaaaagtgaaggaggaagagaagaagggacagagggaagcagagagggagggtggaccccaggtacttgatactgtaattaaaatacatatagccataccataattgagaagtcaaaaaacaatagatgtgggcatagacgtggtgaaaggggaacattgttacactgctgggggaatgcaaattattagtacgacgactatgaaaaacagtatgaaaaactatgaaaaacagactatgaaaaacagggaatgcaaattattagtatgacaactatgaaacatgtttaaagaactaaaagtagaagtaccattcaatccagcaattccactcctgggcatctacccaaaggaaaataagtcattatatgaaaaagatacatgcacgtgcatgtttatagcagcacaatttgcaatagcaaagatatgaaacccatctaagtgtccattgaccaatgagtggataaagtgtggtatatatgcatcatggaatattactcactcataaaaaggaacaaaataatgtcttttgcaataacttaggtggagatggaggccattattctaagtgaagtaactcaagaatggaaaatcaaatattatatgttctcacttataagtgggagctaagctatgagaatgcaaaggcttaagagtgatattatggactttgtggactttccggggaaaggctaagaggtgggtgagcgataaaagactacgcattgggtacagtgtacactgcttgggtgatgggtaaacaaaaatctcagaatcaccaataaagaactcatccatgtaaccagaaaccactcgtacccccaaaactattgaaatcaaaaagaaaattcctacagccatagacaaatcctacctgatctgacttctatgtggaatctaaaaaagttagactcctagaagcagagagtagaacattctttaccaggggcaggatggggagatgttgatcaaagggtagaaagtgtcggttataggatgagcaagttctgggaatctaatgtatggcatgggtggcaatagatgtgttaatttgaccgtggaaatcattacacgattacgtggatcaaatcttcatgttgtacacgctggataagtacagtctttgccagttaaatttgtaaaagataataaaaatgttaagcaaaaaaatacaaatagcaatgatttagttatttgaagcattaagcaggagtttcaaagtatctatcataaagcaaggacagatagaggctatgaaaagtcaagttgcatgtgggtaagtcggagccaaatgagggtaatatctagctacaaaaaaggaaagaaggtgaaagaaagaatgtgtacatcagccctactaattccaataagaaaactgttactgtcccccttttgcagctatgaaaactgcaagctcagcgaagttgaataattgctcaaagtcacacatgacacagtcagaatacaaaatccttgtattagtctgctcagtcagtcttctataacaaaataccacagactgcgtggcttaaacaacagacatttattttctcacagttctggagactgagtttctgagatcagggtgccagcgtggttaagttttggttaggtctctcttcccagcttgcagacagctaccttcttgctgtgtgctcacctggtggagagagagatccacatctgtgatactcatttactaagagcatttatcccgtcagtccagggccccaccctcatgacctcatctaaccttcattacatctcaagagctgcatctcctaataccatcacgatgggggttagggcttcacatatgaatctggaggagacacaaacatttactccataacaattcccttgacttgaatttcttgtttttttccctccaacacagaaggtggtaagagctttgtatttttgcctttaatttcccacacatgtgcctaattgacctgagcaattcttttatttttatttttatttttatttttttgagatggagtctggctctgtcacccaggctggagtgcagtggcgtgatctcagctcactgcaagctccacctcctgggttcccgccattctcctgcctcagcctcccgattagctgggactacagatgcccgccaccacgcccggctaatgttttgtattttttagtagagacggggtttcactgtattagccaggatggtctcgaactcctgaccttgtaatccgcccgcctcagcctcccaaagtgctgggattacaggcgtgagccaccgcacctggcctgacctgagcgattctaatctgctcaacctcagaacagaatacgtcatgctaatgggggtcccccaaaactatttgttgagtcagtggccacagtgagctctcagtgaacctgagcaatctgagttattaagaaggcactcatccctgcacagccacattcatcttttaagtgttatgactgatcattttcaactattttcttcataaagttatatattattctgtgagaccattttccacttttggacaagagattgctttgtagggaaaagccaaaaagagatctaaagacaaaactcatctatctgaggttccttaaagaaagtgaaactgagtcagaaggaatggagtcaaatcctgtgttccctgcagggtgccactgcggtgcacattcagcttataatggaacggctgctgagaaggatcaaccggacagtgattgggatgaaccggcagtctccccacatcgtgagtatctctttgttggatcccacggccgctgctgtttctctgtcccctttgcctatcgggaggccttcggggccagtggcttgagactattcttcacatgggcctctcacatcatgggtcattggttataaccttagcagatcttgattctgacatggattttctgttgagagaaaataatccagcctaggcaatatagtgagaccccatccctacaaaaaatttaaaaaattagctgggtgtggtggtggcacgtgcctgtggttgcagctactcaggaggctaaggtgggaggatcacttaaacgtgagatgtcgaggctgcagtgagctgtgattgcaccattgcatcctagcctggacaacagagcaatagcctgcctttgaaaaagaaaaaaaaaaaaaaagcagcaagcagggagggaagggagggagggagggagggaggaaggaaggaaggaaaaaaggagagaaaagaagaaaagagaaaagaaagaaaatgatccagtatgaaccacccagcccctttgattcaaggaagaaaccaaacattttaaagaacctgtggttagcatgcttgtggaaaggccattgttggtctggcctcttattttctgtgcactctatctaaacagatgccgggtaacaactatgatagaggccataggtagctgttgaaaggctaagtggtgtcatcattaaagtgaagcatcttttacttcctatattaaaagcttcctatattaaaatcgaattagattttaattagaggacataggaaaagaactatttcaaattcctatcagataagaaaaattcatttatttcacaaatacgtatttaaaaactgccataaaacaggcactgctctggacactgaagaggtacccataaacaaaacagaaaaatcactgcctttgaggagctgacattccaacaataatgacagcagttacagcaaaataaactacatagtgttaggaggcaacaggggctagagagaaaaaaaatgagcaggataagggaagtgagggtggggagtcacacctttaaataagatgattaggaattttaccagagagggtaaaatttgggtaaaaacttgaggaaggtaagggagtgagccatgtggctatctgggaagggtcttccagggagaggccacagccatagcagaaaccctaagacatgcctggtcagaacctgtagggtgatggagctgatcctaataagaataaagagaaacgattgcaagtaaaactgtctttctgctggattaaaacccaatctctgagccgaggagttcgagactggcctgggcaacacagcaagaccccatctctacaaaaattttttaaaaaattagccaggtgcagtgattagtgcctgtacgcccagctactctggaggctgaggcaggaggatcgcttgaacccaggagatcaaggctgcaatgagctatgatctcgccattgcacttcagcctgggtgactgagtaagaccctgtttcaaaatataaaataaaacaaaataaaataaaaatccaagctcatccaaaacatattataaaaggatttagatcttgtattagtggattatcagttaactagactagtcctacatctttttctcaaggaagtatctgagggaacaaagactaatatggaaattggagaattcctcatgtaaaatcaaggcttttatctttagaacagtcagattgttggcaaggaaatactatttttttttttaccaacagaaagagggaataaaacctaaaatctatcaattactttttatttctaggccctgataatattgctgttaatcacttgtgcaaaaataaaatctatagcttaactgatctgtcttttccacccattgactattgaagggtaagaatgacttaggaagctgggtgcggtggctcatgcctgtaatatcagcactttggaaggctgaggcgggcagatcacctgaggtcaggagttcgagaccagcctggccaacatggtgaaactctgtctctactaaatatacaaaagttagccaggtgtggtgacacatctgtaaccccagctactccggaggctgaggtaggagaattgtttaaacccaagaggtggaggttgaggttgcaatgagccaaggtcacgccactgcactccaccctgggtgacagagtgagactttgtcttaaaaaaaaaaaaaaaaaaaaacaaacaaaaaaaaaaacgtaggagagaaaactagtcaaatcacttatatgttttatatgtttaaaagttgggcatgttttaacagcattgcttcactaatccctttataatttactgaaattactaacagatggagtgcaatttagcagatcaagatggaaaaaaacaggattgaagaacattgcgttatgctaaaactgatatacttttagagtattttacatattttgtgaaatttaagaaaagacaatgtaccattaattgctattgccaagccatttctatcatacattataaagaaagattgatatgggaaatgatatattggctatagataattacatacttgaattcaaatttcctgagctccttttaggaatcaaattgcatgttgtctcccttgtttaaactcactcaaggacatcagctccatatgtttgaagggaagggcaggactggatgtaaaggcagcagtactcccgccgtgcttccgctaacatgaaatgagagtgggaatgacttagatccacggagtgatggcggtgccaaaagaagcaaagtgaagtgggaatgataagcataagaaggaaaaaaagtgaggggaaaatgtacagacagacacagacagtcgcgaagagagatgtggaaaaagaaaatctacatggcttgatacagtttattccagatattcaagaatggttaaatattaggaaatacatttataaaataacatcaattcaataaaaggaaaaaagccttataattttcttcatagatgccaaaatggtatctgattattgttacattttttcccaaatcaagaagaggagggaactttttagcgtgaaatcaccaggcatcatgatactcaatggtcgttaaaaaagggaatcaagatatttaggccaagcacaatggctcacacctgtaatcccagcactttgggaggctgaggcaggagtattgcttaaagccaggagtttgagactagtgtgggcaacatagcaagaccctgtctctacaaaaaaattaaaagttagccaggcatggcagcatgtgcctgtagccccagctgcttaggaggatgaggcaggaggcttgcttgaactcaggaaattgaggctgcagtgagctgtgaaggtgccactgtgcttcagcctgggtgacagaatgagaacctgtctctatttagaaaaaaaaaggtatttaatttcaacactgttgtttagctttttctataatttctagccaatgtaataagaaaaagatactaaacataaatattgtaaaagtaaaaataattgtcattatttttagctgaaatgaccagcatatctacaaaacccaagagggtttactcaaattttagtaaaactaataaacaatttattaaactaacctgtttatttattttgttttgagacagggtgtcactctgtcagccaggctggagtgcaggggtgctatctcggctcactgcgacctccacctcccaggttcaagtgattgtcctacctcagcctcccaaatagctggggttacaagtgtgtgccctgacacccagctaatttttgtatttttagcagagacgaggttttgccatgttggccgggctagtcttgatctcctgacctcaaatgatccacccgccttagcatcctaaagtgctgggattacaggcatgagccactgcacccagcctctaacctgttttaaaataaatgatatttaatgcctgttctttaacaatggaagctatttagagattataaataagaaattctatttaatttagtcacaaaaatatcagagtaaaaataaatactagttacaaataaatagccaaatagaaataataatggggcctggcatggtggctcacgcctgtaatccctgcactttgggaggctgaggcgggcagatcatgaggtcaggagatcgagaccatcctggccaatatggtgaaaccccgtctctattaaaatacaaaaaaaaaaaaaaaatagccagttgtggtgatgcatggctgtagtccgagctattgggaggctgaggcagggggaatcacttgaaccccggaggcagagctttcagtgagctgagatcgcgccactgcactccagcctggtgacagagcgagactccgtctcgaaaaaaacaaaaaatacataataatggagagcttgcctgtcagacttagtggacacatatcagcagaacagaaccatgataagtgaaaaggagactttggattatatgaacatttcattacctttctaaagggaaaatgaaggtttttagtaaatgttatttagaaaattagttaacaatttggggctgggtgcggtggctcatgcctgtgatcctagcacttcgggaggctgaacctagcagattgcttgatcccaggagttggagaccagcctgagaaacatggcaagaccctgtcttaaaaaaaatacacaaaaattagccaggcatggtgacatgcgcctgtaatcccagctactcaggaggctaagatgtgaggatcgcttgagccccagggaagtcgaggctacagtcagccatgatcgccactgcactgtagcctgagtgacagaacgagaccctgtctcaaagaaagaaaaagaaaattagttaacaatttggaaaaaatttgttcaacttcatgctatacccacaaaataaatgtcagagtgaagtgttcaattaaaaaaagttgtatcataaagcactagaataaaataataaatagataactgatttgaggaggaataggattcatggattttttatagttaaaatacaagaaaacaattttactagataaaattttaaatccctctatatgaagattatatatatatatatatatatatatatatatatatatatgcaaattaaatgtcaagtcccaagctttaaaaattttgtaatataggtgacaggtggctaataaacttaatatacaaaagctattataagccactaagcaaagatattgttttagtagaaaaatgagtaaagaatgggtgcaaacagcaacatgagaaagctaaatggccaaaaagttcatggacagactgtttaatttagagaaaaggaaatgaaagtgcaaagtgagattaaacctctgagtattaaacctcagtgttaaattctgagtattaaacctctaatactcagaataggcaaggtcttggagaaacaaattgtgttagacaccgttgggaaaacaagctatatgataatttggcaatatatatatatcaaaggccttagtacaataagtttatactgctttataattgaaaaaataaactttttttttttttttttttttttgagacaggctctggctctgtcacccaggctggagtgcagtggcagaatctcggctcactgcgtctctgcctcccaggttcaagcaattttcctgcctcagcctcccgagtagctgggattataggtgcccaccaccatgcctggctaatttttgtatttttaatagagatggggtttcaccatgttggccagactggtctcaaactcctgacctcaagtgatccgcccaccttggcctcccaaagtgctgggattacaggtgtgaaccaccccaccaggcctaaaaaataaactttttaaaacaaaagagacagtctaaggcatacgttcagaaagagatagacatggacagtctttcattgttctgcttggggaatctttccctctgttttagaaacagctgtatgttcatctgtcctgtgctaaattcctttgtgttattttcatagctgcatgaatacaggaggttagcacccctggatctttactccctgtctaaaaaactaagtctataattcacatttttttggtctaggggatagcaccttgaatatgtaattcctgaactcacaaatggaagcagtgttaatgaatcatctagttattgattttttctcttcaagtcagggtcacaattcacgtgggtagtatgttggaacaactggctgaagggctctggagttggagaagcggtatcaggttgtattagtccgttctcatgctgctaataaagacatacctgagactgggtagtttataaattgggtagtttatagaggaaagaggtttaattgactcacagttcagcatggctggggaggcctcaggaaacctacaatcatggcagaagaggaagcaaacgtccttcatcacatggcggcagcaagaagtgccaagcaaaaaggaggaaaaccccttgtaaaaccatcagatctcgtgagaactcactcactatcacgagactagcatgagtgtaaccgttcccatgattaaattacctcccactgggcccctcccacaacacatggggataatgggaactacaattcaagatgagatttgggtggggacacagccaaagcatatcacaggtattctagcagggagttttcatcatcatcgcttgccctcctctccttcatgctcagtgttgccacctcttttcctgctagccttcctccccgttaagatttgtttaactaatctaagtatttcagacatttctccatggaattctatactacagctctgtctcaacaagaaacccaaagccccacaagttgttacatcttcactggtaatctcattgaggtgtcctgtctataggattccacacttcttagctgttaatgagatttcttcactcagacctggaaggaggtggtttgaagcagaaaccgcaaagcacgtggcctttggacctttagaatgcagcgtgtttccagtgtggtgggatacctgcgtggctcagtgggtgggaaaagccaagttcatggggctcacatagtgtttttgtcagttggtggtctaaggagtcttggatttgtgctttccttttccttccaggggagttttgtggcttgcatgattgccctgctgcagcaaatggacgacagccactatagccactacatcagcactttcaaaaccagacaagacatcatcgtaagttgcctttactggtcctggtaacctgaagacttcttaaatttggtttaaaaaaatgactgaagctgagcatcgtgagtccagggttctcttcccacgcacctccggtgctatgtggctgtccacagtgattacagaaaggagagagctgattcctactttctctctttgataggatttgaaaaagagtacaacacatataccaagaggttatcacacactttaatctctcttggatttagagagagcccttatttagcaacatttgggagatgttttttgctctgaaaacaggacttaatacttggtacagtaactactcatggcaaggattttagaaggcaggggtgtgcaaagtctcctaagacgtggttgataccatcattttggagagggcaacaaaaagaggtaatccctgccctttacaactggtccgtgtggcctgttaggaacctggccgcacagcaggacatgagcagcaggccagcaagcattaactcctgagctccgcctcctgtcagatcagcagaggcattagattctcataggagctgaatcctattgtgaactgcacattcgaggaatctaggttgccagctccttatgtgaatctcactaatgcctgatgatctgaggtggaacagtttcatcccaaaaccattcctgcccccatccgtggaaaaattgtctttcctgaaacctgtccctggtgccaaaaaggttggggactcctgctttacaatatttgtaagttatcttcagatgaaaatattttgttctctattgttttaagcaggaaaattgttctcatagttgctgtgaagcactcatctaagaagctgagttaggcctccggctgtggcttcacggcaccttcccttcaggggattattagtggcccttcagacgtccatgaaggtgttattagactttgcagagcagtggacaggatgtgccgctggattagcacactgttgtcatgttgacactagtctttggataacttcccatcatctgtgcgtactccagtctctttgttctagattttccactttctgcctctgtcatgctgagtagatggccagtgcccccatggattcgcagctccttccttgcccattacccacctttctgccatgcccacatggtggacaaacatacaaggaattggaaggaaagtgctgtttgttattattagttggttccatggtggactctcaatgccgtgttagactacgtggctttagctgaaggtctccatgagcctctgcttgggccataccctggcaggcagcatggcatgggaaccatagcaatatgtagatgtgcctgtggagaccaggcgcaagaggcccagtatggggggtggggggtggaggaggaagcccaaggttagccatgtgttctctacaggcaggtggtgtagcgggtaagagcacaggccttagaacacgcagctctgggtttgaattctgaccattccactcccttgtatgcaatttggggcaagcggtttaacctcactgaacttcagtctcctcatctgtaagatagtacccaccttgagggttaattaagtgttgcttggctccatgcatgggaaatgcccagcttcgtgcaggtaggcatgtagctaatgcctatgaggactagctgtttgtaacaataattgtattattattgctatataaagtaaaattaacaataaaaattctagggattttgtttcaaatttccttcagagagcaggcaaaatagggaggttttaaggtcaaaccgtgacaatttggctccattgttaagtaagaaaaaaaggggcgtacctcctgtttgccagcatggtgttgagctcctccagctgtattatgtaattaaaagaggatcattatcctcacgagggaactaagacctggagaaatgagggaacttgcctgaatttagtccccggtggctgagctaccgtgcacagctaggcctttgcctcccagtggcctttcagtccctcatgctgccttctgagtgaaccgcatgaaggcccttgggaagtggtggataaaaccaggctttgggattccctgtgagttccatcatgccgtctcattaatttagatttccaggagttaaatagagagtctgtatctgaagcaaataacaagtatctaaattcaatccttgcttcacaaaccatgaattcttatggatttagaagaaaagttaacagaatggccaataaattggtggaagcacttaaaatatataatgaggccggatgtggtgactcatgcctgtaatctcagcactttgggaggctgaggcaggtggatcactggaagtcaggagttcgagaccagcctagcccacgtgatgaaaccccatctctactaaaaatacaaaaaataattacccaggggtgatggcagacacccgtaatcccagctcctggggtggctgaggcagcagaatcgcttgaacccgtgaggtggaggttgcagtaagtcgagattgtgccgctgcactccagcctgggcgacaaagcaagactccatctcgaaataaataaataaataagtaaataaaatatatgatgaaacgaatttgaattcattaattatgtctaggatttcagaactgagggtgggtatgtctaactcgccataaaaccaggggagaatccacagttgcacacacacactggccggccagggagagtcattccccatgccgttcagcatccaaagtataggaagttacccagcttgaccagcatctcagaaaaatatggttagcaataggacctgggcctcctgtctctcacatactgtgtccaggcagaactgtgtaggttagtgccagagaaactggacaggactttcaagaatcccagtggaaaaggtctaaatttagctaactaataaaaatgccttcaaaacattttagctttgatttcaactctgattgttctatttctgaattagtttttgctcacagccccctttggagcagaagagctctgtatgcttaagtgattagttattagtcatcaccagccactgttacgatccattttgaaggaccgtttaggacctttcttccaggctgcacatgataacgtccctggcgcaggaagagtggtgattctgcttcttgtgtgtatcactgtgtccttttctaaccataataaaggagaattgaactgaaatctattaaaagtatccatttccccacaattgttggtgaattatgtttaagtgcatgagatacattctgacaacctgtggcagcagaggaagaaagagataagggttgcaaacttggggtccaaagctccaagttctcatccagctcttctccttcccactttctttttttccttttttcttttcttttcttttcttttcttttttttttttttttttttttgagatagagtctcactctgctgcccaggctggagtgcaatggcacaatcttggctcactgcaacctctgcctcctgggttcaagcgattcccctgcctcagcctcccgagtagctgggactacaggcatacaccaccatgcccggcaaatttttgtatttttagtagagatgggatttcactatgttggccaagctgcccacctcggcctcccaaagtgctgagattacaggtgtaagccactacacccaaccctccttcctactttctatgcccttaagtgagtcctttagtttttctcagcctcagttgtaccatttgtaaaatgtggatgattctttttgtcctcatcttccttatagggtcctacaatataaaaatcaaattgcatcacagccagctgtaagaatgctttgttattcctaaaacccttgaaagatgggctgttactgtggggctaggaacatcctgttctgaggttgtggttctgcttgtatacacgccagaataaagactatgaacgtaacccagttttcccccaaccactcctctgttctccgcaggacttcctcatggaaacttttatcatgttcaaggacctgattggaaagaatgtctatgccaaagattggatggtgatgaatatgactcaaaacaggtgagacagcccatggctggccctgaggcatttgtctgaatacctaaggctgctgtgtgaactttgggaaatgtctttaaatccctttgcctcaaacccatcatctgtaaagtgaggatcttcctgctccagaggtcctaatttatgtgctcgtgatcttgattttcccagggtaattgcctttgctccacctcgggctctctactcccttctctagcgtcgtctcttcagtgctctcatggtaattgtcatcctcaactctccactgcacctttccgtggctccacgtggcctgtgtcatcctgatattcagggctcaccagttagtgtctgttctatgaccggtccatgatgtatttaaccagattcttcttatgaacatttagattctttccattttctattaatgtgaaatagcactgtcatggccttccttgctttacatatttaaaaatatccatggttattttatcaggatatactcctaaaataatttagtagttcaaaagtttggtgaaattatagggcttttgatacacagtgccaaactaactagttgcttctgctacttccctgtgtatgctacctgtactccaaccaaactggcctctgcccagtccctgaacacatggtctgctctgcctcacaccggtcttccgctagcagtgccttccccataacctctggctgtcagcattccagctattccataaggttcttctgaagcgtcacctccagaggaagcctttctgacctggatgtcatctcttcttccttcgattttccataccccattcaaaccttcttatagaattgttttcagattctatgttgggtaatagatgtacatgttgttaatttccccaaccaagctgtaaatttcttaagatcagaaactgtgtctttcaacacagacgtgagcctgtgccttgcaattgctagcccacaacaaatacttgttgaacagaagtgaaatgaactgaatatatattatattaaaagagtgttagagtttaatgagataaataaaccattattgtaagcattattattaactctacatgatacccaattctgagtaattctactctaacacctgattagaagaagccttctctgctatgtacagattagatttaaaaaattacaccagaaaccctaagcttaaacagaaggatcataatagagtctatatatattaccctcctctgaggcttaagagtcctggtttgcagtctcagatctaccttcaattacctaaattgggatgtggccctgagtggctcttcttgtttgttctgtaaactgacctcctgtgccccatctgcggatggtgttatgctgttgtctgcaaggacactgttagattatgaggtcttatgatgccaagttcaggtttggtttggtttagttcttaatataggtgggaaaaggtttcaaaggacatacagttggcttctttatctggtgttttccttccgcagggtttttctccgtgctataaatcagtttgctgaagttctcacaagattcttcatggatcaggcaagctttgaacttcaggtaggcatgtgactcacctacctgcttctagaattcttggccatggcaagagaactatatgaatttggaaaatgtctcctcagatttcactgttttcacatgaaaaaggttttcctgtgttttttcatttcctaaagcacatatgcctgtcacactgtcctccaaacacaacaaaataggggtggtttcttctttctataaaggtaacatatgtaaaaaaaaaatcttaaagagtaatagtagaagatcaaaaatataaatagtcctccttgtcgctataaacatttggagttgaccctttgtatatttacacaaatgcacatagacacacatggctacaaataagcacacaggtaactctcctaccgacaaatgagtttggttctaaagaacagttcttatgcacagtttgttgaaagtccaaaggaattgcaaaacggatgaccgctagctctattttcattcattcattcatttacttatccattcatccatttaacaaatgttagagtacttacatgtacagggccctgttttgcgccctggtaggggcatttccctggtgaaggcagataagttccttgctgtcatggagcttaccttccagagtactctgcattttgtgggtgatgtgctttctgtgttctttgtctttgcgtgtatctgtggaactgttatcagtggaggtccttgactacagattgtccaagttcttgacgttttgaacaaaatgcacaaacaaagcaatgaaagaatgaagcaataaaagccagatttattgaaatgaaagtatactccacagagtgggagcaggctcaagcaagtagctcaagagcactggttacagaattttctggcgtttaaataccctgtagaagttttcccattggttacttggttacaccctatgtaaatgaaggagtagcatgtgaccagtctgaccctcccaccaattgtgggaggggactaatcagaggtactttcaatttttcatctgccacagagtgcaaaggggtagcctctgatccttttgttacttgggtgtggagaggtggggttttccttttgattcagttctaggaagtcagtgtgaattggccttcagtgccctgcctccaggccctgttttcctgcctcagaactttaaaagttgaaaatcataagtagaggaaagtatacacacatacacacacagagatgcatgcacatatagatgaatatatattgtatgtatgtgtatgtatatttgccaaaatggaattgagctgtgcagttctttggtactctgttaatctgttttcctttttcaatgatctgtgatcttttcaataatgttgaatattttcctgtttttaatggctgaatatcatctgttctatgactggtccatgatgtatttaaccaaattcttcttacgaacatttagattgtttccattttctattatattaaataacactgtgatggacttccttcctttaaatatttaaaaatattcgtgcttggctgggcacggtggctcacgcctatagtctcagcactttgggaggccaaggcgggcagatcacctgaggtcaggagtttaagaccagcctggccaacatggcgaaactccatctctactaaaaatgcaaaaactagctaggcctggtagtgggtgcctgtaatcccagatactcgtcaggataaggcaggacgcttgaacctgggaggcggaggttgcagtgagccgagattgtaccactgtactccagcctgggcaacagagtgagactctggatcaaacaacaacaacaaaattcatggttatttcatcaggataaagtcctaaaagtgtttactaattcaaaagtttggcaaacttttaggacttttgaaacatagtgccaaagtacatactataaatagatacacttcttggcagcagttttcctttatcccaggagtaaagaaaaatataatagcttaaatttttttaaaaagcttaacattaagtctcaaaacttttaggattgaataatcaaaacctaagaagaatgtagattgtattttgttctttcattaatctcttgttaatgactttttaccatgtgacattgttttattatggcccttattaatgttatttttcatttccctttacccacacaattaattttgaacagctctggaacaattacttccatttggcagttgcatttctcacccatgagtcccttcagcttgaaaccttctcacaagccaagcgcaacaaaattgttaaaaagtaagtgtccttttaaagttaagatcgggaaggggcttcttccatttgtttacattgagagcaatattttaggtatcacagaaattactatttagtggctacccatgttgttagtgaggtaagtcttcaactaattacttaataggcctcacattcacccaggttcagctctcttttcttaaggcccaaccatcttcccatcagtcatcccatgctttttatcaaatctgtacctggagacggaccttggctgtcagcttgcccatccccaagaacagctgcgcctctgctggcagcttccccaaattgcaggcatagtacctcctcattcatagcgcttcacaaagcacactccttcagcacagttgctccacctccctgccatttcagcagagaaagccaggtctcagacattgcattaaaatgccctccagattcctggtttggaattcaaaatggaattatgtgcagaagtgataagagatttagggaagcatttcatttcattgagagactggaatccaaagaccatgtcgttaaaaaataacttgaggaatgtattatttgaagactttgaaattttagttgtgttccccttgttgggatatctgcgatatgtaggaaaattatttagtgtccctctacttctggttcctccctcaaaaactgcctacatatacaaaaacagcaaagtattttttgctcccaaggaccaatatttatccctttgtggacagtatcactcccattgagagtgcatggtgtagagccttccaatgtgaatattttgaaaaacacgctagaatggatgtatattaccccaatatcagtctataaagtatataagtatttagtcacctgttaggcattagtcacagtactgtatgatcatacttcattcaccttccttttcatcagtgtttgccgtgttttgtttggctttgtctgtgcctcactcttctccctgaagtgagtttgttaatctcatcttctcagctatttttcagcgtttccatttggctttattgcggcacaaggtcccccggcctctgtgcgcctcattccttttgggggctcgtttaggtatgaacctcatctcttaaggttgggccttaagagtgaccaagagagacacagactgtttttactttccttcttattgtgtttatgcaattcatttctactgaaaatcctccttctagtttatgatcttcttcctagatatggggacatgagaaaggaaatcggctttagaatccgggacatgtggtataacctgggtgagtgtctagccttgaacaggcctgatcacaacctctgagtgataagcatcccacgataaagtcttttttttattttaatccagataaccctgagatgtatttgtctgtgtgtctggaagtgaaagttgatttgtgggtttcattgacaatgaactgtctcttactctggcatccacatgctatcagaatctgagtcactcacttctgaattgagttgttttaaccttttcttttcttatggaacttgtggaggaagattttaacactttactttcagtgaaataattttttaatatcttcattcactttcatttcaggtccccacaaaatcaaattcatcccatccatggtgggtcccattctggaggtcactctgacccctgaagtagagctccggaaagccacaatccccattttctttgatatgatgcagtgtgagttcaatttcagtggaaatggcaatttccatatggtaagaagtggcagaccgcgtaatattagtaaatggacatatagtcaaatcataactcatttctttctatatagagaagcagtaaccttaataatgcaagtccatgttgatctgaaagttcactttacatttcattttataaagcaattagagatagagtcagacagtgcaacccagagcctggaaaagatttttttgctacatgtctttcctaaggcaacacctgtctgtagaaaattaaaggaagttaacttcatgcattttaatcctagctgtttcagtatagcctagagaataatgtagtgaattgaatttaaaaacctatctattatagtacggctgaaagcagtgcaatggattaagttctaatccattactctgtagctttgagaatgtcattttcctggtatgtcttctctgtgcctctgttttcttatctacaaagtgtattaatattgaaaggacgatttcgcatctatgaacctctgcaaaagcaatctcactgcagagacttagacatgaaactgaagtaaaatagaaaaacaagaattattattctatttttatatgaatagttgtaacagaaagcaatgttttggataatatgtttttaatcaaatgtaatgcaaaggacaaagtaacatgagactttgttagaagattttgatagggccttggtgcacagtttatgagtgaccctctgtgatcctccctgtctgtgctggaaacagttcacaactcagcgaatgggttggccaagtctagaaagttggccatgtcttcttctaaggatgcaacattatcctgtgaaattctgcctctactttcagtttgagaatgagctgatcacaaagctggaccaggaggtagaagggggcagaggagacgaacaatacaaggttcttctggaaaaactgtgagtatttcaggaacgaaacctgaagtcagtggtgtcatttagtaatagagaaaaacaggggtcctgtttcaccaatagagcaattgagtagtctcagagtcactagggccacccccactgtggtcttcagtatggttatggggtgtatactgtccacagctgacattgtttatctcgtgggagtcaaatgctggtattttcctggccagcctggccctagagaacacagcagatggaggcaaggaggaggtgcagagtggtggcattttgcccagtgtttgaatttttgaacttcaacaaaagtattagcacttctaattataactgcaaagtaacaatttaaaggaaaaaatatttcaaggtctgctgtgtatgtaaaaaataccttaggacccataaaggacatataaccaaagcagttctgtctccagccaggttggtctttttcctgccctgtcatccaccccatccaacacatctgtacctctgtctgggctcccattatcaccactgtcccctcttcccccaccaccacactcacctataaccctcttgccctccttggcacatgtggagtaatgaagagtgggaaagtgattaaaaacacataggtgttggcctcagtgagagattgaacttcaaaccctgttttcgccacatattaagagtttggctttagtccagtgattctgcttatccaacacttcattttttttccctctccaagaataacatctattttttgatatcatcatgagaattacaggagatgatgtgctaacatagcatctgttgcagagttcatgactaataaatattggctgctctggtgttcatggttgttattattacaatttgtttttggtgtttgtttttaagagatagggtctctctctgttgcccaggctggagtgcagtggtgcaatgatagctcactaaagccttgaactcctgggctcaagcagtcctcccgcctcagactcccaagtactaggactacaggcatatgtcgccattcccagctgtttcttatttttacttgtgtagaaatggggtcttgccgtgttgccaaggctggtctcgaaattttgctttaagtgatcctcccacttcagcctccctagtagctaggactgtaggcgtgcaccaccatgcccagctggttttcatttttatttttgtagagacagggtcttgctatgttgcccaggctggtctgaaactcttggcctcaggcaatcctccagcctcggcttcctaatgggctgggatttacaggcatgagccaccacgtctggcctagtattattattattattatttacaggcctacccttcattcaggttgtaactactctagaccattgctttctcatgttccctgaacttttctagtgttgaccaactgcatctccagctgggtgcttgcctcagtcacttagttgttcacctgttcgcctgttgtgtgtgagttttgtggatgagagtctgtgtttgaggacagtgctcccaactgtattcttttttgaagattctctaaggaaccagcactctgaataccgagaaatggaattgaattgtattttcagtagagatggggtttcacgatgttggccagggtggtctccatctcttgacctcgtgatccacctgcctcggcctcccaaagtgagccaagtgagccaccgtgatggatgcctgtagtcccagctacttgggaggctgaagcaggagaatcacttgaacctgggaggcggagattgcagtgaactgagattgcaccactgcactccagcctggctacagagcaagactccgtctcaaaaaaataaaaataaaaaaaataattgaattgatgaatagtctgtattttaaaggactagaagcctttcttgttttgtttttaatagtgacaagaccttttattggtcttttttatcctgtttccattaagtctctccatttgagcttcaaacctcccagtttatatcttttgcaattctgatcttatatggaattaaatgaagttatgcacatatacacacaatatttatacatgatatgctacttttttaaatcctacagctgatttgttttacataaggatcttactttgttttcttcattcttcctagatcactaacttagaaaaaatacggatacataggtctccagtgcccaagaataaccctaaatctggattaatgtgttggacccatttctttctctttccctctccctcttttcccaggttttcttttaattatctaataagccccagaacttggctctgtgtgggtccaaagggacaggatttagactgaaagtttagcctcagtttgcttctttataactctgcatttttttctgaagctaacacttttatctaaagagccgcattgcaggagatgtactaggttcccaggttcctctaggctgggcatccatacgaggcattccagaatgttcagaggatgccctgagtgccaggccttagggagaataaagacataggaaaaatggtctcatacaactaattagagtcctcacagagcacacacgaaccttttgagcaagggtttgttgactgaataaaacacaaacaaaaacagacattgaaagaaggacattgtgtgctcagattctaagtgatgttgggacttgagctgagtcctaaagaaaactggaactcgagtccacaaagaagcgcagcataagtgaaggtcacaggataggaaggtgttgcatgaggtgtgtgtgtgtcggcttaactgtgtcacttaatatctaacattgacgttctgtgtcatcaaatcctgccccagccactgctgagaccctggtcagtgctggtcagtgctgctggaatgatagcatggaacctgggcttttgtctctccctccgcccctccaggctcctagaacattgccggaaacacaaatacctctccagctctggggaggtcttcgccctcctggtcagcagcctcttagagaacctgctggactatagaaccatcatcatgcaagatgagagcaaggagaaccgtatgagctgcactgtgaacgtgctggtatgtgacatgcctccggtgtgatgggagggtactgtcaggccgcccctgcaccctacagctcagctctaggtagatcccacaaacacagaggcgccctgaggcacctttgtggagccggtgtcttcctaagtctaattggaatggctggctcagctcacaggtatcagcagccacagaccctgaggataaatttggtgtgtttttgattgtttgttttaatttttatttcagtaggtttgggggtacagtggtttctggttacatggataagttttggggatttttttttttttttttgagacggagtctcgttctgttgccgggctggagtgcagtggtgcgatctcagctcaccgcaacctccgcctcctgggatcaagcaattttcctgcctcagcctcccaagtagctgggattacaggcacgcgccaccatgcccagctaatttttgtatttttagtagaaacagagtttcaccatgttggccaggatggtctcgatctcctgacctcatgatccacacgcctcagcctcccaaagtgctgggattacaggcgtgagccaccgcacccggctggataggttatttctttagtggtgatttttgagattttagagcacccgtcacccgagcactgtacccaaaatgtagtcttttatccctcaccctcctataaccttccccactgagttcccaaagtccattatatcactcttgtgcttttgcatcctgaggataaatatccccttttcttatggggatatttgttaaagggaaacagtgatctctttggaaaagtgaaacttttgaaaagcaacaatagtggtttgtctatttttgtgtcaatagctcttgatttatgttgggattctgtgatccttttttttcctggcagaacttttataaagaaaagaagagagaggacatatacataaggtaagctgaaggaaatttcttgcttctgctgtttatttcatggctttgtgattgatttcttcagtaaacaaatactttcccaacaccgtgtttgctgctttgagagacccctaaaagtacatgatacgctccattcaccctgaaccgacaaactctttagacagatacatgaataagtacgacaggaaggagtgcctatgtgaggtcatgtcagggatcaggggaaggatagacaacttctggcctgggtgggcaggagaggctgtacaggaagaggcaggaaaacccacccaagagtcttagcttgaagtctgcgaatccctgaacatgaaacaaacttgtacgtaaccaacgtgcatgttgttggggagagattccatagctttcattagcttcccagaggggtccaagacctaatatttaaaaacattaaacaccactgccttaaagaaagaagagaaactagtctaggtggagtcagagaaacacggaggcaggaggtgcacagtgtattgaagaaatggggaagatccgacttcttggctcaagaggaaggaattgcttctgtacagtagtggggaggggggtcaggcagggaagcaggctggggtctggttatggaatgagctgaacactaaatcaactctcgagcctgggcagcatggtgaaaccctgtctctacaaaagatacgaaaattagccgggcctggtggcacgtgccagctacttaggaggctaaggtgggtggatcacttgagccctggggcttaaggctgcagtgagccatgatcggaccactgcatactgcagcctgggcaatacagcaagaccctgtctcaaaacagaactaaaaaacctataaaactctcgagtgacaaaatgcttccttctccccttcttgccagatatctgtacaagcttcgagatttgcaccgagactgtgagaactacacagaagctgcctacacgcttctcttgcacgctgagcttctgcaggtgaatggctcagagagcttgtttcaacagggtggagtacagtgtcctttcagactaaattctatacatttcatgattttgatgggaaagaactttattccaggaatatccttttatacaagtttttttagttctttctaaataggcacagctaatttgtagatcaagtatgggaaaatgtcagttatcttttatttaaaaatccttagaaagcagagcacgacttatgaacctttggtaattgacactctaattaaagcaataaaacacacattgatgaatacataaaaaaatttgtaaaactgcagaaaactgcagaaagatgagttataagtgaatatagtaccatagaagtactctatttttattctctccctaaataaatgtatgttgtggtttagatataaatacatctatatgttatgaatcccaagtaattatttctagccctgagcaccttctctaactttggatttacatataaactttgattggccaatatgcagctcaaactgaacaaggcggtaacaggaacctttatttctcactctttgctcctccccagcccatcctacctcactttgttaccatgttactaataacattcccatccatttagttgctcaggcaacctcatagtcatcttcaatttctctcttttactcaccacctcccacattctccacaagcgagagatgtggcccctctgttcagaacatgcccctaacttatccgcttttctttttctttctttatttttttttttaaagagatgagatcttgctatgtttcccaggctggtctcaaactcctgggctcaagcaatcctcccacttcagcctcccagagtactaggattacaggcatgagccaccatgctagccaatccacttttctttatctccctgactaccaccttggtccatcccgtaagcatgtcacaccttgagcactacagcagcctcctgtttggtgtctctgcctccagttttgttctcagctattaatattcttttacagtttatattttatactaaagtaatatatgggcattgtccgaacatatgagttaaaaataggattcctatgcctcaccacttcccaaaggaaattcacaattcatatttaagtttagggcattaaaaagcttattgtataatggactgggcctggtggctcacgcctgtaatcccagctctttgggaagctgaggccagcagatcacttggggtcaggagttcaagaccagcctggctaacatggtgaaaccccatctctactaaaaatacaaaaaattagcaggcgtggtggcacctgcctgtagtcccagctactcaggaggctgaggcaggagaatcatttgaacctgcaaggcggaggtttgcagtatgctgagatggtgccaccatactccagcctgggtgatagagcaagactgtgtctcaaaagaaaaaaaaaaaaaaaaagcaacctactgtatatagcttaaaaagtgaggcttgttgactgtggatttcgccattgtatgatcagaaagaaatccccagtgtctgtaactgtaggtcttttcatttgggaaactcaggaaggtaaactctcctatcctggtgtaagatatgaggtatgaatgcagctttttttccccccagattgctattcaatagagatgctgtttgttaagtatagttcacattttgcttattggtataagatcccatctttattactaaattcttattttggggggagggaatctctttctagattgtatatgcttttacgtgggtctctgtctgttcatgtaccagtaccatactgtattaattattaattcttgatagtgtgttttatgacctggtagttactcttgattgctcttctttttcagagttttcctacctattcctttttgttaatttttccatatggactttggaaagatgaaatttaaaaattaatttagtgagaatttacatgttaatgaaatagaattttcttatccaaaagcatggtatgactttccatttgttcgagtctgcttttgtgcccttcaatggcgtgtgaaagttttctgcatataagtcttgcatattccttgtaatgttcactcttagaaatgttctttttggacttatttttgtttggttccattcttctattctgtatatttagtctccgtgtatctgaaataaattttatttcaagtatattaattgttcttcctgctgcgtaacttaattctcttattgtgtgtcgcagtttcttagtcaactgccttgcattgtgaggaatacaaccataatgtttgcaaattgtggtagttttacctcttcctattcatttttatactcctaatttgttccttttatctgactgtgttactgatgccccagtacaacgacagtcatgtcagttagcgaccttgctttgtcgctggcattttggggggatgctgtgagtgctccttcatttggcatgatactcttgttttggagctggcatgtgtatatgtgtgtatatgtaacttttgtgtttaatacataatctaaaatacaaaatcaatgagtcaaatatatatacaatattttcttgatgttggggggctgaatatttgttgtattaaccgtgtgtcgcttttcttccttttcagtggtctgacaagccctgtgtgcctcatttgcttcagaaggacagttactatgtttatacccagcaagagcttaaagagaagctgtatcaagaaatcatatcatatttcgacaaaggcaaagtgagtattggattgtttttgtactaggggaaagaggaaaatgaccgcagtatcgcaatacaattctgatgctcaccacttggagttagcactgactacccaggttcagggcactgtctccaacgagactgcccccgcttcagatgccatcttcaaatttgggggtccccagtccattcacagttctgggcaactgggtatacatctggggggcttccactgccccctcaggtttaatagtctgctagaacaaccaatagtacacagtgaagtgctatatttaaccattccagtttcatcaggaagaatgtaaactggggccagccacatgaagggacccatagggaacagtctgggagaatctcaagcgtggggcttctgtgtcttccccctgtgaactcggggcaccttcccagcaaatcagtgtgttcctcaatcaggaagctcacccaagccatgggtgtacagagtttttattggggtttcttttttttttttttggtaaatatggggtctcaccagttgcccaggctggtctagaacctagaactcctgggctccagtgatcctcctgtattggcctcccaaagtgccaagactacaggcatgagccactgtggggtttcattatacaggcaggattgaatgaatcgttaactacacaatgaacttgatctttagccttccttttgtccctgaagattgggctgatatcgcatggctcacagccctaaccttctagtcacatgattagtatttctggcatggcagcccccatcctgagactaggagaccaccatgagtcacctcattagcatagatttgggtatgatcctggggtgggggcaccaggaataacaaagacactcttattatttgagaaattctaagaaaattcaccggaactcaggaccaagaccagatacatgatttaatatacaacaataactcacagctactgtttattcttcccttgtgtattcttgaattctgagatttcagagggggacagattttgcaaacaatgattttaaaagatttaattttgaagtgtttcccaatggcttgtgggctctgcacacatttcctcagaagccagaaacaatggaacatagcaccttgtgaacaggaatgaagcaggaggtgacccgatgctgcaagttgaatagtatccgtctaagagacagctcatgaaataccaaaggggttagaaggctcaatctgggctgctagcctcagacactgaggacgtgctttagcctgtaacttacatggttatacatgctcggaggcatttcctaaaactcatccactaagtagggaaatcagtgccctgcattgaaatacagtttgccaaattccacactatcggggaaacccacccccaatatttcaacataggttctttctattttccataagtgttggccggctgataaataaagagaaagagtacaaagagaggaattttacagctgggctgccgggggcgacatcacatatcggtaggaccgtgatgcccacctgagctgcaaaaccagcaactttttgttaaggatttcaaaaggggagggggtgtaccaacagggagcaggtcacatacttcaaggggcaaaaagcagagcaaagatcacatgcttctgaggaaacaggacaaagggcaaaaggcagaaactcctgaagagggtctatgttcagcggtgcacgtatagtcttgataaacatcttaacagaaaacaaggtttgagagcagagaagcggtctgaccaaaaatttaccagagtggaatttcccaaccctagtaaacctgagggtactgcaggagactgtttattcttccttatctcaactgcataggacagacattcccagagtggccatttatagacctccccccaaggaatgcattcctttcccagggtcttaatattaatattccttgctaggaaaagaatttagtgatatctctcctacttgtacgtccatttataggctctctgcaagaagaaaaatgtggctgtttttgcccgaccccgcaggcagtcagaccttatggttgtcttcccttgttcccaaaaaatcgctgttattctgttctttttcaaggtgcactgatttcatattgttcaaacgcacatgttttacaatcaatttgtacagttaacacaattatcatagtggtcctgaggtgacgtacatcctcagcttacaaagataacaggattaagagattaaagtaagacaggcgtaagaaattataaaagtattatttgggaactgataaatgtccatgaaatcttcacaatttatgttcctctgccgcagctccagccggtccctccattcggggtccctgacttcctgcaacaccacacaacagtactgttagcctttttccatctccacaaacaacatcactacacctacacacacacacacacacacacacccatacacacacctgtacacacacatttcagaaccaaagtcccacagaaacttcccttccccctccaaccagacttgcatgctttccgaacctgggctggcagagcttcctctctactttgaagtgctgtaggtgcttgacctgttaaacacagtattgcttttttgggcgacacatggtacttattcttaatgtccgtgcaaacagaactacagaagacgcccctggcaaagctgccaatatacactgtctttatgatgtcaggaaatgaaggtttcactgatctaagggataaagcgagtgaggaatatctaccgaaactcaatcccccagaccacttgctcattcccagtgactcgccagtggcttttgccactgaatcaatgactgccttgttctccacttttaaccttactttcctttttctgaagatgtgggagaaggccatcaagctgagcaaagagttggctgagacttacgaaagcaaagtatttgactacgagggccttggcaacctcctggtgagtctgggtcaaaatatgttaggcctctgacagggttgctaaaattagcactcatgaaaatgtttccgtaagttgaaagtcaggatgaatggtgtttttttacaatggaaaagtcaactttgcttgaaatgagaatgaaaaaagatgtagtccaaaggctctgatcaatatttctgccaaatatccttcagagaaggttcaggacatctctggaagtggagtggggttgtctcgacagtgtggtggaatattgagtttcagatagtagtgactcgctttccacatccctcaggatctctgtctgcagctctctcattcttcctgaagccatttttctttctgtgggccctccatattcccagccatcagtaaagcaaaacaaaaatgagtgcccagtgttaggcagccaccattctgaaagctcagtggaggcagccaccattccgaatgcccagtggaggcagccaccattccgaatgcccagtggaggcagcaccattccgaatgcccagtggaggcagcaccattccaaatgcccagtggaggaggcagccattctgaatgcccagtggaaggcagccaccattctaaatgccccagcggtaggcagacaccattctgaatgcccagtggaaggcagccaccattccaaatgcccagtggtagacagccactcttctgaatgcccaatagaaggcagccaccattctgaatgcctgatggtaggcagccaccattctgaatgcccagtggtaggcaaccataatattaaatttaataatttctagtagaggagttagaaaagatcaggtcacccatagtcatgaaataatcatttatttgaggagctgggtgtcaagatcactttgtaaaaagtttaccagtgtgctattaccagcccctggcttcacatgcaaaaaactgacttattaatttcatcaactgggctgggcacggtggctcatacctgtaatctcagaactttgggaggccaaggcagatggatcacttgagcctaggacttccagacgagtctgagcaacatagtaagacaccatctctacaaaaaatataaaaaattagctgggtgtggtggcaccttcctctagtcccagctacttttgggaggctgaagtgggaggatcacctgagcctgggaggtcaaggctgcagtgaactgtaatcatgctactgcactccagcctgggcaacagaatgagaccctgtctcaaaaaaaaaaaaaaatttcatcaactgaactgagctgaaatattagtaatgtaacatgttacataccggtctaagaaaatagtattttgacgagaccatcacctagatagaagagtaatggcatgctaaccattgtaggggagggggctcaggtcattgctcaaagctgtccacgtctggctggctattttgctttctttaaggctgaccttgtgagccaaagctggaaagcccctcatcttgtgaagaattaaagataaagatggtagcagatactgaaaaaccgaacatcaccaccaccttctgggcacttataatttaccagacactttcatccagaccacctgcatgaactacacagtccttctttttaaaaatgttctttattttattattattttttcaaaacagggtctcactctgtcacccaggctggagtgcagtggtgcagtcatagcccactgcaaccttgaactcctgggctcaagacatcttcctgcctcagctgctggctaattttttaattttttgtagagatggagtctcactatgttgcccaggctggtctcaaactcctagcctcaagcaatcctcccacctctgcctcccaatgtgcaaggattataggcgtgagccactgcgcctggccttggaaggttctttatcttctcccatgggtgtctggttaagtgcagccgccttctgtgaatctcagaatgcactttttaaccttttgtagtccctgagcccactttgagaaactgctgaaagttgtgcactgccccgttacgcagaagaattccaacgtgcacacacttcagcatacaccctcagggagtcacagccttccaacgtccattcatggagcccaggtccaaaacctgtgatccgagaataggataacccttttctgcccatagggtgttttccaaagacctttcattgctctgggttacgtgggaaacaacaaaacaaagtctgactttttttttcccccaactgtgtacttataacctccccttggaatgtcttgttttgttttccagaaaaaaagggcctcattttatgagaacatcattaaggcaatgaggcctcagcctgaatactttgctgttggatactatggacagggctttccttctttcctacgggtaagaaacctgatggtggtctcccaggccattaggaggagggaagagactcatttcttttccagatgggcaacagggtgttagcagctgccgacccgtgttctcgctgtgggaggtaggggagggaaaccacttcctgagcagccggcctcttcaccccacacccccggacacccgtggtgttctgcaggtcttttgtgaaatgacttttcccaggtgcagtgaaaaagggaaaaacagaaccatcccccgcactggtcagctgctacgggtcacgccagggaaaagtgtggactgatgtatttcgttgtttaccatgtttctagccagagctaatttgaaaataggtatcccaagaaccagactgcaggagtatcccaaaataaaacattttattataataataatgacaaggatggtatttttcttccatctcaaaattgtgtataatgcgatattcaatttatagtttaataaataaaaattcttatctcttacgaaaagtttcttttagagctgagctttgcttaaacatttattatccatctgctttctcctaatttgaaaacaagcgataaagcaagcaatttacattcctaacagtgcctaatgagacagtttattcattcagtcagtaaatatttattgaacatctactgtgtgccaggcatagggaaggcattagaaagatcttgctgattacagtcaaacatagtccctactctcatggattttacaacctaaactcatgaggggagattttaatcacacatgaatgtaaaatttaatctgcatgtcggacgcagtggctcatgcctgtaatcccagcgctttgggaggctgaggcaggcagatcacttgacgtcaggggttcgagaccagtgtggccaacatgctgaaacgctgtccctactaaaagtacaaaaattagctgggcgtggtggtgcatgcctgtaatctcagctactcaggaggctgaggcaggggaattgcttgaacccaggaggtggaggttgcattgagccgagatcacaccactgcactccatcctaggtgacagagcgagactccatctcaaaaataaataaataaataaactataaccaagaaagataccctgtgctataagaatctgtaaccaggaagtatttacccaagtgaaatagaaacttacccttttacaaaaaatgtacaggaatatttatagcagctttaatcatagtcaccaaagacaggatccaatccacgtgtccctgaactggtgatgggataaacaaacttcagtgtatccacacaacagaatactgcagcagccaaaggcagtcagctcctgatacacacaactgcgggcatgattcccacccacatgcagcttgctaggtaaaagaagttacacttaaaaggctgcgtactctgtggttttatttatacgaaattcttgcctaggcaacgcttcctatcaggacagaaagtagatcagtggttgctggccagggggaggttggctgcagaagggcctggggaaatttttggtggcagtgaaactgttctgtatcttgattgtggtcctggttatgtttgtcaaaactcacagaattttacactaaaaggggtccattttactgtatgtagattatgtcttaatattattattttatttatttatttatttatttatttatttattttttttttttttgagacagtgtctcgctctgtcacccaggatgaagtgcagtggtggaatctcggctcactgcaacctccgtcttctgggttgaagcgattctcgtgcctcagcctcccaagtagcagggattacaggtgtgcacgaccaggcccagctaattttttgtattttagtagagatggggtttcaccatgttggccaggctgatctcgaactcctgacctcagttgatccccctgcctcagcctcccaaagttttggaattataggcatgagccaccgtgcccagcctatgtcttaataaaaaaaagaatcagggcctggcacagtggctcacacctgtaatcccagctacttgggaagctgaggtaggagaatcacttgagctcgggaggcagaaattgcaatgagccgagatggtgccactgcactccagcctgggcgacagagccagactccatctcaaaataaaataaaaaaaatcaggaaagactttccagggatcctctgtttcagctgcaacctgaaaggtaagctgggagtggagcaggtaaagggggtaggaataagcattgcaggcagaggaagcatcaggcaagagcagggcagtgccttgaaaggaagggccagtgcagcaggcacagagagagctggggtgccagcggggaggcggggagccctggaagagcctgcagggccttggggtttcctggggtgttctgtctacatcctgagagcagtgggagctgctgcagacttttcgtgttggaaaggtcatctggcttttgtctccatggtcatccatggagaatggatgggaggtgctgcaggtaaaccactaagagaccattgcagatgttcagaaaagagatgacaggctagactcgggacgtgggggtggtggctttacagagaagcggaaatactagaggggtggagatgaggtcacagccatctgatgattgatgggctgtgtgggtgaggaagtgagagttgtcaagaatgatttctgggcttctggcctgcatcattggagggggtagttgaaccatttactgggacaggaggaccggaaaaggccagagtcacagaggagagaatgaatttattccttgagtaaatatttattaaactcctaccatatacttggctctaatataggcatgggagcagagtcaaaacgaaccaaaatcttgaaattatctagcttatgttccagcttggagagatcaaaaaatgagataaatcaataaactatttagtatgagagatggcctagaacactgcctcctacagtgtagctactcagtaagtatcatggagaaaaggacttagggaaggggactagagaggcaggtgttggggatggagttacaattttaaatacagtaaacaagaaagacttcagaaagaaaatggcatttttgcaaaaaccagaaaaaaagttaaagaataagctatgcagctatcaagaggttgagcaaaggtcccagaccttgagaatagcaggtccaaaagctatgaggctggagtagttgtgtacaagagggtgtataggagaatggggcaggtggctgttggtaccagatagcagagggcctcccagggctttctaaagtgtttgcaaagtttggttttgcacgtactcaaggggaggtacatttggaacatccaaaaggcacaagtcaaccattagctgtatagatctggaactcaagtgaagttacagacaggagagaaaagttggtgagttacttgtatggagttaaaataaccgtggttggggatgaggtggaccaggcagaggaaagaataaagagtggaaggtctgaggccaagcatggtgactcatgcctgtaatcccagcactggtaggccaaggcaggagtcttgcttgagcccaggagtttgagaccagcagtttgaggccagcctgggcatcatagcatgaccccgtctctataaaaaaattttttaaaaattagccaggcatggtagcatgtgctatggtcctagctactcagtaggctgaggcaggaggattgcttgagtattggaattagaagtgacagtgagctgtgatcaagccactgcactccagcctggatgacagagtgagaccctgtctcaaaaaataaaataaaaaatagaaagagtgtagggtctaaatgcatcagggtctagtgttagctcagcttcaatccaggtcaacataaaagaacaacccctgccatagccgttacatatgcctgcatgtcccatgaaatcagaaatgtgaccacagagacagcagtgattctgtgaaatcaagaacaccagactttcaagtcgaaagcattctcgtctaaatcacctgctgagcgagtgtgcaattttggtgaaatcacgtaatcactgagtcttggttttctgatccgtaatttagaaaaataatgcctacatcgcaggaaagttttgagaattaagttaatagcatataggagtgctttataaactgtaaagtagtttagagatgttaacatacctcaaaggcatactgtagaatataaaatcctcaggagtgatataacctcactgccactctcttctatgggatatttccctgaattcagaatatttaaaattacatcatcctctccttccaacccaatgagatctcattatctcttttgtttctgtcaggggtaccactgttcttcctactccaagaccagtgacttttttttttttttttaagaggtctcgctctgtcatccaggctgaaatgcagtggtgtaatcacagctccctgcagccttgacctcccaggctcaggcaatcctgcctcagcctcctgaggaggtgggattacaggtgtgcaccatcacgcccagttaatgtttttattttttcttagatatggggtctcactatcttgcccaggctcaagaccagtgatctttgaatcagcgtcgactcccctgtctgccctgcccttctcccgacaccaaagaagcaaacactgaatgctgttacttctgtctctccttctgttacttttccttcttctgctcagtccagcctgtgagctttcagttgggcatagatgccactgttggcttacattgtctacacttcttctttcatcatgcatctcctgccttccagaacctccagtgaacattccaagtctttgaaacctctgcctgccatgcgagaccattcattttctggctcattcttccagtccaagctcatttcttctcccagaattctgtgctttccgcccctgggcctgactctttccacatacccacctggtccttcgcaccccttctctttacgcttccttatcccattcatctgtctatgcccatctaaggcccatgtcttgcttgaagccttctctttccagtcgagctaattcttcctgacctgcttctgtgattccttttacagttatcgtctgcatcatacaactagcgttgtattacactctgatcctttacccaccattgtttcatctgaatgatggaatttcaacaggcttgagtcccatagacttttcctaacttggaaaagttttatcatatattccaaaagatccagtagtttttactcccttcattcagtgtttgcctggaaagtgtaattgccctcacggtacttacactatcatgtttactaatatatttacttgcttgttttttattctctcctctagaaggtaagttctgtgagagcaagatcaccattgtattcctgttgtccagctgatcttctctttgtgcaatacatatttttatatgaatggacaagtgattttgaaagacattttacaagacaacctgggcccaagtgttgcttaaaaaggaatcatgtgtgggctaccaatggaaactgctcatttcaaacatggctatgtttgcacttgcccaggcaaccacacctgtgagacaaattactcccatgcctggggcctaggaaatctctttggggaaaaaaaaatgattaaagagattatatttacagtctagagtggagaaaatagtatttaatgcagtaattttctattagactttcaggattggctggggactgtggtacattgcttctgttctctgtcactctgtttctgtgccagaagacacattgcttctcctcattctcttatgcagtgctgtttaagtggtggtccacaaattgttgctggatggtgatgagatcgattaggagtttatacctcaatgtaaattaatgcacttccttccttccttaagaatgtcttgccatgaaaatatcagcatgcctgtggatgtcattgatttaaatgagggcacaagttccgtatttccttgcagatgggtccagactgtttgcagactggccatggtccttgggccacactggaagaagaactgggctaagtattttttatgcctgtgatttaacttctccaataaaccgcagctcttgtaggatatgatggtcgctgtcaggcaaggactagattttcagtgagaacttgatggtggggattgaacgttggctggggagtgcagtggctacctcagtacccggaactccagttgcctctccactcttcctatgtaatgacttccctttctgtgtctcacctgcagaataaaatcttcatctatcggggaaaggagtatgagaggcgagaggacttcagcctgaggttgttaacccagttccccaatgcggagaagatgaccagtaccacgcctcctggggaagacatcaagtcgtcccccaagcagtgtatcctttccggggggagtatggccccgaggctcttatggctgtgcacagccccagctaagccagagaacataggagctacagtcccttctctgcagacacaccatcttctcaagcattctgacacaggttcccattccatgtaaaatctttgggaccctaatagcattagctggtggtgatgacataacaaaagaggagagataatagacaaatgatggatatgaaatatacttcgtagccagatggggagcttaagtggaatatatactttctattgtgaattctggattctgttgtagactttgagacagtatctctgtcctggtgggttggggagctaagactttctaagacttgatcattaaatcagagcaggagcgcttacacttgagctgcttttgaagcctaactttaccatttaccagttgtgtgatgttggattttaacctctcttatcctcagattctccatctgtgaaaagagaataagaatatccctcatgtagagttgttgtgtatagtagagataacacattcaaaatacctagcacagtgcccaactatggcactggataaacagacgggatccaaagataaaagtaattcttgttgcctgggctctgattctggtgatttcagagggatgcttgtcccaagaaattgtttaaatccatttctaagtacctatttcctgatattgcattgatgtctatttccctatggcaaggattgtttgccagatgtctgaccgaaaaaaaaaaaagggccctaggattaattataatcactgaataaggcattccagtgatacacaaaggaactcccattttcagtgtggtcctggcattggggtcaaagggagtgattggtgctggtggcatttccggctgtgaagcaggaggaacaggggtgtttggtgtctgacaccttcacgaccccagcccctctcctttccttaacgagctcttcagacatgcagtgcttcactgtaaagccagtgatgagcttgccgcccagctacaaggataaacctgttccagagcagatcttaaagtaagtggtttttcatttaaaaaaaaaaaaaatctgtgtctaggcacagtggctcacatctataatctcaacattttccgaagctgagggaggagtattgctcgaagccaggaatttgagaccagcctgggcaacaaagtgggatgctgtctctacaaaaaagagaaaagtttgtctctccctcacacctgtttggagtacatcaaaaccaaagccttacatttattacagtttgcaagacctactgtctgttctactttgagtgtaagataaaagcttggtaatacaaagggatgtgggggttttggtttttttaggcagaggaaaatcagaaatttcacacctagcttacagatccctgagcttttattttcacccaaaagcatcgcagaggagtggctggtccccagtgatggaggggctcattccttgtcttgaaaagctgaatgctaacagtattgaaagaactgttataaaactagactaatgagatcacaaatgtatgtgtaagtgcatacacctttttttttgtttttttttgagacggaatcttgctccgtcacccaggctggagtacagtgcgtgatcttggctcactgcaacttctgcctcccaagttcaagcaattctcctgcctcagcctcccaagtagctgggattacaggtacacgccgccacacctggctaattttttgtattttaatagagacggggtttcaccgtgttgcccaggctggtctcaaactcctgagctcaggcaatccgcccactaagagacagggtctctctgtcaactaggctggcatgcagtggcacgatcatagcccactgcaacttcaaactcctgggctcaagagaccctccctcccacctcagcctcctaagtagctgggacatacaccaccacacctgtgtgtgtgtgtgtgtgtgtgtgtgtgtgtgtgtgtgtgtgtgtgtgtgtgtaaatgggatcttgctgtgctgcccaggttggctggtcttgagttcaagcgatcctcccacctctgcctcccgaagtggtaggattacaggtgtgagccaccacacctggccacatataccttttaaaattgtgtgctgtgactttgaggctgaggcgggtggatcacttgaggtcaggagttcaagaccagcctggccaacatggtgaaaccccatctgtactaaaaatacaaaaaaattagccagtcgtgatggtgcgtgcttgtaatctcggctactcaggtggctgaggtaggagaatcacttgaactcagaaagtgcagcctgcagtgagccaagatcgtgtcactgcactccagcctgggtgacagagttagactctgactcaaagtagataaataaataaaaataaataaataaaattgtgtgctgtgaaataaattcctaaataatataaaagtaaggtgtgaaataaaatcaaattgtacactttctcaggccttcatgtggaggcactattgattatgagatagcttagtgggtaaaactcagaccaggcagatgtgttataggttttgttgaagtcaagtcaagcagtggttgttctaagagagaaaaatacagcattgctttgtccttctccagctactacagagccaatgaagtgcagcagttcagatactcccggccgttccggaaaggagaaaaggatccagacaatgaatttgctgtgagttcaccccttttgtcctttaagaggtaaaattaacgggctgagcacggtggctcacgcctgtaatcccagcattctgggaggccgatgcgggcggatcacgaagtcaagagatcgagaccatcctggctaatacggtgaaaccccatcggtactaaaaatacaaaaaaattagccgggcgtggtggcacgcacctgtagtcccagctactcgggaggctgaggcacgagaattgcttaaacccaggaggcggaggttgcagtgagctgaggtcgcaccactgcactccagcatgggcgacagagcgagacttcgtctcaaaaaaaaaaaaaaaaaaggtaaaattgacatcccaagtggagatcttccacctacctaaccagcttccacaggagaaacgatggcacccctgggaacagagacttcacctgctaattacctagacagcaagtactaattacctagacagccagctgtcatctccatggaaaatgctagactaggagtccagaatctggtctcttcctgggcctgctgcttgtaatgaccttgggctagtcatacctctctagacctcacatttccctctgtagggtgagaagtcccaagtagacgatccctttcagctttaaacatccagaatccttgaattttatgagaaaatttggctcagtctctacgaggcatttgagaatagaatctcacttaagtgaaccagggagtcttgctgttttccctgggaattgaccaacatttcatgttttcctcctgggaattgaccaacatttcatgttttccttcttgccaccagacgatgtggattgaacggaccacgtatacgactgcatatacctttcctgggattctcaagtggtttgaagtcaaacagatttcaacagtgagtcatttgaaattggcatttagaaaaaaactttctgtttccaaatataataacagcctttgttgaattccctctgcagttcacaccagcttggccagcctcctctggccaactttgtttttcaaaagagaaataaaaggcatgcttatataatagagctcctttgtaaaactgatgtgacaacaccagccctaaaggtcaatcacagtgaatgactcttttatgtccagaggagtggtgtctgctcagcgatcctgccagcacccagaaacatttttggaatgctgctttggagtttcttgtcaattacatcttccctcccaaagcctgttctcttcttttattctctgctaatcatatccacagttaccctagactcctccctcttcatctcgcccaaaagctgcttattttacctgtttagtattgattaaatctgttttatttcccacctcctcattggcctccctgccatgcatggccttctcaggtccagttacctcactgcctcagtgggaattccattaaggaaatctcaccatttcgtccattctcgtgcttaaagtccttccatggctccaagtacctggagtataaagcctgtcctccttagcacacacacgtatggcctaactcttctgccccatctcctaggcaatctgttggaaccatactgttcatcccatgctaatttcagtcctctgtgacactggatcgttttctctgcctgaaacacactcttgcaatttctgcacctaactaactcccatcaaggttcagtttaggcaccagcttctcaatgaatccatctctggaacacccaagttgggtgacctgccctttgtctgtcccctgtggcatcctgggcgtgtttctaacctaccatgtttacatgtcctgagaccccgctaacaccatcagctcctccaagccatgaaatacatacatcttaatcacttttgtatctgtggtgcatagcatggcacttagcctaaagtaggtgttcaagaaatgtttcttgaccaaagctgaactgaagtttgatgtgttataagtcatggctaggtacagtggctcatgcctgtaatccctgaactttgagaagccaaggtgggaggatcacttgagctcaggagttcaagaccaccctgggcaacatagcaagacccccacctctacaaaaagaatagcagtatgtggtggcatgtgcctgtcatcctagctacttgggaggctgaggcaagaagatggcttgagcccaggagttggaggttacagtgagctgtgaataattgcactactgcagtccagcctggtcaactgagtgacaccctgtctctaaaagaaaaaaaaattagacattattcctcagttatggatatgaattttggatggagacttttggaatcaagtctggaataggaggtcatgttgactgataatgggtaaaatgaagaaggagatactttttttttttttgaaacctgattttgtagacatttccataggaagaactctctgaatctgtactgtgtctcattttcttttcattcaaaattcagcctgtatattcgaatacatcctattatttctgacttctgatacacatagaattcatactaagattatgtatggtctgaatgcatggcctccaagatcacttacctcttttcatggaggaagcatcaaacgttttgccagtggacattcttggtggttcagaagtgactcagatctgatatcctgctgttctcttgtcgttgatcttctcaaaagtctccaaggaagtgttgcctaggaaatgattcttactacaggtccagttcttttcttctcaaattttctgtagacattttgtccaaggaataatcattaccatagctccaatgtttaagtcatcattctactttgtaaggagattttaaatagcttattttgtatcttaccactattccaaaaaattgtggtgtccttataagctagcagtccccaatctttttgacacagggactgctttcctggaagacaatttttccatggacctggggtgggaaggtggggggtgttgggggataggggatggttttggaatgattcaagcacattacatttactgtgcactatatttctatcattattatattgtaacacatattgaaataattatcatgtggaatcagtaggagccctagcttgttttcctgcaactagaaggtcccttctagaggtaatgggagacagtgacagatcatcaggcattagattctcataaggcatgcacaacctagatccctcgcatgtgcagttcacgatagagtttgcactcctatgaaaatctgataccaccactgatctgacagcaggcagagctcaggttgtaatgcgagcgatggagagtggctataaatacagatgaagcttccctcacttacctgtcgctcacctctggctgtgtggcctgtttcctaataggccacggactgatactggcctggcattttgggacccctgctataagtctaaccttgattagcaaatcttcccttttctatagcttgtgggcattttatacctcttcaagggaagagttaaacttttttcagtctttacttggagctgacaagtgtcctctttctcccatgtgctctgtcactcaggaagagatcagtcctctggagaatgccatcgaaaccatggagctgaccaacgagaggatcagcaactgtgttcagcagcatgcctgggaccggtccctctctgtgcaccctctctccatgctgctcagtggcatcgtggacccggccgtcatggggggcttctccaactatgaaaaggttcgcttggtcccagaatcccctagggattcacagacctgggtgtctgtgtgcctccctctgtgccatttgccactgacaaattcatttcctacagctgctctaagaaatgttcactttcccttctggcaagtgaagtgaatgaaacgattgtccctgacttcttagagactatcagcaacccagctggtatagaacttacctagtaaagcgtcacagaaaaaaaaccaacatgcctctggtcaaagcacctgttattctgtctcccctgagggttatacaaactgattggtggaccccagaacccaggcgcactggaaatgaagcagcatctctggggatggcagagccacactctctttagaattagcttctaggggccaggtgtagtggttcacacctgtaatcccaggatttagggaggccaaggcaggtggatcacttgaggtcaggagcgcgagaccatcttggccaacatggtgaaaccgcgtctctactaaaaatacaaaaattggccaggcatgatggtgcatgcctgtagtccgagctactcaggaggctgaggcacgagaatcacttttaaccccagaggcaaaggtttcagtaagccgagattgggccactgcactccagcttgggtggcggaattagcttctaggacccctgcctgacttggtgtgccagaggttgtatggacaactgatggccctgactctacaattaaattagttcaactaagtattcttagttgagacatgaaagcagtacttggcacaatttaatccatgggatagggttaggatgtaacagcatttaaaatacacatcatgcattcagtgtatgttaggtataattaatggaggcagaatttttcattgctgtggtatgtttacagtggttaaatattttttgaatataaactttttggatataaatcaacatttgtcaaggacgcccctgtggagccgcctggagagtgggtagaaattaaaggagccagaggggaagggtgagcagcattaattgggtggcactcttgtgtccgtgtgtgtgtgtgtgtgtgtgtgtgtgtgtgtgtgtcccgggaagagcaggagctttgcactcagttgctcccaggacccagttctggcttccaattggccactgtgtgctctgggcaacatgcttcacctctctgagctccatatatctgcaaagtgagaagaatgcctgacttggccaggcacggtgactcatgcctgtaatcccagcactttgggaagccgaggcgggagatcacctgaggccaagagatagagaccagcctggcgaacttggcgaaaccctgtctctaataaaaacataaaaaaatcagctgggcgtgatggcgggtgcctgtaatctcaggtactggagaggctgaggcattagaattgcttgaacccgggaggtggaggctgcagtgagccaagattgtaccactgaactccagcctgggtgacagaacaacactccgtctaaaaaaaaaaaaagaagaaaaatgcctgactcacaagatagatcacaggatggtttggaagattaagggagacatcctgtgtagaaggaacatcagacagtgcttgacatagagtcgaggcttcaccagtgttggttttcttcctgcctacttggagcagacggtgtaattggaatgttcttcatgggtggtgacatctatgctctgtggctgccactatgatcgtcttctttctgtcctttttctcaggctttcagccttctgtagccttattatactcagcagctgggaaagactcaacaccagagacaaattctagtttctccatgttaggtgccataataatatccagtgttacaatggcagtcaatataaaaataggatctaatatacactactttttaaatactgtaatactttcagtgtgtactttttcatatatattgtttgatactaatcttcatgtattttttccaagtattaatttttacagaatacccctaatcacagatttatatatgccaatatctgtgactgacacataatatcatatgaagtttttccagcgtgacagtgttctaattaaaatgaacaaaaagctaggataaatacatacatacatacatacatacgtacatttcgggacctttggcttaagatactaatgtattcatttagttaatatgtatgactgcacatttctaaacgtaagaaaaaggtaaactcattaatcaccatgatgtattgcaatcagtggggtagcccgtcattacatatttgatgtaatatgtaatggtaataggtagtaggtaaactattctaatccagctctttattcatcgccaaaatgataagaacacaggagctgtgtgctgtaattcatctcccctttctgttctgaggcagaaccctactagaaaaatgaatttcagggctctctgctccagtgttccctgatctaaccaatactttgggaatttccatgtgtcctaccatttaccaaaaacaaaattgttacaactttcaaaaatttcaagtacttgtatttgaaaggtaaaagtcaatgaaaacttaagtaaatactcctttttcatttatactgacagtccctctaaatacgatcctggctagaatgagctgttttgctaatgtattatattgtcatgcttctttttctgataattatttcatatatattcatattctctgttgtattagtttgctagggctgctgtaacaaagttctccaaactgggtggcttaaaacaacaaaaacttcttgtttcactgttgcacgagcaagaagtctgaaatcaaggtgtcacagtgttggttccttccaaggatgtgtgaaagaatgttccatgtctctcgtcctggcttctggtgtcttcttggtgctccgtggcttgaggatgctcctccatgtcttgtcgatggccatcttcttgcatctcttcacataatgttctcccagtgtttgcacttctgtctccaaatttcccctttttataaggacaccagtcatatgggcttaagggcccaccctactccagtatgtatgacctcctcttaactaattaaatctgcaacagccttgcttccaaatagggtcacattctaaggtaccaggcattaggacttcagcataggaatttgggggacataattcaacccataatgtctgctcgcaagataggctttgcacatactttgtttgccacgcaaaatgggccattcacttttataagtctgtcctgtagttccaggagctcttggttttatataatggggggtttggctctcaaggcattaaagcagaagaccgaaggggaatctgaaggctggtcttcgaaagcactttcagaaatgaatgttaaggtctgggaagaaaacatgtcactccaattttggagtctgttggaaacgtttgctgcaaacttctatttctctttcctgatgaattctgtctttaaaacagtaccctatataaggcctgtgtttggaatttaagtttgggttttatttacctgttacagggacttagctggggggtcatgagtgtttactgatgagcctggtgctgatatataataataagggcaaccagcatttaatatatttgaaatgtcttcacatctacatctcattttctttttaaaatagcacttgggataggggactagtaagaaagtgcaaatattaaccttcacttaatataggaaaaaagcgtgatatagccaatgtcacgggacgagcagaaaaactgtcacctccatcttctgttttttaactttttgctctttcccttataatatctatgcacttaatttaatgattagccttgagatattgccatttcgcctttgctttgttctttgggaaagttattttaacgaatgacgttttgctttgttgatgatgattatttgattagtgtgtgtgtgtggtgggctggtgactgttaagaatgtagttttgctaagaatttgctaattaaggaaagaccacacaatagcacacacttttttgcattgtccaacatagtataagagctgtctgaggaaagggatgcatttttagttagacacatctggttcttccgcacaggacacatgtttcacccttccaggctttcctgcacagataggaatgtgttctaattaaaacttgcatatgcttttttttaggctttttttacagaaaagtacttgcaggagcatcctgaagaccaggagaaggttgagctgctaaagcgactaatagcattacaggtacaggacggctttcctctacactcccagggaggccacagtgtgggacacccattattctccagggcttaagtctacaagcccactcagggtgacttttctttctttttttaacccttgtgaaagcaccacctatctatgtatttgtttgctcggccggcagttaaactgcccagggttgacggagccttcttaaagctgagatcaaagttcatcggctggggccgggcccagtggcttatgcctgtaatcccagcactttgggaggctgaagtgggtggatcacctgaggtcaggagttccagaccagcctggccaacatggtgaaaccccatctctactaaaactacaaaattagccaggcatggtggtgcatgcttgtaatcccagctactcaggaggccgaggcaggagaatcatttgaactcaggaggcagaggttgcagtgagccgagatcacgccacagcactccagcctgggcaacagagtgagactccatctcaaaaaaaaaaaaaagaaaagttcatctgttggtttcctggcatgtgtttccagctgagagatgctggcctcatttttttctctcaagacttcagtgggcagtggtagaaaacatgactaccaaattcagtctaagacttaaacctatcagttgctcatccacggaagtgccccaggactccgttagatttgcctcatcccacagtccttccccagtttagggccaacctgtattcttggtgtgcacattttcccacatcattgaccaaagtccatccagtccacaagtcctacactgagaagtggccttcccattggccagcactatgtctagcagtttacctttccaccccatccctcccttccccaaccaaatcaaaacgatccctcttcctgaagcacactgcactcattttttgcccttctttccagatgcccctgctaacagaagggatccgcatccatggggagaaactcacagagcagctgaagccgctgcatgagcggttgtcttcttgcttccgggaactcaaggagaaagtagaaaagcactatggggttataacactggtaagcatgatctaagtagccttcacacctttttctaggctctgtgaccttttatgacactgattcgtttttcagatgccaagtgagttgtaataacttagctatggcatggaaatagtgaggctggtgggagagagtgtgttcccctcttggtgaccttgagcagtccttgtgctggtcagaggttctccaacttgaacaactatcagaacctcccagagcgcctgtgaaaatacagatggctgagccatcataaccctggagtttatgattccatagatctgggggtggggcccaagtagttgcaattctgagaagttcccgggtgatattgatgctgctggtctggggacaacactttgagaaccactgtactagaaatcaggccaggtgcagtggctcacagctgtaatcccagcactttgggaggccaaggagggctgatcacttgtggtcaggagttcgagaccagcctggccaacatggtgaaacaccatctctactaaaaatacaaaaaattagctgggcatggcgtcaggcacctgtagtcccggctattcaggaggctgtggcaagagaattgcttgtacccaggaggcggaggtttcattgagccgagatcacaccattgcactccagcctgggcgacagagcgagactctatctcaaaacaaacaaacaaacaaaccaaaataactcaaagttttctgaatcctagacactggttattcttgtgctgtctggccaaattcttacattttttcctaatcttagaaatagtatctattttgatgaaaagtatacagttttcacgcctttgaagggaagaaggaattgtgaattacatttcatatgcatgtagctgctttcataattgtttttgacgagctcctcacagctacaattttcttttctcctcctgagcagttcagtggatagtgcgtgtatgtactaaccttttctctccagtgagtgatggtgtaatacgttctagctctacttatctgcatttttttctttgaattcatcctgttctctttaatggtcttattctttttgttttgttttgtttttgtttttgagacaggatctctctttgtcacccaggctgaagtgcagtgcgagatcacagctcactgcagccttgacttcccaggctcaagccatcctcccacctcagcttcctgagtagctggaactacaggtgtgctccaccacacccagctaatttttttttgtttgttttttgagacagagtctcgctctgtcgcccaggctggagtgcagtggcacgatctcagctcactgcaagctctgcctcccaggttcacaccattctcctgcctcagcctcctgagtagctgggactacatgtgcccgccaccatgcccagctatttttttgcatttttagtagagacgaggtttcaccatgttagccggaatggtctcaatctcctgaccttgtgatccgcctgcctcggcctcccaaagtgctgggattacaggtgtgagccaccgcgcccggcccacacccagctaatttttaaaacttttttgtagagatagagtctccctatgttgcccaggctggcctccaactcctggactcaagcaatcctcctgcctcagcctcccaaaatgctgggattacaggtgtgaaccagcatgcccagccctttaatggtcttattcttaaaccccttattttcacattatttcctcaaaccaaagctctgagtttcttttcatgctcttttctcccccattcctgtctgcccaccttcagtacagtttcctccagggtatctttttgagcgtgtctttcagccattaagtgttcagtcgtgccttcttcctaagattgtgcctcctaacctgctgctacttaagagtttttctaggagcatttgtcttttgcacacacattcctagacagcaaagactgtcttcgatttaatgagcttagtcattattagaacttggccggtattagtgagtcattttcatatggtggcatctgggggtaatcctactggtgacatttctagagaacataggattcaccaggttaagctgcatgtctacagtgtcaatctaacaattttctctaaccccaatattccatattttaaaagactgaaagcagctgagctggggaagcagacggaaggttttgctatttattggagagtgtgaggcacatcttaattttttcctgtctcatttaggtagcagaaaattatgacaactttttctctagtcttagcatcagggaggtttaacctaagttgtacctatagctaacagtatcagtacatgcaatatttaacaatagaggcagcacaggcaccaaccaatcagaatggggtgccagccacataaccagtacagatgggtactggttagccacaagcaaacagggcagctgtggccagttcataggggctggattccaggtccgctaaccatgtggagtcatatgttttcagccacccaacttgacggagaggaagcaaagccgcacggggtctattgtgctcccctacatcatgtcttccactctgcggaggttgtccatcacctcagtcacttcctctgtggtttccacctcttcaaactcgtctgacaatgctccttccagaccgggatctgatgggtaagggtttcatctttaatctgcaggaagggtggggtaacgccttactaatgtttgcctttagccacgcatcactcctttgagaaaaatagcctttgggtcattctcattgtcttcctcatgaggaatgtcatgattagcagaataataacaacagttactaaaaatgaaaaatgacaaagaaatcacccataatcctaccacactattacatacctatagtcattacctatttttttcatcatttccattttaaaaaataaatttttacatctattttatgaataggttttataatcacatggcatgaaattccaaaagaaccaaacgatatatcacaaaaaatctccctttaatctgagacttcccactacagtagaagccctgcagtagccccacccctagagccagatgatgctaacattcaggttcttggtagccccatggcagctctttataggttcacaagcattgcgtaattatgtgttcttccccacactttttttatatgaatggtagaattttctttactttgctttttttcatttaatattatatcttgaaactctttccatttcagaacataaaaagccccctctttatgctttctgtagctatagatatggctcattgtatgtatgtggcatgatacagattgagtatccctcatccaaaatgcttggggcccgaagtgttttgaatttcggatgttttagtatttttggatatttgcgttatacctgttcagcatccctaatccaaaaaccccaaatctgaaatgttccagtaagcatttcctttgagcgtcatgtcagcattcaaatatttcacattttggagcattttggattttggattttgggattggggatattcaacctgtatattctaccagtgcttactggtggttattcagttgctttcactctattactgttacttcagtgtgacaatgaataaccttaaacacatgttattttgtacatatacaactatatcaatatgggaaaaatctcgtatgtgaaattgctctgtcaaagatgtatatttgcaattttgaaaattattcctaaaccgacttccataaagattataccagtttacactcccaccagcaacacacaggagtgcctagttactcaccctagccaccaaactgtactcttagtctttttaaattttaccaatctgataggtggaaaatattttcttgtatactttttgtttgttttttggtttttgtttatttttcttgttttgcctgaagttgaacatcttttcatttgtttgtagttttattttctgtgacctgtggtcaaatacttttttctgttgaattgttggccctttgtctgtgaaatgagttgaaatgttttctcctaatttctcctttatcttttgacttctaatttgttgcttctaattttttattgagttgtgctgatttttttatgtagttatataatcaatcttttattttatgacttctgggttttatttcacaattaaaggcctttcccactctaagataacaaaaaaggtactttttttttttcattgacttttagggtttcactatttacaattttgtctgtaatcctttagaatttattctaatataagatgttaagtatggagccaacatttttatttccaaatggctactcaattcttcttataacatttagtgaacaagtcatctttttgttttttttgaaatgtcaatcttataaaaaatcaaatttccacatactctttagtctgtggacattttttttctatttcttagatttacctgtctattcatgtatcagtactatgcaatcttaattattatagatataaaacattttttatttcctaatattccttttcagaatttaatctggctagtgtcgctattgctcactgttagattaacttgtctagaatcctattgctatttttattaggatcatgttaaatgtatggactaactttaggaagagtgatggctttttgatgctgaggcttccttgccagaaacataaaatgcctttccatatgttcaaatttaaaatatttgaaaggagttatagttgtgttctttctgcctagcaatatatttaaataatatattgctaaaatacaggaaaggtttaaaagaaaacaatgctttattacttcatcactcaaagataaccaccgttaaagctcaggtatataatatcaaaaaagtatgtttattttttattttttatttttatttctttgagatggagtctggctctgtcacccaggctggagtgcagtggtgcgatctcggctcaccgcaagctccgcctcccgggttcacgccattctcctgcctcagtctcccgagtagctgagactacaggcgcccgccaccatgcccgactaattttttgtacttttagtagagatggggtttcaccatgttagccaggatggtgtcgatctcctgacctcgtgattcgcccgcctcagcttcccaaagtgctgggattacaggcgtgagccaccacacctggccctgtttattttttatacaagtggaaaagcattgcatctatcatgttgtgacctactgcttaatttaatataggtgatgagcatttatgcatcattaagtatttaaaatagtcttgaatataagttatcagttgactcaccattttttcacaaatgtttaattccataatacaataattacatcataaaaataacctacctgaatgccaccctgcctggaaatcaaatatgtagtgtttcttaaattatgcattcttttccgttgatataggtatatttacatagctccaattatagcatatagtttggtactttgctgttctttcttacctttttattataagcatttgtcatgttgctgtgtaatttttatttatgtatttttttttgagacagagtctcgttgtgtcgcccaggctggagtgcagtggtgcaatctcggctcgctgcaacctctgcctcctgggttcaagctattctcctgccttagcctcttgagtagctgggactacaggcgcccaccaccacgcctggtgaagttttatattcttagtagagacgaggtttcaccgtattggccaggctggtctctaactcctgacctcatgatccgcccacctcggcctctcaaagtgctgggattacaggcgtgagccaccgtgcctggctgtgtaatctttattactatcagcttttaccatcatttttgatggcagttgacattgcatcatacaaatatgccatgattaattattcttctactatagaatatttaagctgtatccttctttctaaacaattaaccataaaacttcattatagattttaatacaaaaatatgtatgtaacttgtatcagtataaaatatatttttattaaaaactatagcaaacatatttggacatgtagctttcttattaggatgcattcttagaagtggtgggattatttctagaatgtagtaatctagattctagattacttctagaatctagattacattctagtagtatatagtaatctagattactacattctagtagtatgtagtttgtgggtaggatttgaacacaggctatctggctccagagttgtgctcttacccactacataaaactgtctattgaatctcttactttaaagattctgtctttgcctgtacattgaattaagcccttcacttcctgggataagatactccctaatattttcgtccagtcgtctgatggtcttgtttctgtacattaacaccttgagatgtttgttcagttgtaattgaaaatttagatttagaatctgagagtgaagtcataggtcaagagtaggttgaggaggccgggcatggtggctcacgcctctagccttagcactttgggagggctgaggtaggagcatcacttgagcccaggagtttgagacagcctgggcaacagtttgagaccagcctgggcaacatggtgaaaccccatccctactaaaacaatacaaactttagctgggcatggtggtacacacctgtagtcccagccactcagaagtcaaggttatagtgagatgtgatcgcaccactgcactccagcctgaatgatgggagaaagaccctgtctcaaaaaaaaaaaaaaaaaaaaaatagcctaaagagtcataactgctggtactttcatagtgaattttgattgcaaggtgatcagtatttgtgatgtttgtccttgttcctggccaatagctcaatcttggagccacttttggagcgcagggcctcgtcaggtgccagagttgaagatctgtcccttagagaggagaacagcgagaaccggatcagcaagtttaagagaaaagactggagtctgagcaagtcccaggtcattgcagagaaagcaccagaacccgatttgatggtaaaaaacagaaaagaaaaaaagaaatctctggaggcttgcccccctctcccctgtacccaggcatatcaccatcccctcccagattgaagctgggctatggcttgtttcaggactcagcagcctgggttagtgtcaggtcgcagattgtggtaaggaaagcacatacctcatgagaagttcgagtctataaatcaacattggtgaagatcttgtacccacaatgtaaacatgtgggttgatgcttagagctgtcgttcttgccactctgtcccctgagtcaatccaaacattgtcatttctcttctttaatttttttaaaaggtacttttccttccatatcaagttgttaaatgtggcaagaccaccttttcctgagaatcagggtggcttatttccaacataaatgacacagcccaactgtgatcagaagaatcaagtctgtggccattcagaaaataatctgtggttcagtggttctagtcagtgcctgttcggtgttgcccatcatatgacaatgcttaaaaatcgctccttcagttaagtccttttccaagtgtcttctcagaagacaaggctgttgagagcattgttgagctcagccttcctcaccgtgaaaatgttttgctttttctctctggtcctagagcccaaccagaaaagcacaaaggccaaagagtctccagttgatggataatcggctatcaccatttcacggttcttcacctcctcagtcaacacccttgagcccacctccactcactcccaaagccaccaggaccctaagtaagttttcctgtattccttatagtctttttactagggaatggagtatgtttatgcatctgggcagtttgtaactaaaccagccagaatgtatgtaagaccattgtaaaactggttcaatttcgtgttcgtgtattatacagttagactggagtttggcaaggaggccactaggactcattaaacttttctggatagtgatccaaagggcattagtgtcagttttataattgtgaaggtataaatgaggcagatctgcactaggactagacagataacaagtaacttacaagctaaccattagttaggtagacctgaacagggacaagaaatagacccattccatctactgcttatagtctggcttggggaaccagcagtgcacaacacttgagaagaattgcaaagtacccatagtccagaggcatggtagagggataaatctatcgagccagatgggagacaattgtcaaccaagagttagagataatcagttacagtttcctggaggaagtggatattttcctaagcacttgggctatatcagagaacagaataataccatacattccagaaaatgttgtcatcttcagcttaatactaaaaccctgaacaaaaaaagttttggccaggcacggtagctcacgcctgtaatcccagcactttgggaggccgaggcaggtgaatcacgaggtcaggagatcgagatcatcctggctacagtgaaaccccatctgtactaaaaaatacaaaaaattagctgggcgtgatggtgggtgcctgtagtcccagctacctgggaggctgaggcaggagaatggcgtgaacccgggaggcggagcttgcagtgagctgagatcgcgccactgcactccagcctgggcaacagagcgagactccatctcaaaaaaacaaaaataaaaaaaataaagtttttgcttcagaacaccttgtggagctcttgaaacttctggcgagggcgtcacctgtgtgatgtggggtaagaagtcttcttcgttctatccgcagaaaccatagaatgtggctttcatcagttggttgaccaggttggcttaggtgttacagtgccagcaacatttccatgagcttccttgctcagtgcctctctctgccgcctgcactttctgtcatttctaggctccccatcgttgcagacagatggaatcgcggccactcctgtcccacctccacctccccccaaaagcaagccctatgaaggcagccagaggaactccactgaggtagggaaatcacagctggcaactgtggccagggagcgccactcctgggaaggcagcatcaggttttccaggctctttagtgggcaggtttgctcatagacctgtcactgcagtcgattcttggctcattcctgaaaccacaggagatagagaagttttcaatgggaaggacagacatgcaagcagatgatgaaggtagaggcaggtgttctctgtacctcgtcctgggtacctgtgaaataagccgtgagttctagttcacctttttaggggggcgggggcagggtctggctctgtcacccaggctggagtgcaatagtgcgatcatagctcactgcagcctcaaactcctgggctcaagtgattctcctaccttggcctctcaattagctgggactacaggcatgtgccaccatgcccagctaattttttaatcttttgttgaaatggggtctctccatattgcccaggctgatctcaaactcctggcctcaagtgatcccccccacccacctcagccttccaaagtgctgagattacagatgtgagccactgcctgcccccagccctctatttcacatttgaagagtttacttcttctgaataaaggacagtcattctggagtgacctcagatgggtttccttcagtcatttaacaaatgacttttaagtgcctcctgtctatacgccaggaacccaagtgttggggatatggcagcgagagagagagagaaaatgtgtgtgtgtgtgtgtgtgtgtgtgtgtgtgtgcgcgcgcgcgcacgcacgcacgcacgcacgcgtgtgtctgattagctcatgggaaacaaggaggataagtcagtgtagttttccatttcactttgcaaagcctgtgtagataaactcagatcaattagaagctaaagcagaatatgagaaataggaggagaaggcagaattgggaagaaagctaagacctgcttctaattttgtgtttctgcttctgcagctcgctcccccactgcctgtccgaagagaagccaaagcaccaccccctccacctccaaaggctcggaagtctggcatccctacttccgagcctggatcccagtaaggatcttgccctccctgcaacaccgagtgccttagacagctgctgcctgagaactggcctccagccggtgtcctcattccatggggctccctgctgactgcatttcctgatctgggatgatgtttaccagcccaaaaccagtcatgttcttccaaaagcttctctttgatagaattttgaggccatgccacctcccttccagtccacatggaattccagaatcagtcacagcctctgattttttccaagaagagattgccttcaccattgttaaatgtcagcctgtacggcagagacatggtggtctgcacaagcctggacaagttcttccatattgatggtggagcaacccctgtaatctactccttggaaggattttttgctttgcttatgaaaagctgtgcttgagacttaggtacttttctcacgtggacacactgatcccatcccatattgcatcttggaagagatggatatcaagtacactttggtagctgaaataatcatatctttctgatgtctattgtatctcctttgaggaaaagaacacacatttttaatggagattggctgctttcaggtatgtgtgtctatcattgaaagagcatggactcaaacatcagccctgagttcttgagtccacccaactcccatcttcttgtggcacaggaaagctgccctctccctctcccaccacactcctgactaatggccttcactgcgtcgcagtcactccttccctacggacttctttgaagctcttccttttgcacatacggctttttttttttttttttttttttgtcctattacctcctctgagcgcaaatcactggctacaagggacttaccagtctggattcagcagtttcttttctaaaacccatttgggtgactcagcagccgcatctgctacctgattttatcctggagaatacagtgcaatatttctctttgattatttattcctcttgattgtggaattaatttgattgcttgctaatggtactagtagtactcctttcagaagaaaaaatggagcgatttaggtgaccaaatattacatacataaatagccacatgaagttttagacgtttggacttgaagcctcaaagatcaaccaaccagtccccttatttagtaaataaggaaattgaggctacacacagaaaattgtgctacagattattactaataacccagcttgctaaattaggctatacctaggtaatctctagaagacaactctgacagactctttaatatttacccctggttggaacaatatttgaaatgtcccagatatttctatgctacttagatatttgtggcaaagcagaaagctttttgactgtgaaggcagaggtcagcactgggggaaacttgctggtggtctctcccacaaccttgcccagagtcctttccactaaggaggtgaagagaacagagaaagagatttccatttctgctgccagagctggtatttgcctgcctgattctctgtgtttcctgtttcaccgccaccctttcaggagagaactacaccagttcatcatgagggtcagggaagcaaaagctctcagatgtgtccagggcgttacttaagaaatgagtatgcagattctggaaggggtgtggaaaaggtgatcctttacccccacccaggaaaacctgcattgtgctagcatggaagaatcatgggctttggaattaaacccatttggtggaattaaacccatttggtttcaaatcccagttatgacatctgttaactttgcaaactcacaaaaattatttgaaatta

SEQ ID NO: 969 - DNA, 51830 bp, Homo sapiens
tagacatttatgcagtggttcaaagtctagagtccctacacttctggtacatgacagctgtgtctcgatggagtagactctcagaacagcgcagtttgccctccgctcacgcagagcctctccgtggcttccgcaccttgagcattaggccagttctcctcttctctctaatccatccgtcacctctcctgtcatccgtttccatgccgtgaggtccattcacagaacacatccatggctctcatgctcagtttggttctgagtctcctcaagctgggatcaggtaagactcatctttgtttcctccttactaactaacagtttgagttctttagctacaatggttgcagcataatggaatgaaggcatctttgtcgtttccattcctttggcttctcctagcctcagcctggggaaggatcaggcgctgtggaaacaattatagtagcccccaaataatggaaacacgggtgttgaagacgcaccgtgatcgttgacggggacacacctaacgtgttaaggtgaataaattcagtgtttctcccagatgggctgagtggtgtaggcagggttattggagcaccaaggttgctgacatggatgtccatctgggaagagacacagttaggatttttggggaaaagacaatgtatccagctaaagacatgctgagttagaaatgtctgtggtatgagacacgagggtggaggaaggtgtacaggtcttgaggtgagaaattagctgaaacctggcatattctgggaagaaatccactcttctttctccttccagttactgttaacacagaacctagtatataggatgttgagtgactgaatacaattcacagaggaagcttgaggttggggtagaatgctggtggctagatggtcagtacccagccacagaagattcgattgactgtgttcactttctgtctgtgaaggttcatcctgccacctgtccacctatatcttttttgctaaatgaagctaagaaaacagaaataagggcaatcaaaacatagagcatgtttccttaaaacaaaaacccatatgtgttactaacaggagacgctctcgtttcagtttgttttcatttattttctgacgagcttctttgtttcccttctgtttccgggtgaggcagcaggacatcctggaaatgatcttggagacagaaacattttatttttaaaaactcttatttcattttcttgtgagctttattgttcacagcttccttaggtgttggtttgcttatgatgacatggagatacgatcacattcctgctggggctgtggtgaggactgcatgagcttgtgcatgtagagtgcacacagctgcacgggtgcatggcatgttgcagcaacagtcttgttcctttcttattttcaagggaaggaagtggaaggagtgaaaggagatgttataggcaagagaggtgacagcagcaagggctggccggagaaatggaggtaccctgaaaaatgtttccttgcctcaagagccccacacagccctgaaggcagcatccatagcagcccagctggcatacgctgggtccccaaacctgacctaagacaagggccttcctgccagtgattcgttgagcaggtgattctgggaaacaaagtgagggagtggagagagtgaagccagtagggggaaagccatagagggtgcgctaatgagcgttgctgcggtggcaactgggacccagtcccactgggacctttggaggaactttatagatggtggctcagagtcattccaacatctactgtctcctttccccactgggtgagatgtgccgcccaggactgctaaaatcgcaaaccttctgagctgccttgtgccagggctaagtaggttccaagggtggcaggaagccctcagcagagaggcagaggccaggctccagggacggagctgtcagcaggcagggaaatgcccatcccactgcagggggactcagggttgggtggtgaggagcagggcctcaacatctgctacaccaggtcagaagctggtcagacaccaggctgcaaagtcatgcctcatttaataatactcttaaagatgcatgagtgaaatacatttcagcaagatttataaaatgtaattaaactaaaaaattagtgctaaaatgaaaaagtatccactgatctagaaattcacacatgtaattcaccttccctctgatgcacatgcagacagcacacacaggtatatccatataccataaatggatacatgtgaatgaatcaagagacactgccagtcaaagggggtgggtacttagaaggtgaagggagtgggcctccatagtctgtggtctctaagaagcagtgtaatccttacagggtagtaagagtgatttacaccaggaaaattactcaaatgattgttaaacagatgagcaagtaagaaaggaaatggggctcaccgttcacatgcataactgtggagcctgttctgtgtgactggctctgtgctgatcaagtgggtactatgctgagcaagaaaatcaggccctgtccccagagagccaagagctgtgcaggggaggctcacagaaaacatgtaattgtcacacttgaagcaagacaatgaagaaagtttcaaaagcgaggtgaggacatacatgtaccaagaattttttttaaaaaaaatgaaggcaagacatgttgacaaagcactaggcgaaccacctttcagtgctaaaataaagtggaaaaaattactacacaagcgtaaaaggcacatgctatggaaaatataagtcacacgtgaacgtgctaaagaacaaatttacagaaaacagactgcaaaatcttgtttcagtgtcacagcatgtctttcagaacttggcagaacaagcagattttcaaaaaaaactaaggaagtacaaataattgtgtgcgccatgggcagaaatgtaacattcctctatagtagccataaaatattgatataatattgtgcttgaaggaaaccttaacgaattgccgcaaactggagactttatggcccatactcttctctgggccattagaaagacgtcaactttggttttcagcaaggacgatggaaatggggatgtttgggttttttttttaattgaagcaaatgggcagatgggagagaatgtggcaatagaacctcctggaatcaaagggtctacattcagaaagagactttttcctctggataacatggttttctcatcttaaaaataaaaacattaataatacacatttctgcaggtgctcctcaagatcgaatgaagtaactgatgtggacatggtttgtcaaatgtaaggagatacacaaatgcaagtcactggctttagaaataggattgtgatgaatgtttccccctgatgcacatctccagcccagcccaatggagccctgagtaggtcacactataaagggtttttttttttgtttttgcttttatactttaagttttagggtacatgtgcacattgtgcaggttagttacatatgtatacatgtgccatgctggtgcgctgcacccactaactcgtcatctagcattaggtatatctcccgatgctatccctcccccctccccctaccccacaacgtccccagagtgtgatattccccttcctgtgtccatgtgatctcattgttcaattcccacctatgagtgagaatatgcggtgtttggttttttgttcttgcgatagtttactgagaatgatgatttctaatttcatccatgtccctacaaaggacatgaactcatcattttttatggctgcatagtattccatggtgtatatgtgtcacattttcttaatctagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttccagttctagttccctgaggaatcgccacactgacttccacaatggttgaactagtttacagtcccaccaacagtgtaaaagtgttcctatttctccaatcctctccagcacctgttgtttcctgactttttgatgattgccattctaactggtgtgagatggtatctcattgtggttttgatttgcatttctctgatggccagtgatgatgaacattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgcgaaaattttctcccattttgtaggttgcctgttcactctgatggtagtttcttttgctgtgcagaagctctttagtttaattagatcccatttgtcaattttgtcttctgttgccattgcttttggtgttttagacatgaagtccttgcccatgcctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctttccccattgcttgtttttgtcaggtttgtcaaagatcagatagttgtagatatgcagcgttatttctgagggctctgttctgttccattgatctatatctctgttttggtaccagtaccatgctgttttggttactgtagccttgtagtatagtttgaagtcaggtagtgtgatgcctccagctttgttcttttggcttaggattgacttggtgatgcaggctcttttttggttccatatgaactttaaagtagttttttccaattctgtgaagaaagtcattggtagcttgatggggatggcattgaatctgtaaattaccttgggcggtatggccattttcacgatattgattcttcctacccatgagcatggaatgttcttccatttgtttgtatcctcttttatttccttgagcagtggtttgtagttctccttgaagaggtccttcacatcccttgtaagttgtattcctaggtattttattctctttgaagcaattgtgaatgggagttcactcatgatttggctctctgtttgtctgttgttggtgtataagaacgcttgtgatttttgtacattgattttgtatcctgagactttgctgaagttgcttatcagcttaaggagattttgggctgagacagtggggttttctagatatacaatcatgtcgtctgcaaacagggacaatttgacttcctcttttcctaattgaataccctttatttccttctcctgcctaattgccctggccagaacttccagcactatgttgaataggagtggtgagagagggcatccctgtcttgtgccagttttcaaagggaatgcttccagtttttgcccattcagtatgatattggctgtgggtttgtcatagatagctcttattattttgaaatacgtcccatcaatacctaatttattgagagtttttagcatgaagggttgttgaattttgtcaaaggctttttctgcatctattgagataatcatgtggtttttgtctttggctccgtttatatgctggattacatttattgatttgcgtatattgaaccagccttgcatcccagggatgaagcccacttgaccatggtggataagctttttgatgtgctgctggattcagtttgccagtattttattgaggatttttgcatcaatgttcatcaaggatattggtctaaaattctctttttttgttgtgtctctgcctggctttggtatcagaatgatgctagcctcataaaatgagttagggaggattccctctttttctattgaatggaatggtttcagaaggaatggtaccagttcctccttgtacctctggtagaattcggctgtgaatccatctggtcctggactctttttggttggtaagctattgattattgccacaatttcagctcctgttattggtcgattcagagattcaacttcttcctggtttagtcttgggagagtgtatgtgtcgaggaatttatccatttcttctagattttctagtttatttgcatagaggtgtttgtagtattccctgatggtagtttgtatttctgtgggatcggtggtgatatcccctttatcattttttattgcatctatttgattcttctctctttttttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaatttccctctacacactgctttgaatgtgtcccagagattctggtatgttgtgtctttgttctcgttggtttcaaagaacatctttatttctgccttcatttcgttatgtacccagtagtcattcaggagcaggttgttcagtttccatgtagttgagcggctttgagattcttaatcctgagttctagtttgattgcactgtggtctgagagatagtttgttataatttctgttcttttacatttgctgaggagagctttacttccagtatgtggtcaattttgtaacaggtgtggtgtggtgctgaaaaaaatgtatattctgttgatttgcggtggagagttctgtagatgtctattaggtccgcttggtgcagagctgagttcaattcctgggtatcctttttgactttctgtctcgttgatctatctaatgttgacagtggggtgttaaagtctcccattattaatgtgtgggagtctaagtctctttgtaggtcactcaggacttgctttacgaatcttggtgctcctgtattgggtgcatatatatttaggagagttagctcttcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgcctctgcacgtgagatgggtttcctgaatacagcacactgatgggtcttgactctttatccaatttgccagtctgtgtcttttaattggagcatttagtccatttacatttaacgttaatattgttatgtgtgaatttgatcctgtcattatgatgttagctggttattttgctcgttagttgatgcagtttcttcctactctcgatggtctttacattttggcatgattttgcagtggctggtaccggttgttcctttccatgtttagtgcttccttcaggagctcttgtaaggcaggcctggtggtgacaaaatctctcagcatttgcttgtctgtaaagtattttatttctccttcacttatgaagcttagtttggctggatatgaagttctgggttgaaaattcttttctttaagaatgttgaatattggcccccactctcttctggcttgtagggtttctgccgagagatccgctgttagtctgatgggcttccctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttgtcctgccttgctagattggggaagttctcctggataatatactgcagagtgttttccaacttggttccattctccccatcactttcaggtacaccaatcagacgtagatttggtcttttcacatagtcccatatttcttggaggctttgctcatttctttttattcttttttttctagacttcccttcttgcttcatttcattcatttcatcttccatcgctgataccctttcttccagttgatcgcatcggctcctgaggcttctgcattcttcacgtagttcttgagccttggttttcagctccatcagctcctttaagcacttctctgtattggttattctagttatacattcttctaattttttttcaaagttttcaacttctttgcctttggtttgaatgtcctcccgtagctcagagtaatttgatcatctgaagccttcttctctcagctcgtcaaagtcattctccatccagctttgttccgttgctggtgaggaactgcgttcctttggaggaggagaggcgctctgctttttagagtttccagtttttctgttctgttttttccccatctttgtggttttgtctacttttggtctttgatgatggtgatgtacagatgggtttttggtgtggatgtcctttctgtttgttttccttctaacagagaggaccctcagctgcaggtctgttggagtaccctgccgtgtgaggtgtcagtgtgcccctgctggggggtgcctcccagttaggctgctcgggggtcaggggtcagggactcacttgaggaggcagtctgccagttctcagatctccagctgcgtgctgggagaaccactgctctcttcaaagctgtcagacagggacatttaagtctgcagaggttactgctgtctttttgtgtgtctgtgccctgcccccagaggtggagcctacagaggcaggcaggcctccttgagctgtggtgggctccacccagttggagctgctttgtttacctaatcaagcctgggcaatggcgggcgcccctcccccagcctcgctgctgccttgcagtttgatctcagactgctgtgctagcaatcagcgagactctgtggtcataggaccctctgagccaggtgtgggatataatctcgtggtgcgccgtttcttaagcccatcggaaaagcgcaatattcgggtgggagtgacccgattttccaggtgcgtccgtcacccctttctttgactcggaaagggaactccctgaccccttgcgcttcccgagtgaggcaatgcctcgccctgcttcggctcgtgcacggtgcgcgcacccactgacctgcgcccactgtctggcactccctagtgagatgaacccggtacctcagatggaaatgcagaaatcacccatgttctgcgtcgctcactctgggagctgtagaccggagctgttcctattcggccatcttggctcctccccctcactacaaagggttttgatgatttatcttttgtatgtcttcccacagggcagtggcaggtgtttgggccagacaagcctgtccaggccttggtgggggaggacgcagcattctcctgtttcctgtctcctaagaccaatgcagaggccatggaagtgcggttcttcaggggccagttctctagcgtggtccacctctacagggacgggaaggaccagccatttatgcagatgccacagtatcaaggcaggacaaaactggtgaaggattctattgcggaggggcgcatctctctgaggctggaaaacattactgtgttggatgctggcctctatgggtgcaggattagttcccagtcttactaccagaaggccatctgggagctacaggtgtcaggtcagtttcatatttcataacttagttgtcccaaagaaccatcctggactttataagtgtttttttcaataaggaaattttaaaattttaggtcatttagttagaaggcagcattctatactctacgttccttctgtcttgtgtgtatagttctatgtgttttgtcacatgtttaaattcaggtaaccaccatcacatcaaggtatagaactaccccatcatcacgaagatctccctctgtcaccccttcatggtcacacccaccccttctcagcccctgcctggggttttccatctccctgatgctgtaatttcaagaatgttacatacacagcttcacaccgcaggtgaccttttgagattgactttttaaattcagcataatgctcttgcgatctatccaaattattgcttgtatcgatactttatttcttttttttccccactgtcaaaatagttttccttatgaacatttatttttaaattaacaaataaagattcctgctcacttgtcctacaaattttttgtttatctgatacagcagggagcaaacgtcagctccaggaagctgtgacttcccctgacaatcagttgctcaatgctctgtgttaacttgaccatacttccatagtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 970 - DNA, 51830 bp, Homo sapiens; identical to SEQ ID NO: 969

SEQ ID NO: 971 - DNA, 51830 bp, Homo sapiens; identical to SEQ ID NO: 969

SEQ ID NO: 972 - DNA, 51830 bp, Homo sapiens; identical to SEQ ID NO: 969

SEQ ID NO: 973 - DNA, 41343 bp, Homo sapiens
agtcacacccttcacagtgaaatgtatttgacggggctgggtgcagtggctcaagcccgtaatcccaacaccttgagaggctgagacaggaggattgcttgagtccaggagctcgagaccagcctgggcatatggtaagacctcatctctattaaaaaaaaaaaaaaaagaagatgaaagaaggaaaaaacagaaatttattgtttacagttgttgccgtgtgcagtcagtgagttgtgaataatctgtgtcctgattaaaaacctgtgagtggggctgctctgacggtagtggattatccgaacttagtagtgtcactacaattggcatacgactccccactgctaaatttgactaacttaaatttttttaaaaaccactatgagtgatatttcaggcctgatgataggcaattttcaaaagcgtttcctggaaggcctcctcctcatagcagacttggagtacaaccaatgctttgcagtctctgaggagagtttcaggtgagccctcaggcccggctaagctgtcctggtctttacatatttgcatttctagcccaggcattttaattctcagaatctcaggccttgggcaggactttcaagtgccttataacaaggaggagaatgtggagtcctaattagggaaaaggagtcaggctggcaggaccaggtgaaagcaaaaagaaaaaaaaaaagaggaaataaactataaacatgcctttcttcatgtctagaaaatttaaacaaaagagacagcagataagctacaggtctgcctttcttcgtcatcctggacatacagtccaggatatatggcccagaacatttggccttcctgcccagataacatacataactcacagacttcctgcttatcatcaaacacctcaatttatcaaatatcccagctgacaaaagaatataagttaggctccctgctaccttggcattatcgatcagcccaagctccattctataaaatccctgagacttttttttcttgcagttagcttccctcatgctaacttgcctattgccttccttgcaaagtactttcctactttctctaataaatctgcctttctctacctacaaccatcttggtaaattcttttacccccacaccactggctgccattcccccatgacagaaaaggcaaactccaagacacttttctctactctgtcttagtatccagtatcttaccctctaattcctcctccctacacctcctcctgagctcaggattcataaagctgtgaagccttttgttcagcactccatcactagtgagtcagccccacacgtgtgatgatccatctgcccctcaactggaattccatttcatgggggaggatgagacagggaggggttggcatcttccttggtttagctcttacttttgtagcaactgattagaggcttcactattactttaattcgggtcatcgttcctttggtctgttactcctacgcctggcggctcagcactctctctactttagctgagctcctgacaagtttctcatagaagcagttttgtcttacttcatcatgactggtgcttaggaatagccacgcatacacagtagttgctaaaaaatggcaacgaacagaggccatgggaaggcttttgccaaaggtcgtggttttagtgtttgtgtgtgtaagagagagaatgggtggggggtggactgaatgcacctgactcagaattgctgtggctttgggatgtgatctttgctttcaaccgttccctgttttctccccagcactgggctcagttcctctcatttccatcacgggatatgttgatagagacatccagctactctgtcagtcctcgggctggttcccccggcccacagcgaagtggaaaggtccacaaggacaggatttgtccacagactccaggacaaacagagacatgcatggcctgtttgatgtggagatctctctgaccgtccaagagaacgccgggagcatatcctgttccatgcggcatgctcatctgagccgagaggtggaatccagggtacagataggaggtgagtagggaggggaggagaagagaaggaggggtggatgcttcggtaactcagagggaggacaggagcctccatcttggcattgctgttttatctttctcagttctaatgatttattttaaaagtttaaaatcaatgagatgtaaaagtaaagttataaacatttggttaggtggaaatagaattgtttacaattccaggggagtagaattaagtatttccttcagctgtgacgtaaccctgtgatggttaattttttgggtccacttgactgggtcacgatttgctcagatttggtcaagtattattcaggatgcttctgtgagggtgtttacacataagattcacatttgaattggtaaactgagtaaagaagattgccctccataatgcgggtgggcttatccaatcagctgaagacctgaatagaacaaagggtcgaccctcccctgagtgagagaatgatcttgcatagtagccttttaactgggacactggctcttcctggcctcagagcaggctgctggccttcagactcaaactgaaccactggctctttctatgtcttgagcctgcggacttttggacaggagtgacaccattggctcttctggttctcaggtcttctggtttcaacgtaaatgaaccattggctctcctggggctccagattgctgactcacccatgagttgggacctaaaagagcttccatgatgtatgcaagccaattctttatactaaatctgtctctcctcttcctttctctctttatctccatctttctctctcaaatatatagaaacaacaggatgtatatatatatatatatgtatgtgtgtatacatcctagtggttctgttactctggagaactctcactaatacagatttggtaccaagagtatttctagagaaaaagaattttagggataacttttcagtcatccctaaaattctaaaattctctgagctgggattactgtgtacacctgtagtcccagctactcaggaggctgaggtgggaggatcacttgagcctaggagtttgaggccagcctacacaacatagcaagaccccgtcttcaaacaaacaaaacaaaaagcactgaaagttcatgttgtgatctagcaatacagatatgcaaaatttcaccatttgcgacccataattaagcatgggttgactggtatatgatattttcaaacatgtgtgtcgacctagtgaataagatgagattggctggttgctcctattcttgctagaaaaagtgaggaaagtgatgaaaggaaatatgagcggaggaatttgaattctgagtttcttggtgttgcataaataacctgaaagcttccatgagtgccctgaaagagacccttattttctgtagccacagggctaagattgctgaaaaccaaattgagaactcattctgtgactggctgaacgacaatggaaatccaaacctgttcctcagggtatctgtcaatgtgagggggcattgactgggaagaaatgagattcagaaagttgaaatggggatgtatgggaagactgatgaagctggggacattgagcctcaaatgctgatgagtctttgccagtgaaagcagtctcagtctctctatgtcaattagaagtagcctctccaccttcatctcaggggattaaccctgcattgcccaaagaaactgtaatggcctctttcctgaggcagtcaccatgcaagacaatgctgatgctacgcaggacccacccctaccattcctctttgcttctagatctgtacctaggctcaagtttcagcaggaccctaaagttggaaacaatgcatgactcattagaaagtgtactacactccaaaagagctagttggtttttctaatctatacagaccagaaatccagagaatccatgtcaaatgatattaagggtgtaaggtggtggtacaaggacgtaaggttggctcaaaccacatgtaatggcctcactaatcagagatcctgcatttaatgttgcagctcagagtgttagaaaggcctctatcgtttggttggctgaagcatggatcaaaatgtggcccacagagagtgacaggtgggcatgctgttaggagcctttgccaggcccctgtaagtgaatcatggcacaggccctcaggattgagaagcagagccctgccattctctacgaataactactcttcttttgaaaaatacatcttgggctagaccttaggaaagactgaacacttaatcatgggccgccaagttgcaatgtgacttgaatcagtaagaatatagaatacttgaactaaaaattaacaaacccaatttaatagatattcttagaaggctgcacccaccacaaagcattggaagcacacacagaccataaattaactctcatcaggctcaagcacataaaatgctttacaaaaactttgaagaaaatggtattgcgatatggttttagtgttgtgtcttctccaaaattcatgttgaaacgaaatccccaatgcagcactattaagaggtgggctttttaggaggtgattaagtcctgaggactatgcccatatgaatgggttagtgccttataaaaggatttaagggggtgaacttaccctttccaccccttctgccatgtgagggacacagtgttcatcgccttcaggggacacagcaacaaggtgccatcttgaaacagaggacagtcctcatcagatgccaaatctattgatacttgaccttggacttcccagcctccagaactatgagaaatacatttctattgtttacaaatgagccagtctgtagtattttgttatagcagcacaaatggacaaagactggtatgattcaaacgatgatttctaatcacaatataattaaattcaatgagaaaaagaaaaacaatttaatattcatatatgtttgaaactttcaaaacatacttcaaaaataactaagtggtcattgaaaaagtcataatgataattaaaagtgtcttaggactgaatgataatgaaactatacatacaaactatcacacaactataccttttaagaagtgacatgattaggatggtgaaatggagttttcagttctcaaactcccacagaaacactaattttaacaactaccatgaacaaaagtatttttgtaggagtctaggaagccacttgagaggttccaactggttggtcaggcaaaaaagccaagaacagatgcatggaggaaggtaagaactgtttccttctacccgcctcactgctcttccgaggtaactcagtgccaagagagactccctcagcccacaatttttgccatggggaaagtgagagcaaagtgaatgtccagattccccaggcttgtgggatgctgcccaggaaacccatttctgtctcacttaatgcagaacactgaggggaccatgtggctgaatcatctgggggcagctaggagtagggaaagaggagggggcttatggcagccagtgcatggacctgaacaacaagcagcagaacctactggccagcccctgcactctactagaggcccacctcacaacctgctgactacccaaccagctgatatgtgcccccagccctccacacaccacccctgtggctagaacctcttggtccatcacagtggggcacgtgcttccctgcagacagggtgcctgagcctcagcagatgtgcatacaaacttctgcagtcagaacacagatagcaatcagcttgactctgctggattgagagaaggtgcacaatcttgagtattttagggaattgccctagggataaataaatgcaaggctctcagcagccagcctgctttgcaggactgagaaaagaaaatcccaagacttcctctcaccaagaaggaacgagaaaagtaaagcaggtacatccataaaaaagatctgagagacttccagagtatctagccaggctgactggtcaaggtctttgtctaccaaagtctgccagtacagactagaggaggaggagtgacagaaagacaaaatatactgtcaaacagattcacagcacattaaaagattcatttaccatgattaagtgagctttatccttggaacataaggatggttcaacatatgcaaatcaataaatattacactaacagaatgaaagacaaaaacaatatgatcatctcaatagatgcagaaaaagcatttgacaacattcaacaccctttcatgacaaaaccaactttcaataaattaggtatagaagcaatgtagctcaacacaataaaggccatacgtaacatgcccacagagcatatacccagtggttgtcttagtccactttatgctgctgtaccagaatacctgagattgggtaattgataatgaacagaggtttatttggctcatggtcgtggaggctgggaagtctaagatcaaggggtcacatcctgtgagggccttctagttgtgtaattccatggaggaaggtagaatggcaagagagtaagaaagaggaaggaagctgcttctgcaaaaatggcattaatccactcacgagggcaggatcctcatggccttgtcacctcttaagggtcccacctgtcaacattattgcattggggattaagttttcaacacataaactctggggatacattgaaaccacagtgatgatgaaaaatttttaaacaatagcgaaatctatggaatgtagcaaaaccagttctaaaagtttatagctataaatatctacattaagaaaaaagaaagatctcaaatgaacaacctaagtttatacctcaagaaattagaaaaagaaaaaactaagccaaaatttagcagaaggaaggaaaaaataataattagagcagaaataaatgaaatagaaaaacaataaaaagatcaataaaactaaatgttgtttatttgaaaagataagtaaaattgacaagcctttacctagattaaccaagaaaaaaagagctgactcaaataaatagaattataaataaaagatgatacattacaactggtaccacagaaataaatataaaatgtcatgagactatcgtagttctcccttatccacaggggttacattccaagatccccagtgaatgccacaaaccacgtacagtaccaaaccctatatatgctatttttcatgtctcaaatggaacagagcaggatgatagagatttcatcatgctactcagaatggtgtgcaatttaaaacttacaaattgtttatttatgaaatttttcattcaatatttttgggccacaattgatcacgagtaactgaaatcatgaaaagtgaaaccaaagacaaggttagactacggcactatgaaaaatcataggccaacaaaccagataacctagcagaaaccaaagacaaggttagactacggcactatgaaaaatcataggtcaacaaactggataacctagcggaaaccaaagacaaggttagactatggcactatgaaaagtcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactatggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaatcataggccaacaaactggataacctagcagaaaccaaagacaaggttagactacggcactatgaaaaattacaggccaacaaattggataacctagcagaaatggatacattcctagaaacatacaacctataaaaactgaatcagaataatttaaaaaaaataccagaccagtaattagttagaaatacaattgataatcaaaatcctcccaacaaagaaaattccatgaccagatggctctgctggtgaattctgcaaaatatttaaagaaaaattaacacaaaaaattagctgggcgtggtggcgggtgcctgtaatcccagcactctgggaggccgaggtgggtggatcacgaggtcaggagatcgagaccatcctggctaacacggtgaaaccctgtctctactaaaaatacaaaagaattagccgggcatggtggcgggtgtgtgtagtcccagctacttgggaggctgaggcaggagaatggcgtgaacccgggaggtggagcttgcagtgagctgagatggcgccactgcactccagcctgggtgacagagtgagattctgtctcaaaaaaaaaaaaaaagaaataaacaaagaaagaaaaattaatgccaatacttttcaaactcttgcaaaaaattaaagatggggaataattccaaactcattttatgaggccacagttaccctgatacaaaaaccatataagaacaccataaaaaagaagaaaattacatgccaatatccctgataaacatagatgcaaacatttccaacaaatattagccaaccaaattcatgataaaaagaataattacaaagtacattaaaagaaacattaaacgtatccccatgatcaagtgggatttatctctgggatgcaagaatgtttcaacacacgcaaataaataaatataatatatgacattaacagaatgaagaacaaataatgtataattatgttaacaaacgcagagaaagcatttgacaatattcagcatcttttcataataaaagtcaacagactaggtaacaaaagaatgtacctcaacataataaagatcacatatgtgtcaacaaaaagagtcaaactctataaaacatttaaagaggtttattctgggccaaatgtgagtgaccaaagcccaaggcatagtctcaacaagtcctgagaacatgtgcccaaggtggttgagttacagcttgattttatgttttaaggggacagaaattacagacagacatcaatcaatatatgtaaggtgtacactggtttggtctagaaaggcaggacaacttgaaatgggggcttccaagtaataggtagattagaagattttctggttggcaaatggttgtgagttatctaaaagacctggaatccatagaaaagagtgtctagattaggatagggggttgtggagaccaaggttcttacatgtagatgaagtctcataagtggcgacccttagaggcaataggtggcaaatgtttcatattcagatctttaaaaattgctagactctcagctaatcagtctcttcgggatcagacaaagacctggaaagggaaatttacattctgtagagaatttacatttcccccaccagaggcagctttgccaggctatttcaaaatatgtcaaagaaatatgctttggggtaaaatattttaaattctttcagggcctgctatctgtcatgtgatgctatatgatagtccagttgggatttggtatcttattgctacaaagagtctgttttgtcagtcttaagacctctgttgtaatgttaatgctgctcagttgttcctgaactccaaagggaagaggacataatgaggcatgtccaacctcaccttcccatcatggcctggactagtccttcaggtttacttgggaattccctttcttgagaagagggggtccattcagttgactgggaagcttagaattttatttttggtttacatattataagctcatagctaacattatcctcaacactgaagtagtgaaagctttcctttaagattaggaacaagataaaggtgtccactcttgccacatagtattggatgttatagccagagcaattgggcaaaaaagaaaattaataaaaagcaaccaaatcagaaaggaagaaacataaatgtctctgtttggagatgacatgacacgtagtgagccctagagaatccactaaaacctgttagaacttaataaatgaatttagcaaagttgtaggatacaaaatcaacatataaaattagtagtgtttctatacactaacaataaattgtctgaaaagaaatcaaggaaacaacttcatttaaaatagcatcaaaaaattagaagtaaatttagccaatgaggtcaaagatctgtacactgaaaactataagacactggtgaaagaaatggactataacacaaataaatagaaatgtatcatgtgttcatagaattaatattgcttaatgttcatactacccaaatcaatttatagatttaatgcaatcactattaaaattcaaaggcatttctcacagaattagaaaacaatctaaattcacatgggatcacaaaagaccctgaatagccaaataagacttgagcaaaaagaacaaagtacaagcatcatactacctgatttcaaattatgttatattaggttggtgcaaaagtaattgtggtttttgccattgaaagtaatagcaaagactgcaaagacttttgcaccaacctaatagtaattaaaaccatatggtactggcataaaaacagacatatagattaatggaacagaattaagagccaagaaataaacccatgctatatggtcaactaatcttcagtaagattaccaagaatacaaaatggataaatgatagtttctttaacaaatggtgtttggaaaactggatatttacatgcaacagagtgatattggactcatattttccatcacacacaaaaatcaattcaaaatgaattaaagatataaacaaaaggccttaaactataaactcttagaagaaagcatacagaaaaatctccttgacattgatcttggcagtgatttttcaccctgacaccaaaagcacaggcaatgaaagcaaaaatgaacaagtaagattacatcaaactaaaaagcttttgcacagcaaaggagataatcaacaaaataaaaagcaacatgtggaatgggagaatattttcaaagtatatacctgataaagagttaatgtccaaaatatgtaagacactcatacaactcaataaccaaaaatattccaatttttacaatgggcaaagtacatgaataaacattttccccaaaagacatataaatattaatagccaagagatttatgaaaagtgactcactatcactaaccatcagggaaattcaatcaaaagtataaggagagatcacctcatacttgttagactggttattactaacttaagaaatattacaggtgttactacattgttgctgggaatataaattgatacagccactatggaaaacagtatgcagattccttaaaaaaatacaaatagaactatgctacatagtcttatatgtagataaaccctaaagattccacaaaaaactgttagagctaatacatttagtaaagttgcagtgtacaaaattatataaaataagtaacctcattgataatttataatccagcaatcctgcttccgtgcatttatccaaaagaattgaagtcaggatttcaaaaagatacttgcacttccatgtttattgtggcatagttcacagtagccaagatatgaaaacaatctatttgctgacagatgaatggatttaaaaagtgacatatgtaatgaaatattactcaacaataaaaaagaggtaatcccgacacatggatgaacatggaggacattatgttaagtaaaataagccagacataaaaatgatctcacttatatgtgtaatctaaaatcatcagtcatagaatcatagagcataactgtgattgccagggaatgaggggagggaaaaatgggaaggtgatattcaaaaggtataaaaaagtttcatttgtgcaagatgaagaagttctggagatctactatacagcacagtgcctgtagctaacaataaactattgtattcttaaattctgtgaagagggtagatcttatattctgctcatactacacacacacacacacacacacacacacacacacagacacacacacaataattgtaataattataataaaaggggtaggaggaaactacgggagatgatggatatgtctatagtcttgatggtggtgatgatttgaatgggtatatacttatcaccaaactctttgagttgtataaattaaatatgtacagctttttacatgtgaatcatacctatcatacttgataaatggttttatgaaacaaaaaacaaaacagaaaaataaattaacacctttaaataaatgtatccatttcttctagaatttctagtttgtgtgaatagaggtgttcataatagtctctgatagttatttgtatttttttggctcagtgtaatatcccctttgtcatttctgattgtgtttatttggatatttttttctcttttctttattagcctagctagtggtctatatattttattaatttttttcaaaatccaactctggattcattgatcttttgaatggtatttcatatctcaatctccttcagttcagctctgattttgttatgtcttatcttctgctaactttgggattgattttctcttggttctctagttcttttagttgtgataataggttcttaaattgagatctttctaactttttgatgtagttgtttagtgctataaagttccctcttaacagtgccttggttgtgtcccagaggtgctggtatgttgtgtcttttttctcattagtttcaaagaaattcttaatttctgccttaatttcattatttacccaaaagtcattcaggagtaggttattcaatttccatgtaattgtattgttttgagtgattttgttagccttgatctgtaatcgtattgagctgtggtctgagagagcggttgttatgatttcagttcttttgcatttgctaagaagtgttttgtgtctgattatgtggtcagttttaaagtatgtgctatgtagtgataagaagaatgtatatcctgttatttttgggtggagagttatgtagatgtctatgagatccatttgatccagtgtgagttcaggtcctgaatatcttgttaattttctgcctcaataatctatctaatacagtcagtggggtgttgaagtctcccactattattgtgtggaagtctaaatctctttgaaggtctccaagaacttgctttatgaatctgggtgcttttgtgttgggtgcatatatattcaggatagttatgtttgttgaactgaaccctttaccatcatatattgcctttctttgtctttttgattattgttggtttaaagtctgttttgtctcaaattataattgcaactcctgctttttcctgctttccatttgcttagtagattttcctacatccctttattttgagcctatggatgttgttgcgtgtgagattagtctcttgaagacagcataccatttggtcttgtttctttatccagcttgccactctgtgccttttaattggaggatttagccaataaggcagtttaaaaaatattaataagaaattttcagaaacataaatgtaaaattccaattagaaattttataaactccaagcaaatgttttttaaaaaacctaatatattatgactgaattgagcttacccaggaataaaaggttaggtcaacattgggatatgtatatttatgtaagtattaccttaataagttaaaggagaaaatctataagattctctatagatgttaataaaacatatataagtttcaacatctaactatgatttaaaacacttgtgaatccagaaataaaagaaaaccttttatgaattagcaacagaagagcagttctttcatctgatagaaagctatttaaaaatacccatagctaccatgatacatcatggtaggaggtttaaacccaggaacttaatgaagataactgcattaaacattgctgttcaacaatatgctggaatagtaatcattgcaaaaaaagaaagaaagtgaaaaaagaattacaatttccaggaaggaaaaaatagaatgcctatttccaacaggttatatgataatacacattggaaatctggattaatctacagacaaattctttcaatttatacttcattatgttcataaaaataagatcagtaaacaaaatacattgcattttatacaccagcaaagacagaaaaacaaacaaatatgccatgtataataacacaaaatgtcacatagaaatatatttaataaaatatttttatactcttattaaggattagataagtttactaaaataactaaaataagaggagagacacatctggccctactgagccccactggtcaagtagcaacacaattcctgatgctgtctttaagccttactcagcgtgggaggcaagtgcacactggcagttgaccatacagggagcatctggccctggccaacctcagcagctgagcagcgactcagccagccttgggttctctttgcatattccctagataggaagacaatagcagctctgtgattatctacagagggagcatctgatcttgcccagacccagtagctatgcagcaactcaacccaccattggtgttctgcttaaggctactctagactaggagccaagcccaagtccacacacatctgtggagcatagcctctggccctgcccaccctgagtgatcaagcagcaaccccagaaatctcacccagcctcagagctcagcacacgtccctgaccaactacagattccaaacaacagtaccatctagcaagaaagacaacctctaaccctggacaatcaggcaactgcagagcccaatcagcagcaccacctgtcacaggagcacagccagcagttccatttaatgtcagagcacaggtagtggcccagcccaactagagaacccaacacccacatctgcctgtctgaggttgctaccagttggcctattcagaatcccaggctatattaaatagtgaagacctcttactgagaaagaacacttgcaaaggccagaaaaggtggccatttcttcaaatgtgcaggcaccaacacaaagacagaaggattattttaaaaatcaagaaaatatgacaccaaaagaaactaataatgctccggtaatagaccctgaaatatgcaagtctatgagaccactaagaatttaagataatccccttaaagaagttcaggaaactacaagaaaatgcagatagaaaataaataacatttgaaaaatggttaatgaacaaaaagaaaagcttgacaaaggaataaaaacaataaaatagttaaaatcctagaaatgatgaatacaataactgaaccaaaatattaactagaaagcttcaacagcagacttgatcaaggcaaagaatcactgggcttgaagactggatattttaaattatccagtcagagaataaaaaagaaaaaagaataaaaaatgaaaaagacctataggaattattggacaccattaagtgtactgacttttgcataataggagtttcagaaggagatgagagagaacaagatcccgaaggcatatttaagaaaataatggctgaaaatttcccaaatgtggtgaaacacaaaaatatccaggttcaggaagcttggatgtcatcaatcaaattcaacccaaagaggattttaccaagatatatcatattccaattatcaaaaaatcagagacaaagaaagaatactgaaagcagcaagagaatgaaccatatcgcattcaagagagccccaatatggttttcagcctttctcttagcagcaatcctgcatgccaggaaagaatggcattatgtattcaaagtgttgaaggaaaagattgccaatcaagattacattactagcaaatctgtccttcagaaatgagggagaaataaaatctttcccagacaaacaaaagctatggtaattaatcattattagatctattttataaatattactaaagggagccctttaactaaaacaaaaggattataataacaaaaacatatggaagtaaaaaactcactggtaaaaataatatatagtcatattcagaattctctaatacagtaagggtggtatttaaagctaatttatccctactgtcacagttaaaagacaaaattattaaaagcacctataactaaaataaattgtaaagaaatacaaattacaaaacatgtaaattttgacatcaaaatcataagaagtggaaaggagtgaaagtgtagagtttttgtatgtgattaaagttatcagaataaaatagcctgttaaaaggatattttgtgtatgcctcatggtaaccacaacacaaaaaaaccacagcaggcggtggctggcaagatggccaaataggaacagctgcggtctgcagcccccagcaagatcaatgcagaagggaggtgatttctgcatttccaactgaggtacctggctcatctcattgggactggttagacagtgggtgcagcccacggaaagggagctgaagtagggtggggcatcacctcacctgggaagtgcaaggggttggggaactccctctcatagccaagggaagatgtgagggactgtgccatgaggaatggtgcactacaacccagatattatgcttttcccatggtctttgcaactcatagaccagaagattcccttgggtgcctacaccacccgggccctgggttttaagcacaaaactgggtggccgtttgggcagacaccaagctagctgcaggagattttcataccccagtggcacctggaatggcagcgagacagaaccattcactcccctggaaagggggctgaagccagaaagccaagtggtctagctcagtggatcccacccccatggagcccagcaagctatgatccaagggcttgaaattctcactggcagcagagcagtctggggtcaacccaggacactcgagcttggtgggcagagggacatcaccattactgaggcttgagtaggcagtttttccctcacagtgtaaacaaagccaccaggaagttcaaactctatggagcctactgcagcttggcaaagcctctgtagccagactgcctctctagattcctcctttctgggcagggcatctctgaaagaaaggcagcagccccagtcaagggcttagagataaaactcccatctccctgggacagagcacctgggggaaggagaagctgtaggcacaacttcagcagacttaaacgttcctgcctgcctgctctgaagagaacagcagctctcccagcacagtgcttgagctctgctaagggacagactgcctcttcaagtgggtccctgacccctgtgccttttgactgaaagacacctcccagcaggggtcgacagacgcctcatacaggagagctccggctggcatatggtggatgcccccctgggacgaaccttacagaggaaggagcaggcagcaatctctgctgttctgcaccctccgctgatgatacccaagcaaacagggcctggagtggacctccagtaaacttcagcagacctgcagcagagggtcctgactggtagaaggcaaactagcaaacagaaaggaatagcatcaacatcaacacaacaaaaaggatgtccacacagaaaccccattcgaaggtcaccaacatcaaaaaccaaaggtagataaatccatgaagatgaggaaaaaccagtgcaaaaaggctgaaaattcctaaaaccagaatgcctcttctgttccaaaggattacaactcctcaccagcaagggaacaaaaccggatggagaatgagtttgatgaattgacagaagtaggcttcagaaggtgggtaatagcaaactcctttgagctaaaggagcatgttctaacccaatgcaaggaagctaagaaccttgaaaaaaggttagaggagctgctaactagaataaccagtttagagaagaagataaatgacctgatggagctgaaaaacacagcatgagaactttgtgaagcatacacaagtatcaacagccaaatcgatcaagtggaagacaatgatatcagaaactgaagatcagcttaatgaaattaaacatgaagacaagattagagaaaaaaagaatgaaaaggaacaaacaatgcctccaagaaatatgggactatgtgaaaagaccaaacctacgtttgattgctatacatgaaagtgacggggagaatggaaccaagttggaaaagattctccaggatactacccaggagaacttccccaacctagtaagacaggccaacattcaaattcaggaaatacagagaacaccacaaagatactccttgagaagagcaaccccaagacacataatcgtcagattcaccaaggttgaaatgaaagaaaaaatgttaagggcagccagagagaaaggttgggttacccacaaagggaagcccatcagactaacagtggatctctctgctgaaaccctacaagccagaagagagtgagggctaatagtcaacattcttaaagaaatggattttcaacccagaatttcatatccagccaaactaagcttcataagtgaaggagaaataaaatcctttacagaaaagcaaatgctgagggattttgtcaccaccagacctgccttacaagagctcctggagaaagcactaaatatggaaaggaaaaaccagtaccagccattgcaaaaacacaccaagttgtagaaactgcatcaactaatgggcaaaataaccagctagcataataatgacaggatcaaattcacacataacaatattaaccttaaatgtaaataggctaaatgccccagttaaaagacatagactggcaaatttgataacgggtcatgacccattaatgtgctatattcgggagacccatctcacgtgcaaagacacacataggctcaaaataaagagatggaggaaatttaccaaccaaatggaaagcagaaaaaagcaggcgttgcaatcctagtctctgataaaacagactttaaacaaacaaagatcaaaagagacaaagaagggcattacataatgataaagtgatcaatgcaacaagaagagctaactatcctaaatatatatgcacccaatatagaagcacccagattcataaagcaagttcttagagacctacaaagagacttagactcccacacaataatagtggaagattttaacacccaactgtcagtattagacagatcaacgagacagaaaattaacaaggatattcaggacttgaactcagctctggaacaagtggaccctataggcagctacagaactctccaccccaaatcaacataatatatattcttctcaggaccacatcacacttattctacagttgatcacataattcgaaacagaacactcctcagcaaatgcaaaagaatgtaaatcataacaaacagcctctcggaccacagtgcaatcaaattagaactcaggattaaaaaactcactcaaaccacaaaactacatggaaactgaacaacctattcctgaatgactactgggtaaacaatgaaattaaagcagaaataaataagctctttgaaaccaatgagaacaaagacacaatgtaccagaacctctgggacacagctaaagcactgtttagagagaaatttatagcactacatgcccacaggagaaagcaggaaagatctaaaatcgacaccctaacatcacaaataaaagaactacagaagcaagagcaaacacattcaaaagctatcagaagacaagaaataactaagataagagcagaactgaaggaaatagagacacaaaaaacccttcaaaacatcaatgaatccaggaggtggttttttgaaaagattaacaaaatagatagaccgttagtgagactaataaagaagaaaagagagaggaatcaaatagacacaataaaaaatgataaaggggatatcaccactgatcccacagaaatacaaactacaatcagagaatactataaatccctctacacaaataaactagaaaatctagaagaaatggataaattcctggacacatacaccctcccaacactaaaccaggaagaagtcaaatccctgaatagaccaataacaagttctgaaattcaggcagtaactaatagcctaccaatcaaaaaaggcccaggacaagatggattcacagctgaattctaccagaggtacaaagaggagctggtactattccttcagaaactattccaaacaatagaaagagagaaactccttccctaactcattttatgaggccaccatcatcctgataccaaaacctggcagaaacacaacaaaaaaggaaaatttcaggccaatattcctgataaacatcaatgtgaaaatcctcaataaaatactggcaaagcaaatccagcagcacatcaaaaaccgtatccaccacgatcaagttggcttcatccttgggatgcaaggctggttcaacatacgcaaattaataaacgtaatccatcacataaacagaaccaatgacaaaaacattatctcaatagatgcagaaaaggccttcgataaaattaaacaccccttcatgctaaaaactctcaataaattagatgtcaatggaatgtatctcaaaataataagagctacttatgacaaacccacagccaatataatactgaatgggcaaaaactggaagcattccctttgaaaactggcacaagacaaggatgtcctctttcaccactcctattcaacatagtattggaagttctggcctgggcagtcaggcaagagaaagaaataaagggtattcaaataggaagagaggaagtcaaattgtctctgtttgcagatgataggattgcatgtttagaaaaccccggtgtctcagccccaaatctccttaagctgataagcaactttagcaaagtctcgggatacaaaatcaatgtgcaaaaatcacaagcatttctatacactaataatagacaaacagaaagccaaatcatgaatggactcccattcacaattgctacaaagagaataaaatacctaggaatctaacttacaaaggacgtgaaggacctcttcaaggagaactacaaaccactgctcaaaggaaataagagaggacacaaacaaatggaagaatattccatgctcatcgatagaaagactcaatatcatgaaaatggccatactgcccaaggtaatttatagattcaatgctatccccatcaagctaccactgactttcttcacagaattggaaaaaactactttaaagttcatatggaaccacaaaagagcccgtatagccaagacaatcctaagcaaaaagaacaaagctggaggcatcatgctacctgacttcaaactatactagaaggctacagtaaccaaaacagcatagtactgatacaaaaacagatatatagagcaatggaacagaacagaggccttaaataatgccacacatctacaaccatctgatttttgacaaacttgacaaaaataagcaatgggggaaggattccctatttaataaatggtgttgggaaaactggctagccatacgtggaaaactgaaactggactccttccttacaccttatacaaaattaactcaagatggattatagacttaaacataaaacctaaaactgtaaaaaccctagaagaaaacctagggaataacattcaggatataggcatgggcaaagacttcatgactaaaacactaaaagcaagggcaacaaaagccaaaattgacaagtgggatctagttaaactaaagagcttctgcacagcaaaagaaactatcatcagagtgaacaggcaacctacagaatgggagaaaatttttgcaatccatccatctgacaaagggctaatatccagaatctacaagaacttaaacaaatttccaagaaaaaaaacaaacaatgccatcgaaaagtgggggaaggatatgaacagacacttctcaaatgaagacatttatgtggccaacaaacgtgaaaaaaagctcatcatcactggtcattagagaaatgcaaatcaaaagcacaatgagataccatcttgtgccagttagaatggtgatcattaaaaagtcaggaaacaacccatgctggagagaatgtggagaaataggaaagtttttacactattggtggaagtgtaaattagttcaaccattgtggaagacagtgtggcgattcctcaaggatctagaaccagaaataccatttgacccagcaatcccattactaagtatatactcaaaggattataaatcattctactataaagacacatgcacacatatgtttattgcagcactgttcacaatagcaaagacttggaaccaacccaaatgcccatcaatgataggctggttaaataaaatgtgacacatatacaccattgaatactatgcagccataaacaagcataagtggaagttgaacaatgaaaacacatggacacagggaggggaatattacacactgggtcatgtcagggtgtggggggctaaggagggatagcattaggagaaatacgtaatgtagatgatgagttgatgggtgcggcaaaccagcatggcacatgtatacctatgtaacaaacctgcacattctgcaaatgtatcccataactttaagtataattatttttttcagatggagtcttgctctgtcgcccaggctggagtgcagtggcacaatcttggctcactgcaagctccccctcccgggttgacgccattctcctgcctcagtctcccaagtagctgggactacaggtgcccgccaccatgcctggctaatttttttttgtatttttagtagagacagggtttcaccatgttagctaggatggtctcgatctcctgacctcgtgatccgcccgcctcggcctcccaaagtgctgggattacaggcgtgagccactgcgcctggccaattttaagtataatttttaaaaagccacagcaattgcacaaacaataaaaaacaaaggattcaaagcatgcaactgtgagaaaacatcaaatttcaaaggaagacagccagagaagaattaaaaataaaagatctacaaaaccaacataaaacaaattataaaatggaagtctgtacctataaataaccttgaatgtaaatgggttaaattctccaattaaaatacatagactggctgaatgtatttttaaaatcaaccatatactactgtctataagtgactcacattactagtaaagacacacaaagtctgaaagtgaggggatgaaaaaggatattccatgcaaataaaaaccaaaaaaaaaaaaagcagtggtagctatacttatatgagacaaaatagactttaagtatgtaactataaaaagagaaaaaggtcattatgtaataatagagggttcaatttaccaagaacatataacaatataaatatatatgcacaaaacatcaaagcagttagtaaatattttaaggagagataaactgcaacacaatagaagtagggaacctcaaatcccactttcagcaatgaacagataatctagacacacaatcaataagaaaactttggacttaaactacatgttagagcaaatggacttaatagccatatacagaatattctatccaacaccagtagagcacacattcttctcaagtgcacattctccagaacatatcatatcttaggccacataaaaagttttaaatttaagaggattaaactcataataagtatattttcagaccacaatggtacaacctagaaatcaatagaaatcttggaaaacaggcaaatatgtggaaattaaacaacatgctttcaaacaaccatcgggtcgcaggaaaaaacaagaatgaaataaaaaatattttgagacaagcaagaatggaaacacaacacacaaaacttatggggtgcattaaaggcaaaaatgagagggaaatttatagcaatagacatctgtatcaaagaagaaggatctctaataaacagcctaatgttacacatcaaggaactagaaaaagaaaaaagaattacatccaaagaacagaacaataataagtaaggagactgacttagtaataaaaattctcccatcaaagaaaagcccaggacccagtgacatcactgatgaattctaccaaacatttaaagaaaaactgccagcatttctcaaactcttccaaaaaatgacagaggacatacttccaaacttattttacaaggtcaacattaccctgataccaatatcagacaaggacactgaaaaaaaaagaaaactacaggccaatattcctgatgaaaatagatgcaaaaattccaccccccaccaaatactagtaaaccaaataaaatagcacattaaaagaattgcccactgtgaccaagtatgatttaaccctaggatgcaaggatggttcaatatatacaaatataaatgtcatataacatataagcaaagtgaaggataaaaatcatatgataatctcaattgatacagagaaaatatttgataaattcagcaccctttcatgattaaaaatctctgaacatattaggtatacagggaatgtacttcaatacaataaaagccatatatgacaacccatagctaacattgccatggcatcctttgggtgttgcttttcctctggaaacctttgcccaagtttttcttaggcccattgggcttgttctgcccccttggccttgcaggctgtgcttggcttgtgataccagtccagatcccacacctgccaagggcgagccaggcacagagcagtgaggagtgcatgagtgagcgagcacaaaatctggccactgtgcacagccaggcatgctggctgctgtggtggagcaggcagctctaggcaccagcacaggtgccagctccatgtaaacctctgtgtggctagatcagatgcactgcaagtagcttccactgtaggcacctgtgtctggacgaggggaatgtggtggtgcctggaagcttggaaatgccagaaaccatacaggcccaaagagggtgtcacagtcctggcatgggaagcccctaggtctgggctcctggaagggctgcagctcttctctccttctcattgtctgcaacattgcaaacagggcggtgtgtatcagccctgtttgtgttacagctttttcagtcccacctttcagtggttcccaagttcttgtcccatatccaggaagaatgtggtacacagacaactggagggtaaggcagtgaggagctttattgagcaacagaacaattctcaggagacctgaagtgggtagctcctttctgcaggcaggtcatcccaacaagtgggtagctccttcctgcttctcacttcatagtcctgatgtctgtctgagtctaggggtttttatgggcccagaaggaagggagtgcatgctgattggttcatggatggccatgggtggctgggaaaaagcaccataaattctgactccaggcagtggactccacccggaactggcagcccagcccccaggcttcaggtcatccctggcttgaaggtagttagggacctgcccctttccacccaggaacctgtttcccttccaccatcaacatgccatccatggtacctgggctgttcatgctgagttggacctgcagacctgtgcagagctgccctcagccatcgtcctccctcctgtgctcactggtgctcaaagtccagaaggagctgaggaggcagaagctgtcatgtcagcactgcctccagcacatgcatacctggctgggcacaacagtgcccggactcggctacaactttgctttgcactggagtggacaccaggagcagggagagggtaggaagcagaagcaggcacttctgagcctgcaggggcagagagggtttccagggccccgagagcacagtgatgcctgggtctggagctgcggctgggtgactgcagttgtgccccagagcacaggactcctgccccgtggacttggtagagagtggggctccccccattcccagccccctcccagccccacctggctccatggagcacatggccccagccacacctcccctgctgcagccagcatcttcacagcaactgctccagacaggctgccactgttatcaacatcatacttaaacatgaaaagtggaacacttttcctgctagatcagggacaatacaagaatgcccattcttataactttttttttttttggtgtcttgctctgtcgccaggctggagtgcagtggcatgatctcagctcactgcaacctccgtcttctgggttcaagtgattctcctgcctcagcctcccgagtagctgggactacaggcacacaccaccatacccagctaattttgttgtatttttaggagagacaggttttcaccatgttggccaggatggtctcgatctcttgaccttgtgatctgcttgccttgtcctccgaaagtgctggggttacaggcgtgagccaccgccccggcacttctttctaacatagtactggatgtcctaaccagcacagttaggcaaaagaaagaaagaaaaggtatccacattggaaagaaaaaagtaaaattgtctctatttagtaataacatcatcttatatatagaaaatcctaaagacttagccaaaaaagtattggaaaaggtaaacaagtctagtaatgttgaaagatacaacatcaacatacaaagatcagtttcatttctatacactaatgaaaaactatctgaaaaagattaagaaaacaattccaatagcaacaaaaaagtacttagatataaatttaaccagagatgaaagacctggttaaaattatggaaaattataaaacactgattaaagaaattgaagaaaacacaagcaaatggaaaactatcctgtgttcataattggaagaattaatattgttttgatgtccttgactagcagagctgccgcttgccgtagtgtgctctgcaggaattgtggacgaacacagctgaagcttgccactggccactccatcccctcaaccagtgaccctgaccacttgattggtggagctgctgcctgccacatgtgactccagtgatctaaggacttgtggagtcacatgtgaccagaccaccagtgagccgaaactttcaactgtcagaggtgctgtacaccacacatgttccccaggaattgggaattagcctgcccagcatctgctcccaccagaaataccaccccctggaacagtggaggcaccacacactgcctgcatcccccagggttccaaggactggcgcactcagcacctgctgccatgacttcatatccttgattggcagagtgactacatgctgcacgcagccccccaggagtctcaggaacagcccatttggtgtccaccactgatggtggccatatctcatttacttgcagagctgctgcatgctacgtgcatcgtctaggactccaggtactggcccactcagcacctggcacctctagtaaccttgcctcctcgactggtacacccctgggaccaagtgaccagtggagctgtcatgtttggtgtgcactgcccttgcctaaaaaccagcctagctggtggccccagctccctgcaaagctgtgccattgcctccaaaactacacacagcctacaacattgacacacttgaaggtacttccaatgttgattacagctgaagcagttacatggaaattattaatataatacagcacccacgtatccaaccaacaccataggactcatctacaggaaaacatctttgcctataaaagtttccacctcagggaactagaaaaataaaaaaaagaagccccaagttgaaaatgtttgaaataacaaaaattagagcagaaatagagagtagaaaaacagaagaaaacatcaacaaaactaacaggtggtttatatataatgttattccataaaattggaagaggttattgttccaccaaatttgcagatatcaatgtaggaacccaagaaacatgaaaatccaaggaaatatgacacctccaaaggaacacagtaattcttcagtaacagactccaaggaaaataaaatctatgaatgcctgaaaaggagttcaaaataatgatcttaagaacacttagtgagacacaagagactagaaatggagaatttaacaaaatcaggaaaacaatttttcatctaaatgaaatactttttaaaagcccctttccccatttaaaaaaaaaaagaaatattcaacagagagacagatactacaaaacagagctaaacaggaatcttggagctaaggaattcaatgaatgaaataaaaacattgccatttgatggattactatagtgataaaatttgattcctttcaaatttatacaggagataaatcagaagaaagaatttctgaacttgaagacaggtattttgaaataacccagtctgatgaaaaaaagaaagagaaaaaagaatgaagaaagtatacaggacttatgaaataccattaagtgaaaaaattttcatattatgtgagtttcagaagaagagatgagagatggtgtaaataacctatttaataaaataatagctgaaaactttgcaagtcctggaagagatgtggacatccagttccaggaagcttaaaagtttccaaaatattcaacacaaaaaggtcctctacatggcacattttagtcaaattgtcaaaaggacaaacagagaattctaaaatgagcaagataaaagtgtcatgctacgtacaagagaattcccatcagactaacaacagatttctttccttcttccttccttccttccttcctttctttcttttttttttttttgatggagtcttgctctgtcgccaggctggaatccactggcacgatttcggctcactgcagcctctgactccctagttcaagtgattatcctgccttagcctctcgagtagctgggattacaggcacgcaccaccacacccagctaatttttgtatttttagtagagacggggtttcgccatgttggtcaggatggtaacagcagatttcttaacagaaatcttacaggccaagagagaaagggatactatgttcaaagtgctggaagggaaaaaaagccaactaagacatgatggccagcaaagatattcttcggaaataaagaagaaaaagatattttttagataagcaaaactgagggaatttatcaccactagatcagtcttacaagaaatgctcaagggagtcctatgtctggaagggaaaggatgataactaccatatgaaaacacctgaaggtagaaaactcactggaagaatagatatgaaaatgagaaagagaaaggaatcaaattttatcactatagtaatccatcaaacggcaaagggaaatgataagagaggaagaatcaaacttggatatacaaaataatgaacaaaaagttaacaaaatgacaggaataagtcctcactcatcaacaatacccttgaatgtaaatagtttaaattccctaattaaaatatatagattggctgaatgaatgaatgaatgaataaatgaaaaaagatcccattatatggtgcccagaagaaactcacttcacttgtaaagacacacaaagactgaaattgagggatgatgaatggtattccacacaaaaggaaaaaaaaacaagcaagaatagctatacttatattagataagatagattttaagtcaaaaactgtaaaaagggacaaagaagattattatttaatgataaaggggtcaattcaacaagaggatatagcaattgtaaatatatatgaacccaatacaaaagcaccaaaattcataaagcaaatattactagatctaaagggaaaggtagatcccaatacattaattaatgtaatgtctagctgaactgtctagctgttgaagctgggggcttcaacaccccacactcaccattggacagatcatctagacagaaaatcaacaaagtaacattggatttattgtaccctatacaccaaatgaacctagcagatatttacataacattttatccacaagctgcagaatacacattcttctcatcagcacatggaatattctgcaggatacattttatgttaggccacaaaacaacctcaacaattttttttaaaataaaaactatatcaaatatattttcagggcacaatagaataaaacaagaaatcaataacaagaacactggaaattgtacaaatacatggaaattaaacgacattcttctgaacaaccattggcttaatgcagaaattaaaaacaaagttaaagaactccttaaaacaaatgaaaatataaatacaacataccagctgggcacagtggctcatgcctgtaatcccagcactttgggaggctgaggtgggcagatcacgaggtcaaggggtcaagaccagcctgaccaacatggtgaagcaccatctctactaaaaatacaaaaaattggctgagcatggtggcactaatcccagctactcgggaggctgaggcaggagaatctcttgaaccagggaggcagaggttgcagtgagctgagatcatgctgctgcacttcagcctgggcgacagagcaagacttcatctcagaggaaaaaaaaaaaaaaagaaacacaagataccaaaacatatgggatatagtaaaagcagtactaggaggtaagtttatagcaataaatgcctacatcataaaaagtataaatatttcaagtagaaaaaactccaaacaattagcctcaagaaactagaagggcaagaagaaacaaagcccaaattttgtagaaggaaataaataataaatatcagaggagaaataaatgaaataaagaccaaaattataagacaaaagaccaacaaaataagagtttgtgttttgaaaagataaaattgacaaacccttagctggaataactatgaaaaaaagagagaagatccaaataaagaaaatcagaaaccaaaaggaggcattacaactgataccagagaaatagagaaatacaaaggatcattggagactattaagaactatatgccacggggcacaattgttcatgcctgtaatctcagcactttgggaggccaaggcaggcaaatcacttgaggtcaggagctcgaaaccagcctggccaacatggtggtgaaaccctgtctctacaaaaaaacaacaataacaacaaaaaaaacccataaaaattagctgggcttggtggcatgcacctgtagccccaactactcaggaggctgaggctgagaatcattgaacctgggaggcagaggctgcagtgagccgagattgagatgcagcctgggaaacacagcaagaagaaagaggtggaagggagggagggaggaaggaagggaggaaggaaggaaggaaggaaggaaggaaggaaggaaggaaggagagaaagaaagaactagtatatgccaacaagttggaaaatgtaaaagaagtagataaactcataaacacatggaacatactaaaatagagtcaggaaaaactagaaaacctaatcagactaataatgagtaacaagagtgaatcagcagtaggaagtatcccaacaaacaaaagcccaaaacaagatgacttcactgctggattctattaaacttttaaagaactaacaccttctcttcttaaagtattacaaaaagttgaaggggtgggaattcttccaaactcattccatgaggacagtattatcctgatgccaaaatcagaaaagaatacaacaaaaaggagaatgctacaggccaatattcattatgaacatagatgcaaaaattctcaacaaaatactagcaatccaaatccaatagcatatcaaaaagaatatacaccatgattaagtgggattgattctagggatgcaaggatggttcaacatatggaaatcaataaatttgatatatcacatcaacagaatgaagaccaaaaagtatatgatcatctcaatagacattaaaaaatatttgatgaaattcaacatcctgcatgatataaactctcaacagtttagatgtagaagaaatgtacctcaacacaatcaaggtcacatatgacaaactcacagctaacatcatacagaatggggaaaagttgaaagcttttcaataagaactggaacaagacaaggatgcccacttttactactcttattcaacaaagtactggaagtcctagccggagcaatcaggcaagagcaaaaaataaatggcatctaaattggaaaggagaaagtctaattgtccctgtttgcagacaacatgatctttatataaaaaaactaaagattccatcaaaaaaacctcttagaactgataaacaaattcagtaatgttgcaggatacaaaatcaacatataaattcagtagtgtttctacacaccaataacaaactagttgaaaaagaatcaagaaagcagtatcatttacaatagctacaacaaaataaaataccaaggaataagtttaaccaaggaggtgaagatctatacaataaaaactacaaaacattgatgaaaagaactgaagggaacacaaacaaatgaaaagataccccatgttcctgatgtaagagaattaagattggtaaaatgaccacactacccaaagtgatctacagagtcaatgcaatccttatcaaaataccaatgacattctttaaagaaataaaaaccaaaatcctaaaattcatatggagccacaaaagactccaaacagccaaaacattactgaataaaagaacaaagctggaagtatcacactatggagcttcaaaatacactacaaaagcatgctagccaagacagcgtggtactagcataaaagcagacacacagaagaatgagacagaatacaaaacccagatataaatccacatatttacagtcagctcacttttgagaaaggtgccaagaatatatattagagaaaagagtctcttcaaaaaatagtgctgcatttgctagtatcaatatgcagaagaatgaactaacccctatctctcaccatatataaaaataaactcttgatgaattaaaggctaaaatgtaaaacctgaaactataaagctactagaagaaaacataggaaaaatgcttcaggacattggactgggcaataatttttttttatgtgatttcaaaaccacagacaataaaagcagaaacagacaagtgtgattatatcaaactgaaaagcttttgcacaacaaaggaaataattaacagagtgaagaggtaacttacagaatgggagaaaatatttgcaaactatacatctgactaggtattcatatccaggatataaggaactcaaacaactcaagagtgaaaaaacccaaataatccaatcacaaaagggaagatagacttttttttttttttttttttttgaggcagagtctcgctctgtcgcccagactgcagtgcaatggcgcaatcttggctcactacaacctcagcttcctgggttcaagtgattctcctgcctcagcctcccgagtagctgggattacagacaccatccaccacacccagctaatttttatatttttagtagagacggggtttcaccaggttggccaggctggtctctaactcctgacctcaggtgatccatccagcctcccaaagtgctgggattacaggcatgagccaccgtgcctggccaggatgatagaccttatatacatttcttaaaagaaaacatacaaatgaacaacagatatataaaaatctgttcagtatcactagtcatcagggaaatgcaaatcaaaactacaatgagataaaacattactcaagttaaaattgctattatcaaaaagacaaaagataacaattgttgatgtggagaagaggaacacttacacaccattggtgggattttcaattagtgtgttcattatggaaaacactatggagatttctcaaaacattaaaaacaaaactaccatagatccagcaatcaaagtactgagtatacccaaaagaaagaaaatcaacatgttgaagaaatctgcactcctatgtttatttcagcactattcacaatagctaagatatggaatcaacctaagtgtttattaacaaattaatgaaaagcaaatatgatgtatatacaaaatagaatattattcagtaataaaaagagtgaaatcctattatttgcaacaacatggatgaacttagaagacactacgttaagttacattaaaccatacatgatctcacccataagtggaatccaataaatggatctcatagaggtacagaatctagaagacattaagtaaattaagccagacacagaaatacaaatatcacatgatctcacccacatatggaatccaaaaagtttatctcatagaagtagagaagtaggggttaccagagactggtggagctggggatagggtagagggaggaatggagaaagactggccaatgcatacaaagttacaattagataggaagaaaatgttctggtgtcctgttgcatagcaaagtgactatagttaacaagaatgtatagtatatttcagaatagctagaagagaggattttgaatgttctcaccacaaagacacgacaagtgtttgaggtgatggaaatgatcattacacaatgtatacatgtatcacgacatcacattgtaccacataaatatgtacagttattatgaggcaattaaaattcttttaaaaagctgatctcatagaagtagaaagtggaatagtggttactagaggctggtaagggtagagggattgcaggggatgaggagaggttgatcaggtacaaaattatatttaaatagcagcaataagttccagtcttctattgcacagtagggtaactataattaccaataacatattacatatctcaaaatagctagaaaagaggattttgaatgttctcaccttaaatgatcaatgttttaggtgataccttaatttgatcattacatattgtacacatatatcaaagcaccattttgtaccctgtaaatatgaacaattattacatcaatacaaagtaaaataaaacttaaaaaactgaacacaaataaaggaaatatattccatgttcagggattggaaggattagcattgttaaaatgtttatactacccaaagctatttacagattcaatacagtctctctcaagattctaacgtcacttttcacagataaagaaaaaaggaatccttaaattcatatggaatcacaaaagatctcaaatagccaaagcaatcttgagcaaaaataacaaagttagagtcacaatactctgatttcaaaatataaagtgattataattaaaacgtcctggggctggcacaaaagcggacacatcactcaatggaacaggatggaaagtttggaagtacgcccatgtgtttatgaacaattgatttttgaaaaaggtgccaagaacacaggatgaagaaaggacagtctcttcaataaatgatattgaaacaagtggatatccacatgcacatgtgtgaaattgaacccttatctcacaccatgtacaaaaacgaactcagattaaaaagttaaacataagacctgcaactataaaactgctagaagaaaatatatgggcaaagctccatgacattgatcttggcaataatttttttgaatatgacataaaaagcacagacaaaaaagcaaaaatagacaaatgggattacatcaaactaaaaagcttctgtacagcaaagaaaacagttaacaaggtgaaggactacccacagagtgagagaaaatatttgcaaaccaaacagctgatagagggttaataaccaaaatatataagaaattcaaacagctcaatagaaagaaaacaaataacctgatcttaaaaaaggggaaaggacctgaacaaacatttctcaaaattacatttaagtggacaacagggagagtgtaggcttgcgctaactctcttctttcacctagttgcactcctgagagcaagatgggtcaccagcagctgtactggagccactcatgaaaattcggtcagggttcttgctcttgtcgagtctgatccggaaatatggcctcaatatgtgctggcagtgtttccatcagcacgcaaaggacatatgtttcattaagttgaactaagtgctcttccttgaatggattatccaaggcatctacgcaatgaaaaaccatgatagctctttgtacataaaataaacattaataaataaataaataaataaataaataaatggacaacaggtacatgaagaaatgctcagcatctctaatcattgtggaaacgcaaattaaaccacaatgagatatcaccttacacctctttgaatggctattatcaaaaagattaaagataagtgttggcaaggatgctgagaaaaggaactcatacattattggtgggaatgtaaattagtatggcaattatggaaaactgtatggagttttcttaaaaaactaagaatagaactactctatgattcagcagtcctacttgtgggaatatatgaaaatggattgtaatcaatatgttgatggaatagctgtattactcacaattgctaaattcagtctaagtgtccatcattcagatgaatggataaagaaaatgtgatctataaatacaatggaatacaatatttagcctttaaaaaaaggatggacattttgtcgtttgcaactccgaggataaacctgaaggacattatgctaagtgaaataagccaagcacagaaagatgaatctcttgtgatctgatatatgtcaaagctaaaaaagttgaactcataacaatagagagtagaatgttaccagaggctggggcagagggcaagagagaatggggagttgttggtcaaagggtgcaaagattgagatagacaagaggaatatgttttgaagtctactgaagaacagggtgactgtagttaacaataatatattgtatatttcagaataacagaaagaataaaatttaaatgtctcatcataaaaatgataagtaagggagatgatggatgtcttaattagcttgatttaatcattccacattgtaggcatgtatcaaagagtcacaccgtacccattaatatgtatgtgatttgtcaatttaaataatagtaataaaaggagggaagagatagtttttcagacaagatgcaaatattttaagacatcagttctctctgaattgatctatagattcaatacaattccattcaaaatctcagcagaattttcttagaacttgacaagtcaatacaaaaatttatgtcgcagagcaaagttgccaaggcacaactgaataagaagtgaggaaacttagtctagtttataccaagacatatcccggaactgtggtgattaagccactcaaaattattggcacaaaagtggacaagtagacaaatgacacagagcagagagcccagaaacaaatccaaacctaaacagaaagcttattgggtcagaggtgatgctgcacgtatcagtgtgtaaaggaatgtccattcaataaatgttggcacagtcgttatctgttgagaagaaaattaaatagaaccactacctcattttataacaaaagtacaatcaaagtattaagcctataggagaatttatagaaacctatttcttccattgtggggaacaaggtgactccttaaagaagaattgaattgtgtcttttgttcaccaataactaaaatgtctgtgggattgtttttcagatacctttttcgagcctatatcgtggcacctggctaccaaagtactgggaatactctgctgtggcctattttttggcattgttggactgaagattttcttctccaaattccagtgtaagcgagagagagaagcatgggccggtgccttattcatggttccagcagggacaggatcagagatgctcccacatccagctgcttctcttcttctagtcctagcctccaggggcccaggcccaaaaaagtaatcatccttctctagggtattctaacatctcttcctctggaaatatcaactacgacagccccttgctacttcatttaggtcaaataataaggggatgaatgattttcagtacctatagagagagcttggataattttccatgaacaccaccaagactcctattaaaaagttttaatgtggtgaacaaattcataaaggaggaagcaaaagtgactgacaataagataaaattatattcagtctcaataagacttttcacccccaaaaccaatttcctcctccttgggagtgacacttccccttgggggtgaggccacccccgcctcccctcccagctgccttctcccatctccatccccacctccacagcatcccagctgttgtccctctccttagcatgcaccttcctgatctcttgctccaccccagagagccacactccgtgcaggagctggggagacgagcacatataagtgtcctaggagaggccctgcccttcacacctgcagctcgtcccacctgtgcaaggagccagcgtcgtgtttgtgccttgtacactcctgtgtccaccactgaatatactgtttctgtttcagggaaaatccaggcggaactgggtaagtatgtgtcatgtcctgagcctcccacacatggttctcccgggtccctccctgatccacagtttgagcctctggacgaccctggctgcaggctggacaggaagcaccggcaggtggaggagagcagctgctcgctctctccatccactgctcatgagttacccctcggacatctggagggcttaggataggccccggggcctggaagtccccacaaattgtctgtgcctgttgcccgttggtttgctgtgtgtgtggtgggggaaggtgttgatcatgagctctgagggtgtctgggccacagtgaggaacctgagaaaaatttgtgggtgatcctcgacctcccctggcctgatgctttgagactttatccagttctgtatcaaccactaaatagtctgctttttgttttgtgggaactccaggataaactgggtgagagtgttaccactcgcagggattccctcccacgccctccctgggcccccgctctgtgacgtcagcctcttacatgttttttgtttttgtttttgtttttcagactggagaagaaagcacggacaggcaggtaaaagaaaatattcctcttcacacatttatgactcctttccaagtctctcgtttatggatttttatatcctgaggcccgtgggtccctgcagagccaagcttgtgatgggaactctgaaattgcagattctgggggaggtgcattttgtagagaagccccatagccttcttcggatctctggagggtccacaacactcaaaaagggtcccaatccttggtctttcccttctccctgcgccctgtttcccacgtgagcactgaactgcctgctctgtctgcttgctttcagaattgagagacgcccggaaacacgcaggtaccaacgcctgagagggtgacagtgggacagaatctcaggtggacatgagagggggaactgaacagggacagatacgggaacacagagtgatgctgagacccatcctgcctgcagatggagaaactggatgcttgatcgcccccaagggttcagtgcccccagacacacttctttcccttggtctagaaggggagaagacaggggctgggtaaacgggagacgggggggtctttggcacagtttcagggaattgagggcactagtgactggtcaggggtctgagctgaggggaaggaagtaaagtcaggcagaaaattctgagtgggaggaagttagatagtggggtccctccagctcttatgaatcaaatagttttatgtatgaagggacagtggcagggttgggtgatatgccgagattgggacgtcatattgagacatatctagacattgatgagtcctccaggctgcactggtgatgagaggacctgaaaggcagtgtctgcgggaggctcaggtccggggcctcacctatgccacccagagccagtctgcagtgggagggtcgacctcttgctccagcccagatttcgtcttcagtaactcatgcttcctctctcccccaccgcaccccagtggaggtgactctggatccagagacggctcacccgaagctctgcgtttctgatctgaaaactgtaacccatagaaaagctccccaggaggtgcctcactctgagaagagatttacaaggaagagtgtggtggcttctcagagtttccaagcagggaaacattactgggaggtggacggaggacacaataaaaggtggcgcgtgggagtgtgccgggatgatgtggacaggaggaaggagtacgtgactttgtctcccgatcatgggtactgggtcctcagactgaatggagaacatttgtatttcacattaaatccccgttttatcagcgtcttccccaggaccccacctacaaaaataggggtcttcctggactatgagtgtgggaccatctccttcttcaacataaatgaccagtcccttatttataccctgacatgtcggtttgaaggcttattgaggccctacattgagtatccgtcctataatgagcaaaatggaactcccatagtcatctgcccagtcacccaggaatcagagaaagaggcctcttggcaaagggcctctgcaatcccagagacaagcaacagtgagtcctcctcacaggcaaccacgcccttcctccccaggggtgaaatgtaggatgaatcacatcccacattcttctttagggatattaaggtctctctcccagatccaaagtcccgcagcagccggccaaggtggcttccagatgaagggggactggcctgtccacatgggagtcaggtgtcatggctgccctgagctgggagggaagaaggctgacattacatttagtttgctctcactccatctggctaagtgatcttgaaataccacctctcaggtgaagaaccgtcaggaattcccatctcacaggctgtggtgtagattaagtagacaaggaatgtgaataatgcttagatcttattgatgacagagtgtatcctaatggtttgttcattatattacactttcagtaa

SEQ ID NO: 974 - DNA, 51830 bp, Homo sapiens; identical to SEQ ID NO: 969

SEQ ID NO: 975 - DNA, 5768 bp, Homo sapiens
gttggaaaatcccactttacttcaagtgaagtcactgggttgtccccatgaaatatctccacaatgggtgtgctagacctttactctctgtggcaccaccaagaccccctcaccctgccagagccctctgaagtgtactcagaatggaggggctggaagtggggccagtggtcctggtagtcagcctccccttctgacacaagaattatcgtggaacagcttgtgtgaccgatcaactggtctctccatctttaagccattgtcttgttgactctgttactgcagagtttggggaggtctcatggcttctcgcatcctatttcctgagcttccctgaagccaacttctggccactggtatgtgatgcgagcacagtgcctcctcctgctcctccaggaagcttctgctgattgaacgcaggccagatggcgagatccggagcaaccttcttagatcaagggaagaaaggggcacaagaggggagtaggtaacaagataaaaggagctccctccctgatgactacagagccatcgtggcagccctgggcctccatttcagacgttcatcttgcctaagccaccaccatcagggtctcagtcagtcatcattctcatttactcgggtggctgggtgagggcggaatactaccttccagctgtctgagattaagcctaagccaccaccatcagggtctcagtcagtcatcattctcatttactcgggtggctgggcgagggcggaatactaccttccagctgtctgagattaagcagaacagcagctaaagcagtaacagcaggtctccttcagcagcttgccacagggaagagggtcccgcgtgaaccgaactcaacttccacctgcgcagaggtagctaccatttgcgtagaggtagctgggtctttaaggttagagggaaggcgcagggagggagagacggcgggtgggggttgaacaaagtggagattcacaaaagcagactagggcgggcgacgtgatcagatgacctgtgcgggcggcagcctcctgccctcctccccttcgtgcgccggctggagcgaagagttcttttgacagccgtgagcttccccgccaggaacttactggggctgcatcaccctagaaacgtggctttgggctgtggaaacgctgcctctgtggaagtctctcctcgcgggggtggacgggtcgctgcgcgcccagcgttcttctgcggttctcacagcccgccgccgccgccgcctcggggacctttgcggggaggcctcaggtcagcgccgcccttgcgatggcgggagagcagagcggccccagggcctctgagctccggccccggcacgtcccgccctctcctccgcttgcgggagccggggcgcctcggagggaaaccttccggacacaggccgggagaagaggggccgtggcgccatcgcgcagcttcctggtttcggccatgtttttttttttttgagacggagtttcgctctttttgcccaggctggagggcaatggcgccgtctcggctccctgcagccgccgcctcccgggttgaagggactctccggcctcaggccgcggtgttcttgtaaattagaaccggcctatgcgccaagcgcgggtctcgcggctgcggagagaggcccagcagggggcggggacgccgggaggcggggcctggccgagctgcgcacacccgggtggttctggctacgggtacccggacctgcccaacgaccgttctccattcccgacctccgcaccctacccggtccgcagggcaccttcctcctctctctcaggcacgtcctcgacctcagttgccacgtgcacatgctggtgccttccaggtcggtctttctccaccagactccacctggaactttcttccttttcgtcctgtgctggcctaacccctgctcggcctcggccctcagctgccggctctaacaaagcctctgtctttcccagacccctgtgaccaggtcaggctctgctccctgcgttcctctctccttgcttccctcctcctcccctccccagaatcgcttgaacctgggaggcagacgttgcagtgagctgagatcgcaccattgcactccagcctgggtgacaagagcgagactccatctcaaaacaaaaaacaaaaaacacaactcttgctggctccttgattttagcccagtgagattcacttctaatttctttttttctttgagacagtctgttctgtcacccaggctggagtgcagtggcgtaatcatggctcactgcagcctcaaccttcctggactcaagtgaaccttccacctcagcctcccaggtagccgggactacaggggtgcaccagcatgcctggctaatttttgcattttttgtagagatggggtttcactatgttgcccaggctggtctgaaactcctgtgccccagcagtcctcctgccttggtctcccaaagttctgagattacaggcatgagccactgcgcctgggcttccatttctgatttccaaaactctaggataataaatttacattgttttaagccaccaaattgtagtaatctgttacagcagcaataagaaatgaatacagccatgcttgataattcctttatcaaaagctacctattggtgttaggaagtattgttttaaattctaagacagtgttttcactttctatcttgtgcactgactacctcatgaccccttaggtaccagtcaggactggtagactttaatgtggagaacttctgaaacagcagttctcaaaatgttacctccagacacacagaatctgcatcacccaggaacttgtaaccatgcaaattctcagccacccagacttcctgcatcagaaactctggggcccagcagcctgtgttttaacaaagcccttcaggtgattctgacacttgctcaagtttgagaaccgctgttctaggagctggtcctgcagggaaagggtggcctctcagttcaggttccagtgtggctgggggtgggggtcaaggtgagggtttggttgttgtgtctgacagtcagccaggcttgagcacacggactgtttacaaggctgcactttccatgttctggtcagcagtctcctggttcattccgttacgaatggactgtcaccccaaaattaatgttgaaatctatttctctatttggaggtggggcctttgggaggtaattaggtcatgagagtggagccctcatgaatggaatgactgcctaagagaacagagatggctcacacctgtaatcccagcactttgggaggctgaggtgggcggatcacgaggtcaagagatcgagaccatcctggctaacacggtgaaaccccatctccactaaaatacaaaaaattaaccaggtgtggcagcgggtgcctgtagtcccagctactcaggaggctgaggcaggagaatggtgtaaacctgggaggcagagctttcagtgagctgagactgcgccactgcactccagcctgggcgatacggtgaaactctgtctcaaaaaaaaaaaaaaaaaaagagaacagagagctagcttgctgattttctgccatatgaggatacagtaagagggcagccatctgcaacttgtaagatgaccctcaccataacgtgaccatgctggcaccacgatctcagacttctaacccccagaactgagaaataaatttctccaccactctatgacacggtattttttttttttttttgagatggagtctcgctctattgcccaggctggagcgcagtggcacgatctcggctcactgcaacctctgcctcccgggttcaagcgattctcctgcctcagcctcctgagtagctgggattacaggtatgcgccaccacacctggctaagttttgtatttttaatagagatggggtttcaccgtgttagccaggatggtctcgatctcctgacctcatgatccgcccgcctcggcctcccaaagtgctgggattacaggcgtgagccactgcgcccagctggcatggtatttgttatagcaacccaagctaagacactccatgttatggactgaatgctcgtctgcccccaaagtttctatgctgagatcctaacccctttgtgatggtaacaggaagtgggaactttgggaagtaactaattaggccatgatggtagggccctcatgagtgggattagtggctgtcttagtccattttgtgctgctataatagaatacccgagactgggtaatttatatagaacagatgtttgttctctcacagctgttgcattagggatagatggaaagacttatttatgtattgactgactgattgatggggccttgttctgttgcctaggctggagtatagtggcatgatcatagatcactgcagcctcaaactcctgggctcaagcgatcctcccacctcagcctccatatagctggtggggaccaagtttctaacacatgaatgttgggagacacattcagaccatcgcagtggccttataaaaagagacacaagagcttgctctctgccatgtgagaataccacaagaagactgtcctcagcaaatcagaaagcgggtggaccctcatcagacaccagatgtgcctgcaccttgatcttggacttgccagccttcagaacagtaagaaagaaatgtgtgttgtttaagccacccagtctatggtaacttgctatagcagcccactaggagaccccaagatatttaaaaactcatcagcacctgctttctgcatctggaccctgatcttctggtgggtttaccagttacttgtagagtgtccctgtgatagttttaggtgtcaacttgacaggattgagggatgcctagatggctggggaagcactgtttctgagaaggaccatgtttttggaggagactgttttatgagtgaatttcaggggacacattcagatcatggcagtggcattataaagagagacacaaaagcttgctctctctctctgccatgtaagactaccacacaaagactgccatctgcaaaccagaagcaggtgggctttcctcagacaccagatctgcctgcaccttgatcttggacttgccagccttcagaactctaagaaagaaatggtagcatggcttggtctaagttggaaggcctgagaaacaagcacatggtggaactgagttcaaggataaagacttgagaatacctgctcagtggactgagtagggaagatcaaccctcaatgtaggcaggcactatccaatcacctgagggcccagatggaacaaaaaggtggaagaagggtgaattctctcttccagagctgtgacacccttctcatgcccttgtaccacacaactctaggtcctttggcctttggactctgacacttgcaccagtggccctctggggctctcaagcctttagccttgaacttagttacaccatgtgcctccttgtttctcaggccttccaacttggatcaggccatgccaccggcttctctgattctccagcttgcagatggtatattgtgaccctggcatttaataactatgactttggtcttaagcaattttcttcctctgtggattgatatttacatatcaatgtggataataatttcttaccacggtaactgttgtgaggtaaaaatgagttaacataagtaaaaccgagcacatgcaaaccatccgaaatggttaatacttactatttgtacttgaagaaataaatgtttttgacaataaacttcttgtgcagttttcctca

SEQ ID NO: 976 - DNA, 13674 bp, Homo sapiens
ttgatttaaggaatttctttattggaattccactttacctcgccacaaggagctggctttcatgacaaagagagagtgagccctgaacaaagtattcgttaacattttacaacagacaacatatacatgtcctgcatgacatctttacaataacacattccaaaaacaatcaaacatttaacaggattattaagaaacattaatttccttctctctagatgactggtactttagctttttagcttctgcaataaaatgcgttccttctcagcatttctattcataggaatccctgaatcacttctgtcatgtaaggtgcgaattcatgttgacggtgtgttccattagttactgaatgtgtcaaaatcctctccacggtagaaccttttattgtagcataatgtgtgaataccacttccaggttatccctcatcacaaattcatcattcattatgggagttcatctgaaactttaaaaaagtttcatccattcaactaatgtatcacaatagtacgttcatcaatttgcattttttatgagtgactctctcctatctcctgttagacttgtaagtctatgctttctacttttcctaaaaggaaatccaaattttgtttcagaagtcatcatcactgccccctcccaaaccaattacatcaagtttatacttaaagaccactaatattaaataaatttatattccctgaaacctatcctccctgaatttgcctgttggaggcccttagttttcccactgaccaatgtgtaattgggattcaaagctatacctgaatttcctacatttctagtaacagaatttaccaaacatgaactttctgatggtgattacgtaacttctaattgaagccctttcctcatctgtgttttatgtccagaaatgtctactgattttgaagatttgcttcacattccatcactcagatctaagtttttctctcaagtatggactgttttatatcctgtaagagctgaactaccttgacactggagcctttcttgcttgctatgattgaaaatcacatagaaaggattcctcataatcctctaggatggtttcatttacactgtgtaaattacaagccatgaccccctacattcttacattcataaggtatttcttccatttgagttcggagagacttggtaagctctgcctgctacagaggcatcctcatcctgcccccatccagggcattccctccctcataggttctcttctgggatgtgccactataacttcccacatatatcacatttaaagattcctctccagtatgggttcttttatgcttggtgagatttgatctgatattaaaagccttaccacactcattacatcggtatggcttctttccagtgtggatccttttgtgctggtcaaggactgatctataattgaaggatttcccacactcacaattatagggctgcttcccctggtggacacttttatgattgataagacttgagtgtgagatgtatgccttcccacactcatcacattcatagggtttctcacctgtgtggatccttttatgcactgtgaggcctgagctgttcctgaaggccttcccacacctatcacacacatagggtttctcccctgtgtggatcctcttgtgctgagaaaggagagagctgtaactgaaagatttcccacactcaacacacttgaagggtttctccccaagatggactcttttatggcttataagagttctgcttgagaaaaaagcttttccacattcatcacatgtatggggtgtcctgccagggtgggtactcttatggttaataaggcttgagtgtgagatgtaggcttttccacacacatcacattcatagggcctctccccagtatggattcttttatgaactttaaggcttgagttgtttctgaagaccttctcacacctgtcacattcatagggtttctctctagtgtggacccttctgtgctgagaaaggagcgatgtgtaattaaaagatttctcacacacatcacatttgtagggcttctccccaagatgaacttttttgtggtttgtaagggttcggtatgtgatgaaggccttctcacactcgtcacacttaaagggcttctccccagggtgtacacttttatgatttataaggctcgagagagagatgtatgctttcccacattcttcacatttgtaaggtcgttccccagtgtggattcgtttatgtactttaaggccagaattatttctgaaagctttaccacactcatcacacccaaagggtttttccctggtatgaatccttttatgctgttcaagggcagagctgtagttgaaggatttctcacaatagctacatttatagggcttctccccaaggtggattcctttgtgatttttaaggctagagcgtgagatataggctttcccacacacatcacacttatatggtttttccccagtatggagcctcctgtggactttgaggcctgcattgtttctgaacgttttcccacacacatcacatacataaggtctctctccggtatgaatagttctgtgttgaagaagtagtgagttataactaaaggatttcccacactccttacattcatgggctttcttcccagggtgaatgcttttatggactgcgaggcctgagctatagctgaatgctttgccacagacatcacacttgtaaggtttctctcctgtgtggatccttttatgcactatgaggcctgagctgttcctgaaagccttcccacattcatcacattcataaggtttctctccagtgtggatgactttatgctgaatgagaagagagctataattaaaagatttctcacactcatcacatttatagggtttatctccaaagtggatgcttttatggttgagaagtgttctacaagtaatgaaggccttcccacactcatcacattcgtaaggtttctcacctgtgtggatccttttatggaccctaaggccagagctgttactgaaggttttcccacagatgtcgcattcatagggcttctcccccgtgtggatccttttgtggactctgagcccagagctgttcctgaaggccttcccacactcaccacattcatagggcttctccccagtgtggatccttttatgctggtccagaacagagctataattgaaggattttccacattcatcacatttacagttcttctccccagaatgggtgcttttgtggtttataaggctggagtaggacatgtaggctttcccacattcctcacacttgtacggcttctccccagtgtggatccgtttgtggacccgaaggctcgagctgctccggaaagtccctccacagtcatcacattcatagcgcttttccccagtgtgcataattttatgttgaacaaggcgggaattatatttgaaggatttcccacattcatcacatttatgtaatttcttaacagcattggttttctgctgtagactagggtaggaggttccattaatgttctccacacgtttgccttgctcactgcctctctgtcctataggcatagtctggtgtgtgatatgctgtgggctcagatgcaagctcttctcagatgcctcaccttcctgttctgtctttatatttgctgtactcttggctttgctgattgcttccctgatgctgcttttgtcctccttcatcctgttttccacaggctttttctgttgattctctaccttgctatcccaaacacatgtgtcaccaaccttagattcaggcataggatcctccacttttggccacttagatgctgcatttccaacattttcatattcttcagttggttcctcatcctcagtgctcgtcttcaaatgtgacactaaaccaagaaaatgaaaaggacacctattcactctcttaaaaaaaaacaaaaacaaactggaataacaatgaacaacattcacttgacaaacatttactgacaacatactgtgtgacaggtaccatgtgccatgtaccggtttttaagtactagggatacaacaatgaatatgacaaaatttctgcccctgtggaactaatgttaaaatgctagaaccctggattttcaatggaacaatgagcttttctattcttgcataacagcttagcatagggcagggtgaaatgatgcacagaaccatgggcaacaccaatcagtttttaaacaatgtcacccagtcatggaaaaacaaacaagagggcagaagaaatctctgaagaagacagaaaaattcataagtaggacaaaagttaggtaaaacttttttttattatgaaaagttagacaaaatcagcagaggacagacaaaactaaagagaaaaaattagtacctggggaggggtatcagggagaaggctatgaaaccatgaagacagttactgcagagatgaggaagaaggcaacctgcatattaaaatatattattaaacgtctataattaaaatagtatggtcctggtacatagacaggcaaatggaatagaacaggaagtccagacattgtcccaggtagacacagaaattaatgatacagatgatatctgaaattaccagagaaaagatggtccttttaatagtgttgtaacaactatgaagccatatggaaaaagataaaattaaggctgggtgcagtggctcacacctgtaatcccaccactttgagaagctgaggtgggcggatcacgaggtcaagagatcgagaccatcctggccaacatggttaagccgtctctagtaaaaatacaaaaattagctgggcgtgatggcacgcacctctaatcccagctacttgggaggctgagggaggagaatcacttgaacctgggaggcagaggttgcagtgagccgagatcgttccactgcactccagcctggtgacagagcaagactccgtctcacaaaaaaaaaaaaaaaaaaagatacaattagatcccattcttcacaccatacacacatgaataaactccatatggaatagagctctaaatataaaaaagctgtacaaatgccagaaaacatgggtaaatgcctctctggcctgagtatagaggaagctttctaatgatgactcatatgcaacaaaagactgatacattttcaaaaactgaagaaaaataaactacaaatcatacaggaaaacaggtaaaaagatgaacaaacaattcttttaaatggtccttaaacattcgacttgattcataatgagagaaagataaataagaactactgtaaaacaccacttctcacctgtcatattagcaaatgttcaaagcttgacaatacactgttgataaggctgtggaggaaacaggcactctcatacactgctgggaatgcaaactggcacagccccttttaaggggaatttgccaatatctatcaaaactacatatgcatttacccagaagtcctactttaggaatttataatgaagatacacctccaacaatataaaaaacatacatgcacagagtgactcattatagcattaattgtaactgcaaaatctggaaacctacataaatctccaagcacagaagactggttaaataaactggagcatatacacaacggagtactgaaaaaggacgaggagcgcttctgaattgatatggagcaatctgtatatcctaaagtcaaaaggtcaaagtgaaaaagagtaatatacatgctacgtttcgtgtaggaaagaaaacaggaaaacaagcacgtatgtgtttctctttatagcaacgataaaccagagaacaatgaggttcatcacctacaagggaggagtgtggagaatggagcagaagggatgggagaaagagagagactccgagtatatagcctttttaatagtttttactatacaaaatacataatattctacatattcaaagaataaaattaaacatcagtgaggatgggaaaggagaaaaactgctaaaacaaaacaaatcaacctatttgcatttcccatgaataccacaatcgcaggaagagaacaaaaaagaaatacagaagtaatccaggcaacttagaaacgtatttgactacgtaagtacattcagtctggggaaagctggaggcggggcagtgggaagaggtacaaataattcaactgttagcaggttttctgtagaggtatgaacaaagcgattctgaaacaactttagatgtattaagaacctgagtaaatgtgttgattttgttgggctcagggctctcctagagaaagggacataaaaataagcaagagaagaaggcgaaaatgaaccttgggatgaatttgcagtactggtgtgaacttatgatttctaaatcacatatatgtgcatgcatgtatattcaagcctgtatggctgtatgcatatatttgcatatatttcctgatttcctagttctgtttgctgaaagcccaaaaaacaaaacactccagtggtaatgagcacatctagtaccccattctgggtctactattaccattatttactaaaaggaaccagagctcctcaaagaaatggctgattgcaggctgaaagcaggaaacatacaagatgagcatcatgctataccagcaagtaaagagaggctcaaaaaaagggtagggacacgctgcaagacccagcttgaacatccagtgttcaagcaccgtaataactaagtatagtgatacattataaaccactgaagataggatttcatgagtctacacaggtacaaacaggggagaaagggaggcctcttgcttacagcagaatgtgagtgctggttgataaatgtagaaggaataccagaattggaaaagtcagcactctgcaactatcagagtaaagactggatcaggagagaatcatcagtgaattctacgtctaggaggaaattctgacaaggagcaggatatccgcatggtcttaaatatttataatgcttaaattatttacaagggggaaaaatacaagagtggagagacaatgccttggccaggtgttctaatttaacacctccagaggggcagatagacataatatgcttttagtagggagaaggacacatcacctatgagaatgcattacatgaactgaatcaccaggtaaacccaaaacgaacaatgttttctactaaaacagagggtggagagaagaggggggactgtatttttcaaatacatcattttcataaaagacaaagaagagctgtacaaatgttccagattaaagaaggctaaagagacttgaccactatattacattcctgaccttgactggatctgtagcggaggggaaaattgttatagaaaacaattacatcagctgaaaaagttggaaaatggatggtagactaggtaaaagcagtatcaacttccaatttactcaatttgaaaacttactgtagttatctatgagactatcccaatccttaggaaatatacgctgaagtatttagggataaagggccatgatgtatataattacctacaaatggtttagaaaaatacttgcatgtatgaaagagagagcaagaggacaaaatgaagtcaaatgttaactgcaggtaaatctgagtgatgggaatctttttactgttcgtattcttgaattttttctgtgcatttgaagttattaccaaacaaaaagtttttaaagtatcagaaagcaaatttgtttcctcttctacaccttcccctccaggtactgctttgccatcctactgcctgttgtatctggaaaaagtggtcttcacatcccactcctctcatgcctcatttcttccacgcagaccacactgcattagcgtcttcaggctgctgcttgccctccgcgctgctgcccctggatgtttctggcccctccttccaccttgagacattcctctcctggctccacatattcccctgggagccctcatggctcccagcactcccacacaccgtctcaggtcctcatctctgcccaggatccctctcaattacagagcctcatatccaccttgccacccacacttttgcctaaatcagaaatgggctacttcccttggccacatccaaaacagcccctaggaccgctgattctattgcctaagtagttctgaagctcccaccccatcccccacctccttcttactgctaaggccttagtttgagccttctaaattctcttctgcatgactgccatcgtttctagaccttcactcttatccctgcccaattctttctccaaccactgtgaagaatttttgtaaaatgcacacctagtcactgggcagtgccaagttctcccaggctacttactgtggcacctaaagccttctgcaccagccgcctgtgcaactgtcaaccctcactgccactccactcactgattctcagcctgatctgtcctcctttgtttctttgacaagtggattattcgttttcttcctgtcctctgggattccatgttagactggctgctgactggcctggtctgcctaaaatcacagacactttgccacttacctctctaacctaggtgaaggccaggggcctccctgttctggctctgcttaaacccctctgtttgggttggggcgcatgatgtcccgtcacctgatgtagttcatccaatcctcttcttgagtgaaatcaaaatggattaacataaacatgcatcttcaatgaaaatagatggcttgaaatgaaatctatgttaatcaatactaagatccatcaaaaacacaggcagaaaagcaccaagacagcactagagtaaatgctgctaaaacataaagacaatacaaagaatgtaacacataaggataattaagttatccttataaacaatactggagatgcattctagggtatcagttatttctgaggctaagtgttgcccaaggaacttaagactattgtctgcatcctgtttgttttccaggccccgggctattcctatccaaagacatggatatgacaaggccctgccatcaaggtgcctgcagactagtaggagagtctggtaggaaaataaccatatgataaaaatgacagaggcggccgggcatggtggttcacgcctgtaatcccagcactttgggaggctgaggcgggcagatcatgagatcaggagatcgagaccatcctggctaacaccgtgaaaccccatctctactaaaaatacaaaaaaatggccgggcatggtggtgggcgcctgtagctccagctactagggaggctgaggcaggagaatggcatgaacctgggaggcgagcctgcagtgagctgagatcgtgccactgcactccagcctgggtgacagagcaagactatgtctcaaaaaaaaaaaaaaaaaaaaaaaaaagcaaatacaggacatggagggtgggaaaggggggatggactacaggaatagcttcaggaagagaagagtgccaagggaagagcaggtacagaggaactggtgttcaccccccgaagacatctggggcaggcaaagggaaaatcagacaggtaggcaaagacaagggctgcaaccataaggagtccagacttgatcctcgggagcttcgggcaaaggagtagcaaacttggatatgcgttttggaaaaattacttattttattaaactggagttggcaaacattttctgtaagaaccaggtagcatatattttaggctttgtgggccacacagaactgctgagtactatttttgtttaagcattcctttaaaagtgtaaaaatcattcttagtttgtaggccatacaaaaacagtccacaagcccagcagtgtgcccacctctgttagataatatcaaggaatcagagctaatttaggctggtataataacggcattgtggctatgttagaacttttgttttttttttgttgtttttttgagactgagtcttgctctgttgcccaggctggagtgcaatggcacgtctcagcacactgcagcctccaccacccaggttcaagcgattctcctgcctcagcctcccgagtagctgggattacaggtatgtgccaccatgctcagctaatttttatatttttagtagagatggggttttgccatgttggcaggcctgtctccaacgcctgacctcaggggatccacccgtctcagcctcccaaagtgctgggattacaggcgtgaaccaccgcacccagaccttttttttttttttttaaattcagactgaagtctgcagtgaaatggcatggaatctggaatttaaaatatttcaatcaggaaaaactaaaaagggaaaagttaaacagcagaatcctgataattgctgaatccaagtgatgggtatatggaagttcataagaaaaaaactttaggccgggtacagtggctcacgcctataagcccagctctttcggaggccgaggcaggtgggtcacctgaggtcaggagtttgagaccagcctggccaacatggtgaaaccccatctctactaaaaaaaaaaaaaaaaattagctgggcatggtggtgggcacctgtaatcccagctacttgggaggctgaagcaggagaattgcctgaatccagaaggtggaggttgcagtaagctgagattgtgccattgcacttcagcctgggcaagaagagtgaaactctgtctcaaaaaaaaaaaaaaaaaaaaagaaaaaaagaaaagaaaaaaaagaaaaatattttaaaaagatcaggcaaggtgcagtggttcatgcctgtaatctcagcacattgggaggctgaggcagacagatcacttgaggctaggagttcaaaaccagcctggccaatgaggtgaatccatctctactaaaaatacaaaaattagccagatgtggtggtgcacacctgtagttccagctactcgacttgggaggctgaggcacaagaatcgcttgaacctgggaggcagaggttgcagtgagccaagatagcgccattgcactccagcctcggtgacagagcgagactctgtctcaaaaaaaaagaaagatcactcacactagttgcagtgggagaatggattgaggcaagacaggactgagtcctggagttccaggagtaagtcactataatccaatcaagactgatttggtagctaagtcatgtgtccctgatgacacaagtaaggaattacccccaaaacacaactcttccatataaagacccagaaactcctgaatttcttaaaagttctaaaggctgaatggacaagccctttctaaccagttttcaacacgcagcatgagtctaatagcctggttacatcagccaaaagcgtcagacatagaacgccacccactccttccaaactacatacgaccaacaacctctgggcactcttccgagcttcttgttcatgctttatcgccaaggcctagaaaagtgaatgcaaacagttaagaaccggccctacattcttgctgtctctgcctccgagactcaggagccacttttcaagagccgagacaactcgttagagaggagccgtggcctgctctggccgaaaaccccttcctattaacagactgcaactagcccggaacgactttcaatttgcagagtccaaccatattccacaagacaatctaccacctcaaggttcacgcgtggattctacaccttaaatccttggatactgtctttgatttggagatgagcaaagaaaggaaacaagacaagagaaagtgacaaaatgcttaccaacccagaacaaagagtacctaggaggggcaaaatgtacaaaggaaagatgggactaaggaacagagaagtgatatgcagatgagaagagaatatggtttgtgttctagctactgttgcatttgtcttatgaatattaggaatgtatatgattaacgtgagttggttctattgcttaaatatagaaataagaatgaaaggtgatttttccttaaagtaaaaaactgaaatagaacattctcatgccaagtagtggagaagagatttctagttgtcgtaggggaggaggtgagcaaaggcgatactaaaagggaggctgattttctgaatcaaacccggcagggactggcttggagtcattgacacaattagtctattaggctagtgtaacactaaatatagggacaagtctcagaagggaagaactacttacgtcttatttgttctttaaacactctacatcagtgattttgataacgacttgtcatatgtaacaatctgccaataactggttgagttaatgtaaaaaaataattttctaacggctgtttagtttcttctgtaaaaatccctaccctaatacactgtattgagtataccattgtttgaagtaacaacaaattggagacaacccaaatgcccccgaatagatctaaaaaaggacagaacatcgaaaacatccaaacaatggcccatccaatacttaccacagctctgtaaaacaaaacgaaacaaaacacaacttctgtgttctgacatgtagagaccagtaagataaagtgaaagaatcaaggagttagaaggatttctatcacctgtgtgaaaaaagggggaactaactagttatatttgccagtatttgcagaaattcggaaaagatacaaaggaacaaaagtggttacctaagagggtagggcctaggaagatacctaagcgggatgggaagaaatctttcactggtaactttttatatttttaatatcccagccatatgaatatattacatatttcatattattattttttttaagccttgagctttcacaaagaaatgctcctgctggccaactactttaaatgtcttagagcagcacacccagccctggcattccccagtgatcttttccgtcccacccctgggttcccgcaggctgtcccctgggtctaagaaactcttcgaccttcctctccctacctagttaactccttttctgcttgcaggaacacgcggcaggtcgcctcctccccggtgcacccgtctgtatgcaggtgcgcttccccagatgagggctaggacgcacctccggggtctctattcacacctgcagcgggagcttatcatcatcactcaccgaccaaaaaaaaaaaagaaaaaaaggtggtggggtggagcggaggggaagaaggtcgaatcagatcacccctagaggtctctctgccctcgcaatcactctcaagtcctagagtaccaaacttaactgcagagggagcacgaaatggtgggtattttgaagcgctaatttttagggatcccctcccatccaaaacagggatgaatagttgaggaacaccggagcggggccctggcccttctcggaacgttgagcagacctaacatgacgctggtccgttcaaacgtcgcagttgtggcccacacagagcccagtctgttccaggggcgcgccctgcacccctctgcctgcccgaggtcttccctcccctccgctccccagaaacgcacccactgagacatgtgcggggagggggcacgcttactcccacatcccgcccgagacccgcggagcagccaagacccggccaaaaaggggagggcgtggcaggcaagggccgggggcgggagcgcgggcggccgcggactcacgtactggctgtggcggcgccgcgggaacccggccgccagcgggacaaaagcgcggaccgcacggccggaaga

SEQ ID NO: 977 - DNA, 13674 bp, Homo sapiens; identical to SEQ ID NO: 976

SEQ ID NO: 978 - DNA, 35257 bp, Homo sapiens
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccaggtatgggaagcccctccgagcacctctgcgcctcagcctcctctttgagcttttctgatgagcactcacctctcaccctcaaacccctggggcctctcttttcctcctgaccctctctctggacctggcctcttgctctaggttcccagttttggtcccagcgctggtctctcctccgatggtaccaattccaggtctccttccacctcccggggcaggtgcacagggagcctgaaaatcccaatagataatggtgctgtgccccagccagtgaagacggtcagagaggggattctcctcacttgtctttaaatgagcatctactatttcttgcaaatgttccatgtatctggacttggcctaagccctttttatgttcagtgtcatctcgttctccctaatattaagaaaagggggttgcttgtaggactgcttggctatgaggaagccttgtttcctttttttgagaacacagagcaagtgagtggtagagcccagattcatgcccaggtctactcgaaatggtggggaacattttgaaccttccttccttctttccttccttccttcctccttccttccttccttccttcaattctctctctctttctttcttctttctttctctctctctctttccttctttatttctttttcttctttctctctcttccctccctccttccttcccttctgtgcttccttcctttcttccaatatttccctttctctcttcctcccttccttcctttctctttctttctttccttctttctttctttttctttcattctttccttctttctttcttttacttccttcctccctccttccttcctctctttcttctttcctttccttcctttcttccttccttcctctctttctccctttctccctcccttcctttcttttttctttcttttctttctttcttctttccttctttctttcttttccttcctttcttttttctttctttctttccttctttttcttttccttccttcctccctccctcccttccttccttcctccatctctctttctctttctttctttctttctttctttctttccttccttctttctctttccttctttctttctttctttccttccttctttctctttccttctttctttctttcttttgtgctgcctcccaacagagatttttctaattctgattatgtcaggatgcatagagaggggctgggagaggtcttcaaggtggggctggtgtttccagcccaggagtcctgagctgccccatctcaattgcctgagaagcacatttgggagacctcagggcaccctaagggatgtggaaaatcctatgaattacccgaaaagaagtccctggcaggttcctctccccagtcatccccctcaggagtgtccctgtcccgatgctcggtgtggtaggagttaaccctgcaggcaggaggaagccccagagggtccatctccagcaggggctgtgggtgagcagagccaggacaggggtgcatggtgaggccacagaataagacccagctctaccccagggagaggagcagggtcctcctcggagggcctgagcacactgagctgaccctggggagaccctgacaaggcttagacaggccccagggctgcagtgatctcccagtgagccatagaaggggtcagagggggaggtttggaagtgtgctaagggatgtgcggagcagggggaaggagggtggggtgcaagggaggaagtgtggggagggaggaggaggcagggcagtccaggagggctcttcctcctctggtcttttccctggctgtccacagacacttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacactagcaaatgtgtagatgtctttccttgtgtagcggacctgtagcggggaaaggtcacacaacatccctctggatccagaaaactcagctaaacctcacaggagaggaacctaaatgcagaccccaccctcactcacagagccccgcccaccctcacttacagagccccgggcgctgattggaagggacaggcccagcagtaagaggacagccagcagccagtctccctgttggaaaggaaccacaaacgtgcagtcaggggccctcgggagccgccctctgtccaccccttcctgattccacccccctagagagggagcccaggggaggccatggctgagacccaggacaggcccagtcgggggaaggagcccagggagggggcaggtgtctaggctgggcccaaagagagggctggggagaggagcagcccaggaggcagagcccagccacagaggggaggggagctgagtcccggggacaggaggctccagaggcagagacggagcccagggctagggcggcaggtgtcagggctgtggcttcagcttggcgtctgtcctgggccttctgcgctggttcccaactctgggatgtgtgacttatatgcctgattacagcggcggctcccacctcacgatttctggaaagtcctcagaagccgcatataagaccaagaacgggcctcacatgcagctgctcctgggcagaaacgactcactgtttccctggcctagacacacacaacacacaaacacacacaagacacacatacacacaacacacacaacacatacacacacaacacatgcacaaaacacatacacacacacacccacacacagtgacagagacttcacacaaagaaacctcctccaggtgccccagagcactccggggcgcaccccagccccgccctgagcagaggactttggcatttcccacgcaggggcgggtgcgggagggaccggcttgtcaaagctgccctttgcttgtgtctctgggtttgataacagtcctaactccacttgttggaagcaagtgatgaaaaacgtgcagtcattctgggcaaagggaccagtgtaggggaggcatgagaggctcacctggtgaaagaacaccagagttagtcatgtcacagggcagctcccagagagacctgcccctcgtcccccagaaccccaccttccaagggcccaggctcctgtcccccgggcctcaactcacagctttgcccatgacctgggagccctgggggtcctggtgaggtgactggacacagcctcatgacactgctgggacctgggctgggaactgagagcctgtggtccctctgggctgtaggggtcggggccccacagtggcggcagagccgggacctcgtacacagcagcatggactccagacccaagtggaacctccattctggtctcagggtgacccgggctgcacagcccagcacctgcccagggtccctctgccctgctctgtccctcaatagtctggacccctgctgggtacttgccttgtcccccccttacaggggaccagggtgaatcttgggcgaagcctgcacctgtgaaggaggccattctccttgctcccatccctgccgcccacatggggaaccagctccttcttgttcctggggacctttcctgggctctggtggaaactccagcggaatgtggggtctttcattttccctcagtgttgcagaggccgaaatggagaggggctgtcactccccaggaaagggcacaatctccttccttccctccagctggcccagggacggtgcacactcttatcctagtcaccctgaggactgcagccctggtatgagcccagagtcacccccaggttttatggatgccttacacactctgccctggcctgacctcaagaggaccaggaagtgcccagttgtcactgggttttgctgccctgagagagtcaggctccagtgcacagaggaacgtgtgtgtgcagggtggtggcactgtcagggggcacagcaatcccaggggagcgtgccctgctgttccaggttgtggcacttatggaagatcctgggtccagaggctggagtaaaatcgttcccactcacatctaacctaccctgggctggctcgtgggagtcaaaggcccagacagtggctggccctgtccatccttggccagggagggtcctggcctccctctgcgctggggggggagccccactcaccctctcttctttcctctctggaggcgctgccctgctctccggcttgtacaatttgctactgagaatttaactccagacagtatttttgccccaatttgctgtaaacatttgagcctgaggccatgtttgtcatcagatgaagtggtttacagatgtgaaattgttgtttgtagtctaacatttctggtttgtaaacccatccgtgatgggctcccagcccaacccgctgcagatgaggccgctgagtttctgttgagaatgaagaccgggttcccaattagggcaactcgtccctcacactgctccttacacccccatcttccagatcccagccaagccccctccacccaatacaccccagcgtccttgcatccaattaacatctcagagtggccacctttgcagagacctggctggggagggaggtcacagtaaagacacagcctggctcctgtgggccccctggggacagcagccctgcacacacactctgggcctttctctccccctttcagccttgtccttggatatcccccaggtcactcttgctcaggaccaagcagattgactggggacagcaaatgtaaccataaaaggggattctacaaggactcccctcagggagcaggtgccagcggtggggactggggagtagataagaggtggctgggagctaggataagagcgacagcccagagttcctggatcctggctgaggctgggtcccgggccccaggacagtcctgcagaccccagaatcagagactgaggagtcaaagacaggcaggagacgcccctggggatgcccagcaaagcactgtcccctgcgtgcagctttcccgggtctccccacagaaagctcagtgagggctgtcgtggccactggcgacccaggcacatttgctccggtaagaggccattgctctgggaagcagcagccacacaggaagagttgggggagggcaagggctctgccctccgagggtcctgcagggcacagggtctgcatagcaggaaccccagactctttgtgccccacccccactctaactcagagctctgtgctaaggagagccttatcatgccctcggtggattcagaagcactttgtagggctgagtgacgaaacatttggggctgggagtagagctggctgggtcaggacgacaccccctcctggaagggcaggcctgtggggggcacaagcagggacaacagcccattcgtgtctgctggtacaggtgcagtctctgtgcaggtgggcagtgggtactgcagggcaccatgctgtgtgtgcctcgagtgtgaactgggaaaggtggtctctggtcagactcacacaacacaccaagatgagctcacaccggaaccacccgagactcaattgggagttgacagcccccaggggatatcctcttgactagagaagtccaaggtctggagacagaatgggaggtggcatcctcatggcagagaacagggcctcctctggtctgcccatgaggagtggtgcccaccaagatggcagggacactgtgctgaggagggtggatcactcccaccttcttctgaggtttccacctcagcgagcaccggccaggctgggagggcgaggagctgtgcttggtccgggtggccagggtgggactgtccccaggatgtggactctcttgcatgagacagctggccaaggatggggggtctaagaggagccaagacaggggaatcagcaggacagggggcagcccccaggcccacagggccagtgcattcttcgggcagctgtgctgggtgcagtaggtggacctgggaaaggatggcgccagacctgccgttgggactcaggggctcacttggggcaggagcacagcttcccacacatttctgcagggctggaggtgggagaaagggcacagggtgagccttctgagggcatttgtgtccctgcatcactctgctcactgggagggcctgggcaagtctaggtacctttcagagcctctcgtatctcctctagaggagtaatggggatgaaagcaccccttgctctagtttgccgtaattagatggactgacacaaacaagggctcagcatgtctgtctccttcccttcccagggcctgggatcaagacccaggacacactctgctctctgcactgcacgccctgcagggccctggatgcagcaggcatgccctgtgctggctatagtaggggacgtagggtcggctgctctggagcctactctctgggggcgctgagtcttattcgagacctttctccagggtgtggatacctgtcctcctgcctgtcccctggcctcctgccttcctggtccctgctgcccaaagtgactgaagtgtggccaaggctcgctttcctcattgtcactccacagcatccctgtagggctattgtcagagcagggaaatcaaaaccaatgcttgtgggaagacacagcagagaacttccttattctgtgacactgatgtgggtggcacaggggacctgagttcaggaaggggtggggcaggtcattgctgacccagcagcttgcggtcactctgaagtgatgtaagcctcctgtgtcctaagagcaaccagaggaggaccacaggagcacatgctgtgaccgtcacagaagcaggaggaccctgacctaggaaccgtgaagggactaggacatgatggctaatggctaacacggtgctgacagccagtcctgcagcctctcgaagcctctgctcctgagcctcctcctcgggttccttggtgatggtcacttgcctcctgccctccaggggctccttctggttcccttggggactgtcctctccccttaaccctctctggacctggcttctgctctaggctcccagccctgttcccagccccagtctctagtctgatgctatctattgagtctcctcctgctcctggggcaggtgtgcaggggggcagcaaatcccaggtgatggcactgtgcccagggggcgaagacggttggagagaagattctcctcacccacctttagagtggcacccaccatttctggcaaatgcaccatgtctcccctctgggctaagctcttttcgcgcccaatccaaccctatcttacccaatattgggaatagggagttgctcccgacaccaccgtgctacgaggaaaagccattctttccttttcctgtgaacacacagagggtaagtggtagagcccagattcacaccggtgtctatgcaaaaccataggcagcactgagatttccctaaggccaggctcattagggttatgtagggtgcacagagcggggctgggagaggcctgcaaggcccagtaggtgcttcctgcccaagagtcctgaggtggcccacctggctagagaagcatggtcgttgcttgtttggcagaacacaggactgttgtggtatccttcattgccgtgttcatgtatataatttaaattaaaatgtaaaattaaagaaaagaaagaaagacgttagagcagccccggtcagccccggtcctgggaggtatcacccaggttgtgggctttgcactcctctcccatatgatcacagctcccctcggccccggtggcccccctgccacgccgccttgaatttgacaatgccacattagaagtcttggtcttaatcctgaatgtttcttttgcccaccttccctttcattcgcccagctgtttcaaccccaaaacgctgcttcctccccttcctctcacttccatatctaattagtaactcactctggctgaattcatccccacaattcacccccaatgtaccctgactgccatcactgtcacctgtcgcctgggatgtctgacagtctccggttcaccagctcagctcccattccctttgcatgcagctactggagtgactttgtttttttctttttttagagataagctctgtctctgtcacccaggctggagtgctgcagcgtgatcatatctcactgcagcctcgaactcctgagctcaggcaatcctccaatctcagcctcctgagtagctgggacaacaggaccatgccaccatgcctggggaattttttgtagagacagggtcttgctatgttgcccaggctggtcttcaaactcctggtctcaagcaatcctccatccttgacctcccatagtgccaggattactggcatcagccacctggcccagctctggagtgactcttcaaaagaaaaaccaggtcatgtcactgtttggtgacatgaaacaacccctaccccaaccacacatggatatgcacatgtacacatgcatgtaggctcacacacccatgtatgcatgtgcacgtgcatgtgggcacatgcgggagggtacacccagttgttgtcttttaaaatgaaatcgaggccgagtgcggtggctcacacctgtaatcccagcattttgggaggccgaggcgagtggatcgcttgaggtcgggagttggagaccagcctggccaacatggtgaaactgtgtctctattaaaaatacaaaacttagctgggcatggtagcaggcgcctgtaatcccagctactcaggaggctaaggcaggagactcgcttgaagctgggaggcagaggttgcagtgagccgagatggcaccactgcaatccagcctgggggacagagcaagactctgtctcaaaaaaaaaaaaaaaaaaagaaatttacatttttcccaatgacccatgagactccctcctcccgtgccagctttgtcaccctctactttttttttttttttttttaagacggagtttctctgttgttgcccaggctggagtgcaatggcacaatcttggctaaccacaacctccacatcctgggttcaagtgattctcctgtctcagcctccgagtagctgggattataggaatgcaccaccatgaccaactaattttgtatttttagtagagacagggtttctccatgttggtcaggctggtctcgaactcccgacctcaggtgatctgtccgcctcagcctcccaaagtgctgggattacaggtgtgagccaccgcgcccagctcctctacttgttttctatgctgtctggctggtgtctgttctagtccaggtcacccagccctctctcgcctcagaccacggcacctgccattccctctctctggacaaagcttccctcggctcttcccactgctatcccttctctccctcaggattcagttcccaagtcacctcccctggcctcttaaagcgagctgcccacacagttcccttctgccccatctccatgtctatttcctgcaccgcccttgttacaaaccagatttatcttccctgtgtgtagattctcatttcttgaccatctgcctccacttcccataaacgcactgaggtcagagtccactgcttcctgcccatgcctcgacggcagtgctggcagccagccttgccccctgggtaggaatccatttacaattgttgaaagaaaaaaaatgaatgattaaaaacagtataaaggaatgagaaaacggtggatggtaatacacaaattattcattagccccaaggagtgggctaggaggtacacagagtggacagtcacatcctctgtgatacctgtttgtattgggctcttgagtaattgacagaatgataacactgccaccagagatgagctttccatgacgaccaaggtggaggagtcagattctgggtgctgcggccaaaatacacgtttcaaaataaatgggtaaagaaattcgtcactggagactgcataaaggttggggcaattgccagagccttgcatggagaatcacacctgcttcaaagatccatttctgtgctacaaaccaccccaccttaaagcttaccataaggtgtattgttcaggcttctgtggatcaggactcagatgacctgtccactggatgagccagcagctggctcactcgtgcagctacagtcggaaggcggccaggcgggctggatggtgcccagtggtctcacttacctgcctggtacttggtgtgggctatcagccaggcacccagctgggctgtcagatgctctccctgtggtcaccccatgcatccagcttgagctccctcaccgaatggcatctgggttccaaaataccaagtctggtcaagactctgcctacatcacacttgctaatgccctgttggccaaggtaagtggtcaagctcagtgttgatatgggaggacgaggctgggcatggtggctctcacctgttattccagcactttggaagaccaaggcgggtggatcgcttgaggccaggagttcaggaccagcctgggccatatggtgaaaccctgttgctaccaggtgtgcacctgtagtcccagctactccagaggctgagacaggaggagaatttgagcccagaaggtggaggttgcagtgagccatgatggtaccactgcactccagcctaggtgacagagcgagatgcttttcaaaaagaaaatatacgtgtatgtgtgtgtgtgtttgtgtgtgtctgtgtgttgtgtgggaagccagtcacaaggatgtgaatatcagggggtgtgtttcactggggatcgccaacatgacagtttatcagtcttccctgtgtgccaatgcatcttactccacccacttgaaaataacccacccattcccaacagccacaaagtatcaccccaatatggaatcatgttcagacatcacatccaagatcctgtcatctaaatcaatcccaggtatagacagggcaccttcagtttgttttgtgggggtgagttgcctcaggttcagagatctgtgctctaaaacacaagtgatctccagctgggctcggtggctcaggcctgtaatctcagcactttgggagggtgaggcaggtggattatctgaggtcaggagttcaagaccagcctggccaacatagtgaaaccctgtctctactaaaaaatacaaaaattacctgggtgtggtggcgggtgtctataatcctagctactcggaaggctgaggcaggagaatcgcttgaacccgggaggtggaggttgcagtgagccgagattgcgccattgcactccagcttgggcaacatgagagaaactccatctcaaaaaaaaaaaaaaaaaaaaagggaatcgctagatggggctgaatatccagggggccttcatcacatgcctggaggcttgggcaggctgtcagctggggtgtttcctctctccacctggtctcgcagcatttaggactacaagtctgttttccttgcatgtaggtgagcaagtcctagatatgcaaaaaatgaaacctacaaggctactcaaagcccagccaaggaaatcacatgacatcatttctactgcattttattggccaatgcaagtcacagaccagcccagatggaaggggacaaaaaaatagactgcatcccttgatgagaagagtgtcaaaatctcatggcaaagggttgtaaaaacagaccggaggaagcgtgaggcgtacactgcacccccaccacaccagcccaagcccttagagaaaaatgatgaaaaatccacctttggccagccacggtggctcatacctgtaatcccagcactttgggaggctgaggcaggcagatggcttgattccaggagtttgagaccagcctggacaacatggtgagaccacctctacaaaaaatacaaaaaaattagccaggtgtggtggcgtgagcctgtagtctcagttatgtgggaagctgaggagagaagatgccttgagctccggaggttgaggctgcagtgagcggtgatcgtgccactgcactccagcttgggcaacagagtgagattttgtctcaaaaaaaaaaaaagtcgacatttgttagagtcacccaagcaagggaagatcagacgaataaggtctcaagtgaacattttctacgtgagcatatccaacccggggcctctgcagggcctgttttctctaggagcaaggactattagcaggcaggggatgggcctggggggcctgggaaagggagaacaggtggaggctccatacagggggacgctggggccaagctcaaggtagggcacacccctccatatcgaagtaggtcatcaagagtcatgcagacgggacaaggcaaggagttccggtgcaagctcgctaggaccctcagtaacaccagaatagaacctggacccaggatccagggcagagagaacctttttaccaaagcctgctgtcaccacccaggctgctttgccttgacagtcccactcctcaactgtaggaaggtgagaaaaattcaacttctcaagtgtgctgttcaggtcacaccctctagagggcgagcatgcagcagaggcatgcggcataaacctttgtccctttcctcggcagggtcccgtgaaagtcaggttgcaggacccccaggccacactggaggagaccctgaagctccactttgtcacccaggagtccgtgccttgcagagcctgggccaggtgctgagaaacacagggatggggctgggctgcacctgcccttgcttgttttttttgttttttgttttttggtttttggtttggtttggtttttttgagacagagtcttgctctgccactcagactagagtgcagtggcaccaactcagctcactgcaacctctacctcccgggttcaaatgattctcttgtctcatcctcctgagtagctgggattacaggtgcacgccaccacacccagctaattttttatatttttggtagagatggggtttcaccttgttggccaggctggtctcaaacttctgaccttaagtgatctgcccaccttggcctcccaaagtgctgggattacaagtgtgagccgccgcgcccggcctgcccttgctttttgggttttgtctttgccacccagagtggcgtcacctggataacatgccctaagactgcagggatgtaggtgagtctgtcccagtccaggaaaccaaggctagtatcagattggctttcatggcttctgggcagagcccagatctgcacctcacgtgtcccggagtcagggaagggtgatactggcttccccagttctgccctctggacgggcgctccgttgacagagaccctgaagagcatcatgccaggtgtggcctcaaatagtaaagataagagaaacagaactcgaggaggagaaatatagaggccaggccaaggccgtgcacagccccctacagcatctggcactgtggtcgcttctttactctgcctccctcctctggagctcccgtgaatgtgagcgtcctcctcctggctggacggcatctcctctctctgggccttctgccctggccccatcctccctcggactgggtgccgagtctcaatgttggtcacttatgaccccaaatcgccttctccagctggacacccccagtctcctgggctggactctgcagtcacctttagtgctcccagctcccctgttcctaagccctgctgtttctacctttgggaggacacgcaggctgtcagcccatgtttgccgagtgctacggtgcttgagtgtgcatagccctaaacagggagctggcactgggtgttatgactccccttgctgtaaactttaaggactcaaacagaagcagaaaaaagtgaaaataagcaacatctactgagtactgaccacccaccaggctccgttccttatgcctgaaggggagcggctcatttaaaccttacacctgaatgggagcgctcattgaacccttgcgcccaaccccacagtgaggagccatcattttcaccttccctgttcagatgaggaaatggactattgcagttagaggttgcaaagccaagctggggttgacccagccaggtaggtctctacccaggtgctcaaacgcagctggggcaattgaaacaagtcttgaaatcagttacagagattctttcttttttgtattttaccatttacctaactttacatgcaacttccttagttcagatacaatgtttcattaaaaaaaaaaaaatctgggctggacatggtggctcacgcctgtaatcccagctctttgggaggctaaggcaggcagatcacttgagatcaggaattcgagaccagcctggccaacatggtgaaaccctgtctctactaaaaaaaatacaaaaattagtcaagcatggtggcacatgcctataatcccagctactctagaggctgaggcagcagaatggcttcaacccaggaggcagagtttgcagtgagccgagatcacaccactgcactccagcctgggagacagagtgagactctgtctaaaaaaaaaaaaaaaaaagtctgctcttctttagagcaagggtccccaacccccgggcctcggatgggtacaggtacatggcctgttaggatcccagctgcacagcaggagatgagccgtgggtgagtgagcattaccgcccgagctctgcctcctcttacatcagtggcagtgttagattctcacaagggcgagaaccctattgtgaactgctgtgaactgcacatgcgagggatctaggttgggtgctccttataagaatctaatgctggccaggcacggtggctcacacctgtaattccagcactttgggaagctgaggcaggagaatcacttgaacacgggaggttgcagtgagctgaccctgccattgcactccaacccccggcgacagtgtgagactctgtctcaaaaaaaaaaaaaaaaaaaaaatctaatgcctgatgatctgaggtggaacagtttcatcccaaaagcatccccctcaccctgtcagtggaaaaattgtcttccacaaaacgatcactggtgccaaggagtttgaggactgctgctctagaggaaatcatacagtgtcctactgggaaactacctttaagaaaggaagttaacgtgttctttaattcacagatggaattttcaaatatttgcaacccaaattattcctattttaaattataaatgcaccagtaaaatgctttttttaaaaaaaaggtttttggctgggcgtggtggctcaagcctgtaatcccagcactttgggagcctgaggcgggcagatcacgaggtcaggggatcgagaccatcctggctaacacggtgaaaccccatctctactaaaaatacaaaaaatcagctgggcatggtggtgggtgcctgtagtcccagctactcaggaggctgaggcaggggaatggggtgaacccgggaggcggagcttgcagtgagccgagattgcgccactgcactccagcctgggagacagagcaaaactctacttcaaaaaaaaaaaaaagtttaggctgggtgcggtgactggtgcctataatcgcagcactttgggatgacaaggcaggcagatcacttgaggccaggagttcaagaccagcctggtcaacatggtgaaacccagtctctactaaaactacaaaaattagatgggcttggtggcatatgccagtactcccagctactcgggaggctgaggcaggagaatcgcttgaacccaagaggtggagttgcagtgagccaggatctcaccattgcactccagcctggctgacagagcgagactctgtatcaaaaaaaaaaaaaaaaaattacacacttaataacagaccatcaaaatatatgaagcaaaaattaacagaattgaaggagaattagagttctacaataattggagacttcaatacccaatgctcaataatggacagaacaaccagatagaaaaaaaaggaaggaaatagagaactcaacacaataagccaactagatctaacagacatatatggaacacttcacccaataacagcagacagccgctgtggaaaacagcatggcagttcctcaaaaaattaagaatagaatggccagatgatccagcaattccactgccaggtgtacactcaaaaaaattgaaagcagagtctcaaggaggtatttgtacacccatggaggtaacccaaattttcatcaacacatgaatggagaggccaaatgtggtctacacatgcaatggaatattactcagccttgaaaaggaaggaaattctgactcacgctacaacatggatgaaccttgaggatattatgctgagtaaaataagccaatcacataaagagaaatactgaatgattccatttatatgacgcacttagaatattcccaatggccagtctggcgcagtggctcaagcctgtaatcccagcacttcgggaggcccaggtgagcggatcacctgaggtcaggagttttttgtttttgtttttgtttttgttttgagacaggctgtgtcatccaggcaggagtgcagtggcatgatcttggttcactgcagccttcacctcctgggctgaagcaattctcctgcctcagtagcccgagttgctggtattacgggggggcccaccaccatgctcggctaattttgttttgtttttttttttttttgagacagagtcttgctctgttgcccaggctggagtgcagtggcgtgatctcggctcattgcaacctccacctcctgggttccagtgattcttctgcttcagcctcctgagtagctaagactacaagcacacgccaccacccccggctactttttttggtgtttttagtagagacggggtttcagcatgttggccaggatggtctcaatctcctgaccctgtgattcgcccaccttggcctcccaaagtgctggcattacaggtgtgagccaccattcctggccaatttttgtatttttaatagagacaaggtttcaccatgttggccaggctggtctcgaactcctgacctcgtgatccttccgcctcggcttcccaaagtgctgagattacatgcgtgagccacctcacctggcaggttcaggacttcaagatcggcctggccaacatgccgaaaccacgtctctattgaaaatacaaaaattagctgggcatggtaggatatacctgtaattccagctacttgggaggctaaggcacgaagaatcgcttgaacctgggaggcagaggttgcagtgagccaaaatcgtgccactgcactccagcctgggtgacagagcaaggctccatctcaaaacaaacaaacaaacaaacaaacaaacaaacagagaatattcaaaatgttaaagacagaaagtagcatggtggttgccaggggctggcagaggagagaatggggaggagggaatgaagattttgcattaaacgggtacagagtttcagtcttacaagatgaaaagagccggccgggtgcagcggctcacatctgtaatcccagcactttgggggggccgaggcaggtggatcttttgaggtcaggagttcaagaccatcctggccaacaaggtgtaaccccgtctctactaaaaatacaaaaattagctgggtgtggtggtgcgcacctgtaataccagctactcgggaggctgagggaggagaattgcttgaacctgggaggcggaagttgtggtgagctgtgattgtgccactgcactccagcctgggcaacagagtgagactctgtctcaaaaaaaaaaaagaaaaagaaaaagaaaagagccatggagaaggatggtggtggtggttgcacaacattacaaatatgattaatatgtttaataccactaaactctgtacttaaaaatggtcaagatggtagattttatgttatgtataatttaacacaacatttttttctttttttttattattattatactttaagttttagggtacatgtgcacaacgtgcaggtttgttacatatgtatacatgtgccatgttcacaacatttttaaaattggaaaaaaagaaaaccagcagcaaggattttaccagagcaataagtagatgacagtcacatgaaaaagacattcgacatcattagccattagggaagtgaacattaaaatcacaatattactacagacctatcagaatgttaccacagacttatcaatgggtaaaataaaacttagtggcagtgccaaatgctggagaaactgggtcatttatacattgctggtgagaatataaaatagtacagctattctccaatttagtttagtagtttctttctttctttctttctttcttttttgagatagtttctcactctgtcacccaggctgcagtgcagtgggacgatctcagctcactgcaacctctgcctcccgggttcaagtgattctcctgcctcagcttcctaagtagctgggactacaggtgtgcaccaccatgtccagctaatttttgtatttttaggagagacggggtttcatcatgttggccaggatggtctcgatctcttgacctcatgatccacccgcctcagcctcccaaagtgctggatttttattatttttattattttattttatgttattttgagatggtgtttcattcttgttgcccaggcttgagtgcaatggtgcaatctcggctcactgcaacgtctgtctcccagtttcaagtgattctcctgcctcagcctcccaagtagctgggattacaggcatgcaccaccacacctggctaattttgtattcttttttagtagagatggggtttctccatgttggtcaggatggtctcgaactcccgaccttaggagatccccctgactcggcctcccaaagtgttgggattacaggcatgagacaccacgcctggactatttttttattttttgagatggagtctcactctgtcgcccaggctggaggatactggtgagatctcagctcactgcaatgtccacttcctgggttgcatctattctcctgcctcagcctcccaggtagctgggactacaggtgcgtgccaccatgcctggctaatttttgtaatttttttttttttttagtcgtgacagggtttctccatgttggtcaggctggtctcaatctcctgacctcaggtgatccacccgcctcagcctcccaaagtgctggtattacaggtataagccactgcactcagccatatataaccttcttcaaataaaattacacaggtggaaaatttttttctttctttttttttttttgagacagggtctcactctgtcgcccaggctagtgtgcggtgatgatgtaatcatggcttaagtgatcctccccgcctcaacctccctagtagctggaattacaggtgcacaccaccacatctgactaatttttttgtttttgtttttgtagacacggggtttcagcaagttgcccaggctggtttcgaactcctgacctcaagtcatccgtccacctcggcctcccacagtgctgggattactggtatgagctaccacaccttgcccgaaaacgttttcaaaataataaaatgggctgggcaagtggctcacgcctgcaattagaggcctggagacattaagtaaaccacccaaggtcacacagtaaggaaggggcagatctcagagtcgcctggctgcaaagctggtgtcccttccccactgtgccttaactgccgccttacagctgggttggaggatgcctccctggtctagggtcattattacattttcttttacaaagtatgtttctgataaacggaactgtttattttccaccgatggtcttatcctttgtccatctctttctgacggcaacagaaaacttcaccttccagaggagcgcctctgcctggctgtcccaccgtctgggaagtaaggagcgcctctgcccagcccccgcaccgtctgggaagtgaggagcgcctctggacggcccccgcaccgtctgggaagtgaggagcgcttctggacggctcccagcaaccccccaggtgtgaagtgacagccctgtgtgtgatctttctgccctccccaagtttgcattttcgacaataaaatttacttttaaattaaaagatttatactggggaagatttaaaaaaaaaaaaagaaagaaaagaaaactcaccttccaaaaacaaccactgggagtccgctttgtgcagaggttggacaagcttctgtgcaggtaggggcgctgctgctccccctaccacccacgcatcctcctccctgtctgcattcccgtcgtcgtagccagaggagttcagagcctctacagagagcacaacttctccagctggaacaaactccccttaaaggaatctatttaggaagattatttcaatgtacattcattcctccaaaatatgcttagatggacttaaataatcagaaagctgtgtgtgtatgtgtttcccgttttcttggcccacaaagaaccccttgagaggtccctgggcagtgagcctgtttatagacacccttctcccttccttggtgtcgcagacatcgcagtccctctgaggggctgacctgccccccaccttctggaagctgggaggttggaagaggggacgcatgccatggacccagcacacagctgggaactcgaggcacacctaagccttcccttgtgctgtgcggagtccacacttccttccccactggagtctcaaaacctcccctcactcaacagggtggtgctgctcaaagctctgggcacacattagggctggggagggggtggtggagagggggctccagcctgcccaaccaccaggcaacggggcacctgcccctctctcagctgggtctggacccgcctcccaggctcaggctgcaatgcctttctctttctctttgcaattccgttgggtcctgcccaggacagataaagacagagcagcctgtctttattggaggttcctctgccagcgggaagggtccggggaaaaccagagccagagccagagccagagaaacatgaagcaccccggggcctcccacaccaatgcctgagcaggaatggggaggggccatgactcataaggccctgggaggtcactttaaggagggctgtccaactgcaaggacgctgtaagcaggaagtgaaaccacagagcttcaaaaaaagagcgggacagggacaagcgtatctaagaggctgaacatgaatccacagatcaggtaccgctgcccactctgcctgctgggcccctcctgccccttcctgcctggtggtcctgctgggcctcaaccctggcctccccccgcccctgccccagccctgggctccctcccctctggctcccctgccacacgaatcccagtcaggctctttgtcctgctgtgtggtcaccccactgctgcttctgaatgggctgcctcccctacctgcaccagcccaggccccgtgctgagactctcccttaaagtcatgcccggactggtgctccccgccctgggagggtgctccctctgtgtgcttcctgccactcctgagctcagaaactgggagaattgaaccaaagggtaattggagcaatcaggcatttttgttctcagtgttttgatgaaatttctgtaagaattactttgcttaaatacaaagtcttaggagagggtgcgggggtaggaatggtctctgaagcacatgataaatcgtgtcatccaaggatgactccatggtgagcagatgtccccagacaggttccactccaaggtcactcttcatcttttagaacatgaccagtggttgagcgtggtggctcacacttgtaatcccaacactttgggaggccaaggcgggcggatcatgaggtcgggagtttgagaccaacctggcccatatggtgaaaccccgtctctactaaaaaacatacaaaaattagccaggcatggtggcgcatctctagtcccagatactcaggaggtttaggcaggagaattgcttgaacctgggaggtggaggttgcagtgagctgagatcatgccactgcactccagcctgggcgacagagtgagacttcatcaaaaaaaaaaagaaagaacatgatcagtaacatggaatgtgagaatgtgggaaaaaagtgcaatgatgaggagaaatgctctgattttaaaatttagtgaaaagagagcccagtccccaacagctttctcctacaggatccgtgatgcagaggctggacagggctggcctggaaaggggcccctgctccatccgtccccagctctgtggcctcggcaggttaccccgcctctctgtgcctctggcatctcctctgtaagatgggaatggcccctgcaggcctagggtagcctcacgtgagctcacacccgctcagcacttagaagagtggcctgggcctcagaattcagttctaccatgattttaaaataatgttaacacgcagagtgaaacatcaggaaggaattgagctgaaaggttaaaagctattttttaggggtgaagggttttattctcttttgcattctcctaatgggttggggagtgggttggcagaaatactaggagggtggggaatgtacccctggaaaggccagagttggacccgagctgggagagatcaccccagcccgcctgccagcatcccctcctcttcctctcccctcagtcttcctgcctgggaaggcagcagaaattctcagggctgtggaggggtcggggaggcccagggccatcctgggagctgtgttcagtggacatgagccccgaggactcccgggagggctccctgcatgggccggtttctctcttgtgccttcagaaatccgatggagcggatgtatcgagacacattctacgacaactttgaaaacgaacccatcctctatggtcggagctacacttggctgtgctatgaagtgaaaataaagaggggccgctcaaatctcctttgggacacaggggtctttcgaggccaggtaccacccaaacttcaatcgaatcacaggcagtgttgcaggaattagaggactggagagactgatatgggtgagacaggaggatttatttaggtgcactggttcagcagactcacatccaaaaaggctgagcccttaacaaagacagactgaggtatttataagcaaacttacagaagcagaacaaaggcgattaatcaaacagtgacaggtcacataatctatagcataacagatgacttagcataacttggggccttctatagctggtggccttgcagctacatcaaaaggaaaacaggaactggctaaatacagacatttgtaaaatatagttataatggttctggaaaggagagacagtaaaggaatttgtcttttttttaaaaaatttttttaaaattttcttcaaccttgccctggaggggtgtgggggtggtgtctggagcccattcctttggccttgacttttcaggcagtgttataactgtcgttggagtgagctggctaggcagaggaaaacttgttcttcttttctttttaacccttgctacagtaggacctaagcagctggaaatgcagaaaacacaacaataagtaaaatgcccagcactgggctctcaattgtgtatttttcccacatttcttttttctctttttttccttttttttttttttttttttttccgagatggagtctcgctctggcacccaggttggagtgcaattgcacaatcttggctcactacaacctccacctctcaggttcaagtgattcttcggccttagcctcccgaatagctgggattacagaaggctgccaccacgcccagttaattttttctatttttagttgagactgggtttcaccatgttggccaggctggggaattcctgacctcaggtgagtcacctgccttggcctcccaaagtgctggggttacaagcatgagtcaccgcacctggccacttcccacagttctgtttttttgttttgttttgttttggtttttttttaagactgagtttcactctttgttgcctgggctggagtgcaatgactcactctcaacttccacctgccaggttcaagtgattctcctgcctcagcctgtgagctgaacagtcacatgagggtgaaggttgttgccacaagctcaggggatgctccagacagagtggcctgggatgtcgagtcacagctgctccatgccacggggacaagaggaagcaggagtttagtctgacacactgcccttccagatagagggcaagagacagaaagaggggctgaagtcacccttgaataaccacagcagtggcacccacaaaggtgcagtccccacagcctcatagcctcttctaggtgccacctcttaaggccattacaatagccattaacactgaacgtgagctttggagcagacaatcactcaaactaaacaggggggatggaggaaaggagcttcaatggcaagatcccctgggctcctgtcctggcccctcctctccctgccccacccctgcactcctcctgctccccctctcagagcatcccctgccccctgctcctctcccaggtgtatttcaagcctcagtaccacgcagaaatgtgcttcctctcttggttctgtggcaaccagctgcctgcttacaagtgtttccagatcacctggtttgtatcctggaccccctgcccggactgtgtggcgaagctggccgaattcctgtctgagcaccccaatgtcaccctgaccatctctgccgcccgcctctactactactgggaaagagattaccgaagggcgctctgcaggctgagtcaggcaggagcccgcgtgacgatcatggactatgaaggtgagaggtggaggggtcaggggagcgtgagcgggaggaacagcatgaaagatggatggatctgcaatgccatggctgggggtgtcccagggcagcctgcaggggtgggactggcactgactgcaactgacagccaggagaccaggcctgggaggacaggccagggtcaggggagagcctgactgcttcccgcttcttcatctcagaatttgcatactgctgggaaaactttgtgtacaatgaaggtcagcaattcatgccttggtacaaattcgatgaaaattatgcattcctgcaccgcacgctaaaggagattctcaggtgagggtctccctctggcctcatcatctctctcctctcacctgctcatcctcctgaggcctccgttggcctggccctcccgccctccctcttgacccactgcctgccctcatggtcacaccaccttcccttaactcctggtgctccctccacactgcctcctccctgctttcctgggcccttcctgtgagtaagaggccccttctgcctctaaggcacctgggtcttggactagaggaacaaacagcaagacagggtggcctgggacaccagccgctgcccttctgtgacatggggacaagaggaggcaagagctcagccttccagggaacaactctgggcaggagatgtggaaggaaggagctcagtgtgggggcacccatggcatcctggggggacatctgagggccacccccacccgctattcctccctccaatggtggcctctgagtgtgaaggcatgggggaaggcagacacctgcccctgactctccctcactaccacatagctgctgggtggctggggacggggggggtccctgggatgattcctgagggcaggatccaggggtccctccagatgtcctcccatccaggtgagaaagcagcataaagtgaggcttgcactcagatgggcctgggaggtcactcacagcgcaggtgtctcctggaacaagggccctggaagatagaaatagaatccaaacccaggactaacatcagggccaagacaagcctgccagggaggctgcacatgaagccccagatcagggaccactgcccgctctgcccatggggcctctgctgccctttcctgcctggtggtcctgctgggcctcagccctggcctccccctgtcccagccccagccctgggctctctcccctcctgttcctctgccacccccactcccagccaggctctttgccctgttgtgtggtcgccccactgctgcttctgaatgggccacctcccccacctgccccaggccagaccccctgctgagactcttccctgaaagtcaccgctgggctggtgctccctgccctgggagggtgctccctgtatatgcttcccaccattcctgagctctggaactgggagaattgaaccaaaggatgattggagcaatcaggcattttgttcttagcattttgatggaatttctgtaagatttactttgtttcaacacaaagtcttaggagagggtgtgggggaggaaatggtctctgtaccagaaaataagtcatttcttccaaagacgcctccgctgtgagcagaggaggatgcacacgaccccagacacaggctcctcctccgtgagcaccattcaccttttagaatgacacctgcaacatggagtgtaggaaaacatatgatcaggagaaatgctcttattttaggcagggcacggtggcttatgcctataatcctagctctttgggaggctgaggtgggtggatcacttgaggtcaggagttggagatctgcctggccagcgtggcaaaacctcctctctactgaaaatacaaaaaatgagccaggcatggtagcgggagccggtaatcccagctacttgggaggctgaagcaggagaatcgcttgaacccgggagggacagcagtgctggtcacggaaacacccaggactcaggactgaagcacaagtgtttccagtccccacacactaaaaaggagacaagaactcctcttcgagcttttctgatgagcactcacctctcaccctcaaacccctggggcctctcttttcctcctgaccctctctctggacctggcctcttgctctaggttcccagttttggtcccagtgctggtctctcctccaatggtaccaattccaggtctccttccacctcctggggcagatgcacagggagcctgaaaatcccagtggataatgatgctgtgccccagccagtgaagacagttggagaggggattctcttcacttgtctttaaatgagcatctactatttcttgcaaatgttccatgtctctggacttggcctaagccatttttatgttcagtgtcatctcgttctccctaatatttagaaaagggtgttgcttgtaggaccactttgctatgaagaagccttgtttccttttcttgagaacacaaagcaagtgagtggtagagcccagattcatacccaggtctactagaaattgtggcaaacagagattccttccttccttcctcccttccttccttccttccttccttgcttcctctctctttctctctttctctttctttctttctttctttctttctttctttctttctttctttctttctttctttctttcttcctttcttctctctcgtctttcttcttttgctgctgcctccaaacagagatttttctaattctggttttgtcaggatgtctacagaggggccgggagaggccttcaaggtggggctggtgtttccagcccaggagtcctgagctgccccatctggcctgagaagcacgtttgggagacctcatggcatccaaagggacgtggaaaatgctatgaattatccaaaaagatgtccctggcaggctcctctccccaatgatccccctcaggagtgtccctgccccaatgctgggtgtggtaggagttaaccctgcaggcaggaggaagccccagcaggtccatctccagcaggggctgtgggtgagcagagccaggacaggggtgcatggtgaggccagggaaggagacccagctctaccccagggagaggggcagggtcctccccggagggcctgagcacactgagctgaccctggggagaccctgacaaggcctaaacaggccccggggctgtgttgacttcctgataatccaccagaaggggtcagagagagaggatcagtggcccccacaaagggagtggaagcgcctcctctgacaggtgcctcagtatatggggagcagggaaggagtggggggtgcaggagaggagcgagaggtagtcccaggaggagtcttagggcttttggtttcccctgtctttgtccacagatacctgatggatccagacacattcactttcaactttaataatgaccctttggtccttcgacggcgccagacctacttgtgctatgaggtggagcgcctggacaatggcacctgggtcctgatggaccagcacatgggctttctatgcaacgaggtgaccgacccagccacctgcatccaggcagggccctcccaatccagggacactcatagatagaaggttctgggtggtgcctgtggtttcctgcagtgtttgtcacttgtgcttcctgcagctgctgctgcttggccctggagttggggggagactttggcttcagtgactctccatggccaggtggggttgagtctgcccaatggcaaagtgcttcctgaggaccctcccaggatcccctcacagacacagctctcaccaggaatgattcggaactgtgggatttgaggactcagggcctacctgactcacaaggccaggatgtccctgtgccctctcttgggcttcatcctgcggagagacagactggggcaggagaggctgatcaggggttttgtcctgcccagggtggagcccacagcaaggccagaacaggtcccatgtcaggatgcaaagatggccagcagttggggaagaactgggccaggaaaggctgagggggccaggctaggctggccaggagccctgagcccaagggactttcttccctggcccctacccagcacagcctctgtctggagaggccaagttctgcttggctctgttgctggaaactgggggcttctctgggctctatgagctcaatgtgggcctcgctggatccacacacactgcttggaacatcctttcaagggtgccagtctccatcaccgcctaagcagtgggactcccccaggaatgacccacagccccttctcagcacaaaccatgtcatccacttcaccctgcatcccctctgatggaatccctccctgtctttgtccccatcacaatcacagtccttgctgccctgctgtccccaacttgaccgattcctagtcttagtggaaaatccttttctctgaagtttggagtaaataccatatttctataagtcaaaataatgacaattataccatgtcacagggaccttcccacattggagtgagtcctgctggtcttctcttccccactacttttggtggaattcattttggcctaagtctatatcacatttgggctcagcacaggttgtggcacagaatagaagtttctagaattatgggccacagatgggatgggagtaggggagttgatgagtagagcaggtcaatctccccttgaaggaagcacactcactcaggggcatcaggccaatgaccttggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatattggagctggggcaaaataaaacctcattgctcctgatctgtttgtatttaaatgggcaacattttgcttatcttgggatttttgcataacatctgatatttttaatattgcatagaaaatcatgcatcctaataaccggggttttggcgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgcatcttcgctgcccgcatctatgattacgaccccctatataaggaggcgctgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatatgggcccggggagggtggctggaagtggaagcagaacttggggatttccgaaagaaagagaactgggctggcccagattccaatgggaaggaagtacctgatgaaggagctaagtccctaggggagggagagggaaaggagggactgaaaccaggatgtgggaagtctgtcctgagagtcatgggcccttggtgctgccccctccccacaacaggagcgtgacttatctcccctgtcccttttcagagtttgagtactgctgggacacctttgtgtaccgccagggatgtcccttccagccctgggatggactagaggagcacagccaagccctgagtgggaggctgcgggccattctccaggtgagggcttcctccctctgcctggtgccccatcggcctccccctcctccccgctcccctgtgccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacaccagcaaagcaatgtgctcctgatcaagtagattttttaaaaatcagagtcaattaattttaattgaaaatttctcttatgttccaagtgtacaagagtaagattatgctcaatattcccagaatagttttcaatgtattaatgaagtgattaattggctccatatttagactaataaaacattaagaatcttccataattgtttccacaaacact

SEQ ID NO: 979 - DNA, 5662 bp, Homo sapiens
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccaggtatgggaagcccctccgagcacctctgcgcctcagcctcctctttgagcttttctgatgagcactcacctctcaccctcaaacccctggggcctctcttttcctcctgaccctctctctggacctggcctcttgctctaggttcccagttttggtcccagcgctggtctctcctccgatggtaccaattccaggtctccttccacctcccggggcaggtgcacagggagcctgaaaatcccaatagataatggtgctgtgccccagccagtgaagacggtcagagaggggattctcctcacttgtctttaaatgagcatctactatttcttgcaaatgttccatgtatctggacttggcctaagccctttttatgttcagtgtcatctcgttctccctaatattaagaaaagggggttgcttgtaggactgcttggctatgaggaagccttgtttcctttttttgagaacacagagcaagtgagtggtagagcccagattcatgcccaggtctactcgaaatggtggggaacattttgaaccttccttccttctttccttccttccttcctccttccttccttccttccttcaattctctctctctttctttcttctttctttctctctctctctttccttctttatttctttttcttctttctctctcttccctccctccttccttcccttctgtgcttccttcctttcttccaatatttccctttctctcttcctcccttccttcctttctctttctttctttccttctttctttctttttctttcattctttccttctttctttcttttacttccttcctccctccttccttcctctctttcttctttcctttccttcctttcttccttccttcctctctttctccctttctccctcccttcctttcttttttctttcttttctttctttcttctttccttctttctttcttttccttcctttcttttttctttctttctttccttctttttcttttccttccttcctccctccctcccttccttccttcctccatctctctttctctttctttctttctttctttctttctttccttccttctttctctttccttctttctttctttctttccttccttctttctctttccttctttctttctttcttttgtgctgcctcccaacagagatttttctaattctgattatgtcaggatgcatagagaggggctgggagaggtcttcaaggtggggctggtgtttccagcccaggagtcctgagctgccccatctcaattgcctgagaagcacatttgggagacctcagggcaccctaagggatgtggaaaatcctatgaattacccgaaaagaagtccctggcaggttcctctccccagtcatccccctcaggagtgtccctgtcccgatgctcggtgtggtaggagttaaccctgcaggcaggaggaagccccagagggtccatctccagcaggggctgtgggtgagcagagccaggacaggggtgcatggtgaggccacagaataagacccagctctaccccagggagaggagcagggtcctcctcggagggcctgagcacactgagctgaccctggggagaccctgacaaggcttagacaggccccagggctgcagtgatctcccagtgagccatagaaggggtcagagggggaggtttggaagtgtgctaagggatgtgcggagcagggggaaggagggtggggtgcaagggaggaagtgtggggagggaggaggaggcagggcagtccaggagggctcttcctcctctggtcttttccctggctgtccacagacacttgatggatccacacatattcacttccaactttaacaatggcattggaaggcataagacctacctgtgctacgaagtggagcgcctggacaatggcacctcggtcaagatggaccagcacaggggctttctacacaaccaggtgaccgacccagccatccgaatccgggcagggcccttccaatccagggacattcataggtagaaggttccggattgtacttgtggtttcctgcagtgtttgtcacttgtgcttcctgcagctgctgctgcttggccctggggttggggggagacttcggcttcagtgactatccatgcccaggtggggttgagtctgcccaatggcaaagtgcttcctgaggaccctcccaggatcccctcacagacacagctctcaccaggaacaattcagcaatgtgggatctgaggactcagggcctacctgacctcacaaggccaggatgccccagtgccctctcctgggcttcatcctgcacggagagagactgaggcaggagaggctgaccagggatcctgtcctgcccagggtggagcccacagcaaggccagaacaggtcccatgtcaggatgcagggatgtccagcatttggggaggagctgggccaggccaggctgaggggccctgagcccgggggactttcttccctggcccctacccagcacagcctctgtctggagagaccaggtaatgcttggctccggtgctggaaactgggaccttctctgggctctatgagctcaatgtgggcctcgctggatccacacacactgcttggaacatcctttcaagggtgccagtctccatcaccgcctaagcagtgggactcccccaggaacgacccacagccccttctcagcacaaaccatgtcatccactccaccctgcatcactgctgatggagtccctccctgtctttgtccccatcacaatcacagtccttgctgccctgctgtccccaacttgaccgattcctagtcttagtggaaaatccttttctctggagtttggagtaaataccatatttctataagtcaaaataatgacaattataccatgtcacagggaccttcccacgttggagtgagtcctgctggtcttctcttccccactacttttggtggaattcattttggcctaagtctatatcacatttgggctcagcacaggttgtggcacagaatagaagcttctagaattatgggccacagatgggatgggagtaggggagttgatgagtagagcaggtcaatctccccttgaaggaagcacactcactcagggccatcaggccaatgacctcggggctccgccggcccctcctccctgcccccatctctgtagcccctccctgcagggctgggtctggggtgagggtcctgaaggctctgaccttgggtacaaaattgatgggggctccaaatgctcagtaattagagaaaacacattttaatttaataattaatgcaatattttaaaacgcaaatttaatacaaatagatcatgatgaataaaagcaaagattttaataaagcctggcaggagagtgctgtcctgtgtatagtggagctggggcaaaataaaacctcattgctcctgatctgtttgtatttaaatgggcaacattttgcttatcttgggatttttgcataacatctgatatttttaatattgcatagaaaatcatgcatcctaataaccggggttttggtgacccctctaatttcgtgctggaggcccccgcctccccagccccacctggtccaggcgctccctccctgttcaccacacatcacctcacactctgtttccttttctaggctaagaatcttctctgtggcttttacggccgccatgcggagctgcgcttcttggacctggttccttctttgcagttggacccggcccagatctacagggtcacttggttcatctcctggagcccctgcttctcctggggctgtgccggggaagtgcgtgcgttccttcaggagaacacacacgtgagactgcgtatcttcgctgcccgcatctatgattacgaccccctatataaggaggcactgcaaatgctgcgggatgctggggcccaagtctccatcatgacctacgatggtaagaatggaaggttcaggtggggtggggtgggtgggggcaggagaggttcctgggaagaaaaggagaaaggccttggtctgctgcctgcagaaacgatggctggactctgggacctgactttggggtcgatgggaagagagaggccaggccaggagatgtgggcccagggagggcagggagagtggctggaagtggaagcagaacttggggctttctgaaagaatgagaactgggctggcccagattccaatgggaaggaactgcctgatgaaggagctaagtccctaggggagggagagggaaaggagggactgaaaccaggatgtgggaagtctgtcctgagagtcatgggccctaggtgccaccccgatcccacagcgggagcgtgacttatctcccctgtcccttttcagaatttaagcactgctgggacacctttgtggaccaccagggatgtcccttccagccctgggatggactagatgagcacagccaagccctgagtgggaggctgcgggccattctccaggtgagggcttcctccctctgcccggtgccccatcggcctccccctcctccccactcccctgggccttgccttcccctctgctcagagcctcctctgggttccctgctccccacagggcgcccagctccgtccctccctttccttctcacagcctccttctctttcccacctcccgcatccctccctcctctcccgtcattgtcactgtccccaggccacctccctgtgccctctttccactctctcacctcctgctccattcaacccccctgctcttccagaatcagggaaactgaaggatgggcctcagtctctaaggaaggcagagacctgggttgagcagcagaataaaagatcttcttccaagaaatgcaaacagaccgttcaccaccatctccagctgctcacagacgccagcaaagcagtatgctcccgatcaagtagatttttaaaaaatcagagtgggccgggcgcggtggctcacgcctgtaatcccagcactttggaggccaaggcgggtggatcacgaggtcaggagatcgagaccatcctggctaacacggtgaaaccctgtctctactaaaaatacaaaaaattagccaggcgtggtggcgggcgcctgtagtcccagctactctggaggctgaggcaggagagtagcgtgaacccgggaggcagagcttgcggtgagccgagattgcgctactgcactccagcctgggcgacagtaccagactccatctcaaaaaaaaaaaaaccagactgaattaattttaactgaaaatttctcttatgttccaagtacacaatagtaagattatgctcaatattctcagaataattttcaatgtattaatgaaatgaaatgataatttggcttcatatctagactaacacaaaattaagaatcttccataattgcttttgctcagtaactgtgtcatgaattgcaagagtttccacaaacact
